United States Patent 11,602,557 (BUNYAVIRALES VACCINE) - sequence listing, part 3

SEQ ID NO: 3578 - RNA, 5067 nt, Artificial Sequence
  derived and/or modified CDS sequence (wt) from CCHFV(5180-R-2011)__KR814874.1__GP
augccuaccaacauuaugcauacgcuauuagugugcuucauucuuuaccuacagcuguugggucuaggaggagcucauagacagucaaacgcaacugaacacaacggaacaaacaccaccacagcacccagcacaagccaaagccccaagccaccugugagcacagccccaccauacgcaccggaaucauccaccaucaaacccaccacaccagcaagcgaaacagaaggcucaggggaaacgaccccacccccaaacaccacccagggcccgucuccaccagaggccacaccagaacgccccgcaacaacugccacaaguacgccaagcacagacaacacgaacuccaccacacacgcgaccgacaacaacccuacaucaacaaucagcacaaguccauccagcagccccagcacgccauccacaccacaaggcauacaucauccugcaaggaaucuauugucagucucgagcccuaagacagcaacaacaccaacaccaacgagcccuggggauauaagcucagaaaccagcagucugcacucagccaugagcagaacaccaacccuccacacagcaacccaggccuccacugaaaaugccaaccacagcgcaccuagacagucugaguccucagcacagcagacaaccacaagcccaaugacuuccccagcacaaccaauccuuguaaugagugcugcuccuacagcuauucagaacauacaucccagcccaacgaauaggucuaagaggaaccuugagauggaaauaauuuuaacucugucucaaggucuaaagaaauacuaugguaagauacugaagcuucugcaccucaccuuggaagaggacacugaaggccuguuagaaugguguaagagaaaccuugggucaaacugugaugaugacuucuuucagaagagaauagaagaauucuucaugaccggugagggcuacuucaaugaagucuuacaauuuaaaacacuaagcacacuaagccccacggagccgucucaugccaggccaccaacaguggaacccuucaaaucuuacuucgcuaagggcuuccuuucaauagauucagguuacuucucugccaaauguuauccaagauuaucuacuucagggcuucagcugaucaaugucacccaacacccagcuagaauagcagaaacaccuggacccaagacaacaagucugaaaaccaucaacuguauaaaccuaagagcaucagucuucaaagaacacagagaaauugagaucaaugugcuccuuccucagauugcagucaaccucucaaauugccauguuguaaucaauucacaugucugugauuauucuuuagacacugaugggccaguaaggcuuccucacauuuaccaugaagggacuuucauaccaggaacuuauaaaauagugauagacaaaaaaaauaagcuaaaugaccgauguacacuggucaccaacugugugauaaaaggaagagagauucguaagggccaaucagugcugaggcaguacaaaacagaaaucaagauaggcaaggcaucaacaggcucuaggaaacuacuguccgaggagccaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauaccaucaacagggugaagucauucaagcuaugcgaaaacagcgccacagggaaaaccugugagauagacagcacuccgguuaagugcaggcaagguuuuuguuuaaaaaucacccaagagggaaggggccacguaaaauuaucuagaggcucagagguuguuuuggaugcuugcgacacaagcugcgaaguaaugauaccuaaaggcacuggagauauccugguggacuguucagguggacagcaacauuucuuaaaagacaauuuaauugaccuagggugcccccauaucccgcuauuggguaaaauggccauuuacaucugcagaaugucaaaucauccuagaacaacuauggcuuuucucuucugguucagcuuuggcuaugugaucaccuguauauuuugcaaggcucuuuuuuauucauugauaauuauugggacacuagggaaaaagaucaagcaauauagggaauugaaaccucaaacuuguaccauaugugagacagcuccugucaaugcaauagacgcugaaaugcaugaccuuaacugcaguuacaauauaugcccuuauugugcaucaagauugaccuccgaugggcuagcuaggcaugugccacaaugccccaagcggaaggaaaaaguugaggagacugagcuguacuugaaccuggaaagaauuccuuggauugucagaaagcuauugcaagugucagaguccacugguguggcauugaaacgaagcagcuggcugauuguacugcuuguguuacucacaguuucauugucaccgguucaaucagcaccuguuggucaugguaagacaaucgaaacauaucagaccagagaaggauucacaagugucugucucuuuauguuaggaagcauccuguuuuuagucucuugcuuggugaaggggcuaguugacagugucagugacagcuucuuccccggccugucugucuguaagacaugcucuauuggcaguauaaauggcuuugaaauugaaucgcauaaaugcuacuguagccuauuuugcugccccuacuguaggcacugcucugcugacagagaaauucaucaguuacacuugaguaucugcaaaaaaagaaaaauggguagcaaugucaugcuggcugucugcaaacgcaugugcuuuagggcaaccauagaagcaagcagaagagcccugcucauccgaagcauuauaaauaccacuuuuguaauaugcauuuuaacauugacaaucuguguuguuagcaccucugcaguagagauggaaaaccuuccaucaggcacuugggagagagaggaagaccugacaaauuucugucaucaggaaugccagguaaccgagacggagugccucuguccauacgaagcucuugugcucagaaaaccucuguucuuagacaguauaguuaaaggcaugaagaauuugcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguagaagaugccucugaauccaaauuacuuaccgucuccaucauggauuugucacaaauguauuccccuguuuuugaguacuugucaggagacagacagguugaagaauggcccaaagcaacuugcacaggugacugcccagaaaggugugguugcacaucaucaacuugcuugcauaaagaauggccucacucaagaaacuggagauguaaucccacuuggugcuggggaguaggaacuggcugcaccugcugcgggguggauguaaaagaccuuuuuacagaucacauguuugucaaauggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcaugugcaaaaaguguugucugcaaguacaguguguaaacugcagaguugcacacaugguauaccaggagaucuacaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaauaucgaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcauaccaagaaaguugagauaucaggcuuaaaauuugcaagucuggcuugcacggguugcuaugcuuguagcucuggcaucuccuguaaagucaggauucauguagaugagccagaugagcucacaguacauguaaagagcaaugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaaugauacuugcacagccaaggcaagcuguuggcuagagucagucaagaguuuuuuuuauggauugaaaaauaugcuugguaguguauuugguaacuuuuucauaggcauuuuguuauuccuugccccuuuuguccuguuggugcuuuucuuuauguucggauggaaaaucuuguuuugcuucaaauguugcaggaggaccagaggcuuacuuaaguauagacuccucaaagacgaugaggaaacaggcuacagaaggauuauugaaagacugaacaacaaaaaaggaaaaaacagacugcuugauggugaaagguuggcugauaggaaaauugcugagcuguucuccacaaaaacacacauugguuaa

SEQ ID NO: 3579 - RNA, 5067 nt, Artificial Sequence
  derived and/or modified CDS sequence (wt) from CCHFV(5170-R-2011)__KR814873.1__GP
augcccuucaacaucaugcauacacuauuagugugcuucauucuuuaccuacagcugucggguuuaggaggggcucauggacagucaaacgaaacugaacacaauggaacaaacaccaccacaguacccggcacaagucaaagccccaagccacccgcgagcaccacucuacaacacacaccagaauccuccaccgucaaacucaccacaccaacaagcgaaacagaaggcucaggggaaacgaccccacccccaaacaccacccagggccugcccccaccagggaccacaccagaacgcuccgcaacaaccgccacaagcacgucaagcacagacaacaugaauuccaccacacaggugaccgacaacacccccacaucaacagucagcauaaguccauccagcagccccagcaugccauccacaucacaaggcauacauuaucccauaaggagucuauugucagucucgagcccuaagacaguaacaacaccgacaccaauaagcccuggagagaugagcccggaaaccagcagucagcacucagccaugagcagaauaccaacccucuacacagcaacccaggucuccacugagaacaccaaccgcagcacaccuagacaaucugagucuucaguacagccggcaacccaaagcccaauaacuuccccagcgcaaacaauccuucugaugagugcugcuccuaaagcuauucaggacaugcaucccagcccaacaaacagguccaagaggaaccuugagguggaaauaauuuuaacucugucucaaggucuaaagaaauauuacgguaaaauacugaagcuucugcaccuuaccuuggaagaggauacugaaggccuguuagaaugguguaagagaaaccuugggucaaauugugaugaugacuucuuucaaaagagaauagaggaauucuucauaacuggugagggcuacuucaaugaaguccuacaauuuaaaacacuaagcacacuaagccccacggagcugucucaugucaggcuaccaacagcggagcccuucaaaucuuacuucgcuaagggcuuccuuucaauagauucggguuacuucucugccaaauguuauccaagaucauccacuucagggcuucagcugaucaaugucacccaacacccagcuaggauagcagaaacaccuggacccaaaacaacgagucugaaaaccaucaacuguaucaaccuaagagcaucagucuucaaagaacacagagaaguugagaucaaugugcuucuuccucagauugcagucaaccucucaaacugccauguugugaucaacucacaugucugugauuacucuuuagacacugacgggccagugaggcuuccucgcauucaccaugaagguacuuucauaccaggaacuuauaaaauagugauagacaaaaaaaauaagcuaaaugaccgaugcucgcuagucacuaacugugugauaaagggaagagagguucguaagggccaaucagugcugaggcaguacaaaacagaaauuaagauaggcaaggcaucaacaggcucuaggaaacuacuguccgaagagccaggugacgacugcauaucaagaacucagcuauugaagacagaaacagcagaaauccaugacgacaacuauggugguccaggugacaaaauaacuaucugcaaugguucaaccauuguagaucagagacugggcagugaacuaggguguuauaccaucaacagggugaagucauucaagcuaugcgaaaacagugccacagggaaaaccugugagauagacagcacuccggucaagugcaggcaagguuuuuguuugaaaaucacccaagagggaaggggccacguaaaauuauccaggggcucagagguuguuuuggauguuugcgacucgagcugugaaauaaugauaccuaaaggcacuggagauauccuaguagacuguucagguggacagcaacauuucuuaaaagacaacuugauugaccuagggugcccucauaucccgcuauuggguaaaauggccauuuacauuugcagaaugucaaaucaucccaggacaaccauggcuuuccucuucugguucaguuuuggcuauguaaucaccuguauauuuugcaaggcucuuuuuuauucauugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaagggcuagcuaggcaugugacacaaugcccuaagcgaaaggagaaaguugaggagacugaacuguauuugaaccuggaaagaauuccuuggauagucagaaagcuauugcaagugucagaguccacugguguggcauugaaacgaagcaguuggcugauugugcugcuuguguuacucacagucucauugucaccgguccaaucagcaccuguuggucaugguaagacaaucgaaacauaucagaccagagaaggauucacaaguaucugucucuuuauguuaggaagcauccuauucauaguuucuugccugguaaaggggcugguugacagugucagugacagcuucuuccccggccugucugucuguaagacaugcucuauuggcaguauaaauggcuuugaaauugaaucgcauaaaugcuacuguaguuuauuuugcugccccuacuguaggcacugcucugcugacagagaaauucaccaguugcacuugaguaucugcaaaaaaagaaaaacagggagcaaugucaugcuggcugucugcaagcgcaugugcuuuaaggcaaccauagaagcaagcagaagagcccugcucauccgaagcauuaucaauaccacuuuuguaauaugcauucuaacauuagcaaucuguguuguuagcaccucugcaguagagauggaagaccuuccagcaggcacuugggagagagaggaagaccuaacaaauuucugccaucaggaaugccaggugaccgagacggaaugccucuguccauacgaagcucuugugcucaggaaaccucuuuucuuagacaguauaguuaaagguaugaaaaauuugcuaaacucaacaagcuuagaaacaagcuuaucaauugaggcaccauggggagcaauaaauguccagucaaccuuuaaaccaacaguaucuacugcaaacauagcacucaguuggagcucaguagagcacagaggcaacaagaucuuggucacaggcaggucugaaucaauuaugaaacuagaggaaaggacaggagucagcugggaucuaggcguggaagaugccucugaauccaaauuacuuaccgucucuaucauggacuugucacaaauguauuccccuguuuuugaguacuuaucaggagauagacagguugaagaauggcccaaggcaaccugcacaggugauugcccagaaagguguggcugcacaucaucaaccugcuugcauaaagaauggccucauucaagaaacuggagauguaaucccacuuggugcuggggaguaggaaccggcugcacaugcugcggaguggauguaaaagaccuuuuuacagaccacauguuuaucaaauggaagguugaauauauaaaaaccgaagccauaguauguguugagcucaccagccaagaaagacagugcagucugauugaggcagguacuagauucaacuuggguccugugacuaucacccugucugagccaagaaacauucagcagaagcuucccccugagaucauuacgcugcaucccaaaauugaagaaggcuucuuugacuugaugcaugugcaaaaaguguuaucugcaaguacaguguguaaacugcagaguugcacacaugguauaccaggagaucuacaaauuuaccacaucgguaacuuguugaaaggggauagaguaaacgggcaucugauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaagaaaguugagauaucaggcuugaaauuugcaagucugacuuguacggguugcuaugccuguagcucuggcaucucuuguaaagucagaauucauguagaugaaccagaugagcucacagugcauguaaagagcagugauccagaugugguugcagcuagcacaagccuuauggcaaggaagcuugaauuugggacagauagcacauucaaggcauuuucagccaugcccaaaaccucuuuaugcuuuuacauuguagagagggaauacugcaagagcugcagugaagaugauacaaaaaaauguguugacacaaaacuugagcagccacagagcauacuaauugagcacaaggggacgauaauuggaaagcagaaugauacuugcacagccaaggcaaguuguuggcuagagucagucaagaguuuuuuuuauggacugaagaauaugcuuggcaguguuuuugguaguuuuuucguaggcauuuuguuauuccuugccccuuuugucuuguuggugcuuuucuuuauguuuggauggaaaaucuuguuuugcuuuaaguguugcaggaggaccagaggcuuguuuaaguauagacaccucaaagaugacgaggaaacaggcuacagaaggauuauugaaagacugaacagcaaaaaagggaaaaacagacugcuugauggugagagguuggcugauaggaaaauugcugagcuguucucuacaaaaacacacauuggcuaa

SEQ ID NO: 3580 - RNA, 5067 nt, Artificial Sequence
  derived and/or modified CDS sequence (wt) from CCHFV(4701-ST-2009)__KR814872.1__GP
augcccaucaacauuaugcauacacuauuagugugcuucauucuuuaccuacagcuaucggguuuaggaggagcucauggacagucaaacgcaacugaacacaauggaacaaacaccaccacagcacccggcacaagucaaagucccaagccacccgcgagcaccacucuaccacacacaccagaauccuccaccgucaaacucaccacaccaacaagcgaaacagaaggcucaggggaaacgaccccacccccaaacaccacccagggccugccccuaacagggaccacaccagaacgcuccgcaacaaccgccacaagcacgucaagcacagacaacaugaauuccaccacacaggugaccgacaacacccccacaucaacagucagcauaaguccauccagcagcuccagcaugccauccacaccacaaggcacacaucaucccguaaggagucuauugucagucucgagcccuaagacaguaacaacaccgacaccaaugagcccuggagagaugagcccggaaaccagcagucagcacucagccaugagcagaguaccaacccucuacacagcaacccaggucuccacugagaacaccgaucgcagcacaccuagacaaucugaguccucaguacagccggcaacccaaagcccaauaacuuccccagcgcaaacaauccuucugaugagugcugcuccuaaagcuauucaggacaugcaucccagcccaacaaacagguccaagaggaaccuugagguggaaauaauuuuaacucugucucaaggucuaaagaaauauuacgguaaaauacugaagcuucugcaccuuaccuuggaagaggauacugaaggccuguuagaaugguguaagagaaaccuugggucaaauugugaugaugacuucuuucaaaagagaauagaagaauucuucauaacuggugagggcuacuucaaugaaguccuacaauuuaaaacacuaagcacacuaagccccacggagccgucucaugucaggcuaccaacagcggagcccuucaaaucuuacuucgcuaagggcuuccuuucaauagauucggguuacuucucugccaaauguuauccaagaucauccacuucagggcuucagcugaucaaugucacccaacacccagcuaggauagcagaaacaccuggacccaaaacaacgagucugaaaaccaucaacuguaucaaccuaagagcaucagucuucaaagaacacagagaaguugagaucaaugugcuucuuccucagauugcagucaaccucucaaacugccauguugugaucaacucacaugucugugauuacucuuuagacacugacgggccagugaggcuuccucgcauucaccaugaagguacuuucauaccaggaacuuauaaaauagugauagacaggaaaaauaagcuaaaugaccgaugcucgcuagucacuaacugugugauaaaaggaagagagguucguaagggccaaucagugcugaggcaguacaaaacagaaauuaagauaggcaaggcaucaacaggcucuaggaaacuacuguccgaagagccaggugacgacugcauaucaagaacucagcuauugaagacagaaacagcagagauccaugacgacaacuauggugguccaggugacaaaauaacuaucugcaaugguucaaccguuguagaucagagacugggcagugaacuaggguguuauaccaucaacagggugaagucauucaagcuaugcgaaaacagugccacagggaaaaccugugagauagacagcacuccgguuaagugcaggcaaggguuuuguuugaaaaucacccaagagggaaggggccacguaaaauuauccaggggcucagagguuguuuuggaugcuugcgacucaagcugugaaauaaugauaccuaaaggcacuggagauauccuaguagacuguucagguggacagcaacauuucuuaaaagacaacuugauugaccuagggugcccucauaucccgcuauuggguaaaauggccauuuacauuugcagaaugucaaaucaucccaggacaaccauggcuuuccucuucugguucaguuuuggcuauguaaucaccuguauauuuugcaaggcucuuuuuuauucauugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuggcuaggcaugugacacaaugcccuaagcgaaaagagaaaguugaggagacugaacuguauuugaaccuggaaagaauuccuuggauagucagaaagcuauugcaagugucagaguccacugguguggcauugaaacgaagcaguuggcugauugugcugcuuguguuacucacagucucauugucaccgguccaaucagcaccuguuggucaugguaagacaaucgaaacauaucagaccagagagggauucacaaguaucugucucuuuauguuaggaagcauccuauucauaguuucuugccugguaaaggggcugguugacagugucagugacagcuucuuccccggccugucugucuguaagacaugcucuauuggcaguauaaauggcuuugaaauugaaucgcauaaaugcuacuguaguuuauuuugcugccccuacuguaggcacugcucugcugacagagaaauucaccaguugcacuugaguaucugcaaaaaaagaaaaacggggagcaaugucaugcuggcugucugcaagcgcaugugcuuuaaggcaaccauagaagcaagcagaagagcccugcucauccgaagcauuaucaauaccacuuuuguaaugugcauucuaacauuagcaaucuguguuguuagcaccucugcaguagagauggaagaccuuccggcaggcacuugggagagagaggaagaccuaacaaauuucugccaucaggaaugccaggugaccgagacggaaugccucuguccauacgaagcucuugugcucaggaaaccccuuuucuuagacaguauaguuaaagguaugaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggauuugucacaaauguauuccccuguuuuugaguacuuaucaggagauagacagguugaagaauggcccaaggcaaccuguacaggugauugcccagaaagguguggcugcacaucaucaaccugcuugcauaaagaauggccucauucaagaaacuggagauguaaucccacuuggugcuggggaguaggaaccggcugcacaugcugcggaguggauguaaaagaccuuuuuacagaccacauguuuaucaaauggaagguugaauauauaaaaaccgaagccauaguauguguugagcucaccagccaagaaagacagugcagucugauugaggcagguacuagauucaacuuggguccugugacuaucacccugucugagccaagaaacauucagcagaagcuucccccugagaucauuacgcugcauccuaaaauugaagaaggcuucuuugacuugaugcaugugcaaaaaguguuaucugcaaguacaguguguaaacugcagaguugcacacaugguauaccaggagaucuacaaauuuaccacauuggcaacuuguugaaaggggauagaguaaacggccaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaauauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaaaaaaguugagauaucaggcuugaaauuugcaagucugacuuguacggguugcuaugcuuguagcucuggcaucuccuguaaagucagaauucauguagaugaaccagaugagcucacagugcauguaaagagcagugauccagaugugguugcagcuagcacaagccuuauggcaaggaagcuugaauuugggacagauagcacauucaaggcauuuucagcuaugcccaaaaccucuuuaugcuuuuacauuguggagagggaauacugcaagagcugcagugaagaugauacaaaaaaauguguugacacaaaacuugagcagccacagagcauacuaauugagcacaaagggacgauaauuggaaagcagaaugauacuugcacagccaaggcaaguuguuggcuagagucagucaagaguuuuuuuuauggauugaagaauaugcuuggcaguguuuuuggugguuuuuucguaggcauuuuguuauuccuugccccuuucgucuuguugguacuuuucuuuauguuuggauggaaaaucuuguuuugcuuuaaguguugcaggaggaccagaggcuuguuuaaguauagacaccucaaagaugacgaggaaacaggcuacagaaggauuauugaaagacugaacagcaaaaaaggaaaaaacagacugcuugauggugagagguuggcugauaggaaaauugcugagcuguucucuacaaaaacacacauuggcuaa

SEQ ID NO: 3581 - RNA, 5067 nt, Artificial Sequence
  derived and/or modified CDS sequence (wt) from CCHFV(4574-ST-2008)__KR814870.1__GP
augccuaccaacauuaugcauacacuauuagugugcuucauucuuuaccuacagcuguuggguccaggaggagcccauggacagccaaacgcaacugaacacaacagaacaaacaccaccacagcacccagcacaagccaaagccccaagccacccgugagcacagccccaccacacgcacuggaaucacccaccaucaaauccaccacaccaacaagcgaaacagaaggcucaggggaaacgaccucacccccaaacaccacccagggcccgucucuaccagagaccacaccaaaacgccccgcaacaacugccacaaguacgccaagcacagacaacacaaauuccaccacacaugugaccgacaacaacccuacaucaacaaucagcacaaguccauccagcagccccagcacgccauccacaccacgaggcauacaucauccugcaaggaaucuauugucagucucgagcccuaagacagcaacaacaccaacaccaacgagcccuggggagauaagcucagaaaccagcagucugcacucagccaugagcagaacaucaacccucuacacagcaacccaggccuccacugaaaaugccaaccacagcgcaccuagacagucugaguccccagcacagccgacaaccacaagccuaaugaccuccccagcacaaucaauccuuguaaugagugcugcuccuacagcuauucagaacauacaucccagcccaacgaauaggucuaagaggaaccuugagauggaaauaauuuuaacucugucucaaggucuaaagaaauacuacgguaagauacugaagcuucugcaccucaccuuggaagaggacacugaaggccuguuagaaugguguaagagaaaccuugggucaaacugugaggaugacuucuuucagaagagaauagaagaauucuucaugaccggugagggcuacuucaaugaagucuuacaauuuaaaacacuaagcacacuaagccccacggagccgucucaugccaggccaccaacaguggaacccuucaaaucuuacuucgcuaagggcuuccuuucaauagauucagguuacuucucugccaaauguuauccaagaucaucuacuucagggcuucagcugaucaauguuacccaacacccagcuagaauagcagaaacaccuggacccaagacaacgagucugaaaaccaucaacuguauaaaccuaagagcaucagucuucaaagaacacagagaaauugagaucaaugugcuucuuccucagauugcagucaaccucucaaauugccauguuguaaucaauucacaugucugugauuauucuuuagacacugaugggccagugaggcuuccucacauuuaccaugaaggaacuuucauaccaggaacuuacaaaauagugauagacaaaaaaaauaagcuaaaugaccgauguacacuggucaccaacugugugauaaaaggaagagagguucguaagggccaaucagugcugaggcaguacaaaacagaaaucaagauaggcaagguaucaacaggcucuaggaaacuacuguccgaagagucaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauaccaucaacagggugaagucauucaagcuaugcgaaaacagcgccacagggaaaaccugugagauagacagcacuccgguuaagugcaggcaagguuuuuguuuaaaaaucacccaagaaggaaggggccacguaaaauuaucuagaggcucagagguuguuuuggaugcuugcgacucaagcugcgaaguaaugauaccuaaaggcacuggagauaucuugguggacuguucagguggacagcaacauuucuuaaaagacaacuuaauugaccuagggugcccccauaucccgcuauuggguaaaauggccauuuacaucugcagaaugucaaaucauccuagaacaacuauggcuuuucucuucugguucagcuuuggcuaugugaucaccuguuuauuuugcaaggcucuuuuuuauucauugauaaucauugggacacuagggaaaaagaucaagcaauauagggaauugagaccucaaaccuguaccauaugugagacagcuccugucaaugcaauagaugcugaaaugcaugaccuuaacugcaguuacaauauauguccuuauugugcaucaagauugaccuccgaugggcuagcuaggcaugugccacaaugccccaagcggaaggaaaaaguugaggagacugagcuguacuugaaccuggaaagaauaccuuggauugucagaaagcuauugcaagugucagaguccacugguguggcauugaagcgaagcagcuggcugauuguacugcuuguguuacucacaguuucauugucaccgguucaaucagcaccuguuggucaugguaagacaaucgaaacauaucagaccagagaaggauucacaaguaucugucucuuuauguuaggaagcauccuguuuuuagucucuugcuuggugaaggggcugguugacagugucagugacagcuucuuccccggccugucugucuguaagacaugcuccauuggcaguauaaauggcuuugaaauugaaucgcauaaaugcuacuguagccuacuuugcugccccuacuguaggcacugcucugcugacagagaaauccaccaguuacacuugaguaucugcaaaaaaagaaaaacggguagcaaugucaugcuggcugucugcaaacgcaugugcuuuagggcaaccauagaagcaagcagaagagcccugcucauccgaagcauuauaaauaccacuuuuguaauaugcauuuuaacauuaacaaucuguguuguuagcaccucugcaguagagauggaaaaccuuccaucaggcacuugggagaaagaggaagaccugacaaauuucugucaucaggaaugccaggugaccgagacggagugccucuguccauacgaagcucuugugcucagaaaaccucuguucuuagacaguauaguuaaaggcaugaagaauuugcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguagaagaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcuggggaguaggaacuggcugcaccugcugcgggguggauguaaaagaccuuuuuacagaucacauguuugucaaguggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcauguacaaaaaguguugucugcaaguacaguguguaaacugcagaguugcacacaugguauaccaggagaucuacaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacauugaaacugauuacacgaaaaccuuccacuuccacucuaaaagaguuacagcacauggugacacaccacaauuagacuuaaaagcaaggccaaccuacggugcaggugagaucacugugcugguugagguugcugacauggaguugcauaccaagaaaguugagauaucaggccugaaauuugcaagucuggcuugcacggguugcuaugcuuguagcucuggcaucuccuguaaagucaggauucauguagaugagccagaugagcucacaguacauguaaagagcagugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaaugauacuugcacagccaaggcaagcuguuggcuagagucagucaagaguuuuuuuuauggauugaaaaauaugcuugguaguguauuuggcaacuuuuucauaggcauuuuguuauuccuugccccuuuuguccuguuggugcuuuucuuuauguuuggauggaaaaucuuguuuugcuucaaauguugcaggagggccagaggcuugcuuaaguauagacaccuaaaagacgaugaggaaacaggcuacagaaagauuauugaaaggcugaacaacaaaaaaggaaaaaacagacugcuugauggugaaagguuggcugauaggaaaauugcugagcuguucuccacaaaaacacacauugguuaa

SEQ ID NO: 3582 - RNA, 5067 nt, Artificial Sequence
  derived and/or modified CDS sequence (wt) from CCHFV(4495-ST-2008)__KR814869.1__GP
augccuaccaacauuaugcauacacuauuagugugcuucauucuuuaccuacagcugcuggguccaggaggagcccauggacagccaaacgcaacugaacacaacagaacaaacaccaccacagcacccagcacaagccaaagccccaagccacccgugagcacagccccaccacacgcacuggaaucacccaccaucaaauccaccacaccaacaagcgaaacagaaggcucaggggaaacgaccccacccccaaacaccacccagggcccgucuccaccagagaccacaccagaacgccccgcaacaacugccacaaguacgccaagcacagacaacacgaauuccaccacacaugugaccgacaacaacccuacaucaacaaucagcacaaguccauccagcagccccagcacgccauccacaccacgaggcauacaucauccugcaaggaaucuauugucagucucgagcccuaagacagcaacaacaccaacaccaacgagcccuggggagauaagcucagaaaccagcagucugcacucagccaugagcagaacaucaacccucuacacagcaacccaggccuccacugaaaaugccaaccacagcacaccuagacagucugaguccccagcacagccgacaaccacaagccuaaugaccuccccagcacaaucaauccuuguaaugagugcugcuccuacagcuauucagaacauacaucccagcccaacgaauaggucuaagaggaaccuugagauggaaauaauuuuaacucugucucaaggucuaaagaaauacuacgguaagauacugaagcuucugcaccucaccuuggaagaggacacugaaggccuguuagaaugguguaagagaaaccuugggucaaacugugaugaugacuucuuucagaagagaauagaagaauucuucaugaccggugagggcuacuucaaugaagucuuacaauuuaaaacacuaagcacacuaagccccacggagccgucucaugccaggccaccaacaguggaacccuucaaaucuuacuucgcuaagggcuuccuuucaauagauucagguuacuucucugccaaauguuauccaagaucaucuacuucagggcuucagcugaucaauguuacccaacacccagcuagaauagcagaaacaccuggacccaagacaacgagucugaaaaccaucaacuguauaaaccuaagagcaucagucuucaaagaacacagagaaauugagaucaaugugcuucuuccucagauugcagucaaccucucaaauugccauguuguaaucaauucacaugucugugauuauucuuuagacacugaugggccagugaggcuuccucacauuuaccaugaaggaacuuucauaccaggaacuuacaaaauagugauagacaaaaaaaauaagcuaaaugaccgauguacacuggucaccaacugugugauaaaaggaagagagguucguaagggccaaucagugcugaggcaguacaaaacagaaaucaagauaggcaagguaucaacaggcucuaggaaacuacuguccgaagagucaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauaccaucaacagggugaagucauucaagcuaugcgaaaacagcgccacagggaaaaccugugagauagacagcacuccgguuaagugcaggcaagguuuuuguuuaaaaaucacccaagaaggaaggggccacguaaaauuaucuagaggcucagagguuguuuuggaugcuugcgacucaagcugcgaaguaaugauaccuaaaggcacuggagauaucuugguggacuguucagguggacagcaacauuucuuaaaagacaacuuaauugaccuagggugcccccauaucccgcuauuggguaaaauggccauuuacaucugcagaaugucaaaucauccuagaacaacuauggcuuuucucuucugguucagcuuuggcuauguaaucaccuguuuauuuugcaaggcucuuuuuuauucauugauaaucauugggacacuagggaaaaagaucaagcaauauagggaauugagaccucaaacuuguaccauaugugagacagcuccugucaaugcaauagaugcugaaaugcaugaccuuaacugcaguuacaauauaugcccuuauugugcaucaagauugaccuccgaugggcuagcuaggcaugugccacaaugccccaagcggaaggaaaaaguugaggagacugagcuguacuugaaccuggaaagaauuccuuggauugucagaaagcuauugcaagugucagaguccacugguguggcauugaaacgaagcagcuggcugauuguacugcuuguguuacucacaguuucauugucaccgguucaaucagcaccuguuggucaugguaagacaaucgaaacauaucagaccagagaaggauucacaaguaucugucucuuuauguuaggaagcauccuguuuuuagucucuugcuuggugaaggggcugguugacagugucagugacagcuucuuccccggccugucugucuguaagacaugcucuauuggcaguauaaauggcuuugaaauugaaucgcauaaaugcuacuguagccuacuuugcugccccuacuguaggcacugcucugcugacagagaaauccaccaguuacacuugaguaucugcaaaaaaagaaaaacggguagcaaugucaugcuggcugucugcaaacgcaugugcuuuagggcaaccauagaagcaagcagaagagcccugcucauccgaagcauuauaaauaccacuuuuguaauaugcauuuuaacauuaacaaucuguguuguuagcaccucugcaguagagauggaaaaccuuccaucaggcacuugggagaaagaggaagaccugacaaauuucugucaucaggaaugccaggugaccgagacggagugccucuguccauacgaagcucuugugcucagaaaaccucuguucuuagacaguauaguuaaaggcaugaagaauuugcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggaaucagcugggaucuaggcguagaagaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcuggggaguaggaacuggcugcaccugcugcgggguggauguaaaagaccuuuuuacagaucacauguuugucaaguggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcauguacaaaaaguguugucugcaaguacaguguguaaacugcagaguugcacacaugguauaccaggagaucuacaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacauugaaacugauuacacgaaaaccuuccacuuccacucuaaaagaguuacagcacauggugacacaccacaauuagacuuaaaagcaaggccaaccuacggugcaggugagaucacugugcugguugagguugcugacauggaguugcauaccaagaaaguugagauaucaggccugaaauuugcaagucuggcuugcacggguugcuaugcuuguagcucuggcaucuccuguaaagucaggauucauguagaugagccagaugagcucacaguacauguaaagagcagugauccagaugugguugcagcuagcacaagucucauggcgaggaagcuugaauuugggacagacaguacauucaaggccuuuucagcuaugcccaaaaccucuuuauguuuuuacauuguggagagggaauacugcaagagcugcagugaagaggacacacaaagauguguugacacaaaacuugagcagccacagagcauacuaauugagcacaaaggaacgauaauuggaaagcagaaugauacuugcacagccaaggcaagcuguuggcuagagucagucaagaguuuuuuuuauggauugaaaaauaugcuugguaguguauuuggcaacuuuuucauaggcauuuuguuauuccuugccccuuuuguccuguuggugcuuuucuuuauguuuggauggaaaaucuuguuuugcuucaaauguugcaggagggccagaggcuugcuuaaguauagacaccuaaaagacgaugaggaaacaggcuacagaaagauuauugaaaggcugaacaacaaaaaaggaaaaaacagacugcuugauggugaaagguuggcugauaggaaaauugcugagcuguucuccacaaaaacacacauugguuaa

SEQ ID NO: 3583 - RNA, 5067 nt, Artificial Sequence
  derived and/or modified CDS sequence (wt) from CCHFV(3809-ST-2007)__KR814867.1__GP
augccuaccaacauuaugcauacacuauuagugugcuucauucuuuaccuacagcuguugggucuaggaggagcucaaggacagucaaacgcaacagaacacaacgaaacaaacaccaccacagcacccagcacaagucaaagucccaagccaccugugagcacaaccccacuacaugcacuggaaucauccaccaucaaacccaccacaccagcaagagaaacagaaggcucaggggaaacgaccccacccccaaacaccacccagggcccgucuccaccagaggccacaccagaacgccccgcaacaacugccacaagugcgccaagcacagacaacacgaauuccaccacacaugugaccgacaacaacccuacaucaacaaucagcacaaguccauccagcagccccagcacgccauucacaccacaaggcauacaucauccugcaaggaaucuauugucagucucgagcccuaagacagcaacaacaccaacaccaacgaguccuggggaguuaagcucagaaaccagcagucugcacucagccauaagcagaacaucaacccucuacacagcaacccaggucucuaccgaaaaugccaaccacagcgcaccuagacagucugaguccucagcacagccgacaaccacaagcccaaugacuuccccagcacaaucaauccuuguaaugagugcugcuccuacagcuauucagaacauacaucccagcccgacgaauaggucuaagaggaaccuugagauggaaauaauuuuaacucugucucaaggucuaaagaaauacuacgguaagauacugaagcuucuacaccucaccuuggaagaggacacugaaggccuguuagaaugguguaagagaaaccuugggucaaacugugaugaugacuucuuucagaagagaauagaagaauucuucaugacuggugagggcuacuucaaugaagucuuacaauuuaaaacacuaagcacacuaagccccacggagccgucucaugccaggccaccagcaguggaacccuucaaaucuuacuucgcuaagggcuuccuuucaauagauucagguuacuucucugccaaauguuauccaagaucaucuacuucagggcuucagcugaucaauguuacccaacacccagcuaggauagcagaaacaccuggacccaagacaacgagucugaaaaccaucaacuguauaaaccuaagagcaucagucuucaaagaacacagagaaauugagaucaaugugcuucuuccucagauugcagucaaccucucaaauugccauguuguaaucaauucacaugucugugauuacucuuuagacacugaugggccagugaggcuuccucacauuuaccaugaagggacuuucauaccaggaacuuauaaaauagugauagacaaaaaaaauaagcuaaaugaccgauguacacuggucaccaacugugugauaaaaggaagagagguucguaagggccaaucagugcugaggcaguacaaaacagaaaucaagauaggcaaggcaucaacaggcucuaggaaacuacuguccgaagagccaggugaugacugcauaucaagaacucaguuauugaggacagaaacagcagagauccaugaugacaacuauggugguccaggugauaaaauaacuaucugcaacgguucaaccauuguagaucagagacugggcagugaacuaggguguuauaccaucaacagggugaagucauucaagcuaugcgaaaacagcgccacagggaaaaccugugagauagacagcacuccgguuaagugcaggcaagguuuuuguuuaaaaaucacccaagagggaaggggccacguaaaauuaucuagaggcucagagguugucuuggaugccugcgacucaagcugcgaaguaaugauaccuaaaggcacuggagauauccugguggacuguucagguggacagcaacauuucuuaaaagacaacuuaauugaccuagggugcccccauaucccgcuauuggguaaaauggccauuuacaucugcagaaugucaaaucauccuagaacaacuauggcuuuucucuucugguucagcuuuggcuaugugaucaccuguauauuuuguaaggcucuuuuuuauucauugauaauuauugggacacuagggaaaaagaucaagcaauauagggaauugaaaccucaaacuuguaccauaugugagacagcuccugucaaugcaauagaugcugaaaugcaugaccuuaacugcaguuacaauauaugcccuuauugugcaucaagauugaccuccgaugggcuggcuaggcaugugccacaaugccccaagcggaaggaaaaaguugaggagacugagcuguacuugaaccuggaaagaaucccuuggauugucagaaagcuauugcaagugucagaguccacugguguggcauugaaacgaagcagcuggcugauuguacugcuuguguuacucacaguuucauugucaccgguucaaucagcaccuguuggucaugguaaaacaaucgaaacauaucagaccagagaaggauucacaaguaucugccucuuuauguuaggaagcauccuguuuuuagucucuugcuuggugaaggggcugguugacagugucagugacagcuucuuccccggccugucugucuguaagacaugcucuauuggcaguguaaauggcuuugagauugaaucgcauaaaugcuacuguagccuauuuugcugccccuacuguaggcacugcucugcugacagagaaauucaccaguuacacuugagugucugcaaaaaaagaaaaacggguagcaaugucaugcuggcugucugcaaacgcaugugcuuuagggcaaccauagaagcaagcagaagagcccugcucauccgaagcauuaucaauaccacuuuuguaauaugcauuuuaacauugacaaucuguguuguuagcaccucugcaguagagauggaaaaccuuccagcaggcacuugggagagagaggaagaccugacaaauuucugucaucaggaaugccagguaaccgagacggagugccucuguccauacgaagcucuugugcucagaaaaccucuguucuuagacaguauagucaaaggcaugaagaauuugcuaaacucaacaagcuuagaaacaagcuuaucaauugaagcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguggaagaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcuggggaguaggaacuggcuguaccugcugcgggguggauguaaaagaccuuuuuacagaucacauguuugucaaauggaagguugaauauauaaaaacugaagccauaguauguguugagcucaccagccaggaaagacagugcagucugauugaggcagguacuagauucaacuugggcccugugacuaucacccugucugagccaagaaacauucagcagaagcuucccccugagauuaucacguugcaucccaaaguugaagagggcuucuuugacuugaugcaugugcaaaaaguguugucugcaaguacaguguguaaacugcagaguugcacacaugguauaccaggagaucuucaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacauugaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcauaccaagaaaguugagauaucaggcuugaaauuugcaagucuggcuugcacggguugcuaugcuuguagcucuggcaucuccuguaaagucaggauucauguagaugagccagaugagcucacaguacauguaaagagcagugauccagaugugguugcagcuagcacaagucucauggcgaggaagcuugaauuugggacagacaguacauucaaggccuuuucagcuaugcccaaaaccucuuuauguuuuuacauuguggagaaagaauacugcaggagcugcagugaagaggacacacaaaaauguguugacacaaaacuugagcagccacagagcauacuaauugagcacaaaggaacgauaauuggaaagcagaaugauacuugcacagccaaagcaagcuguuggcuagagucagucaagaguuuuuuuuauggauugaagaauaugcuugguagugucuuugguaacuuuuucauaggcauuuuguuauuccuuaccccuuuuguccuguuggugcuuuucuuuauguuuggauggaaaaucuuguuuugcuucaaauguugcaggaggaccagaggcuuacuuaaguauagacaccucaaagacgaugaggaaacaggcuacagaaggauuauugaaagacugaacaacaaaaaagggaaaaacagacugcuugauggugaaagguuggcugauaggaaaauugcugagcuguuuuccacaaaaacacacauugguuaa

SEQ ID NO: 3584 - RNA, 5067 nt, Artificial Sequence
  derived and/or modified CDS sequence (wt) from CCHFV(3756-ST-2007)__KR814866.1__GP
augcccaucaacauuaugcauacacuauuagugugcuucauucuuuaccuacagcugucggguuuaggaggagcucauggacagucaaacgcaacugaacacaauagaacaaacaccaccacaguacccggcacaagucaaagccccaagccacccgcgagcaccacucuaccacacacaccagaauccuccaccgucaaacucaccacaccaacaagcgaaacagaaggcucaggggaaacgaccccacccccaaacaccacccagggccugccccuaccagggaccacaccagaacgcuccgcaacaaccgccacaagcacgucaagcacagacaacaugaauaccaccacacaggugaccgacaacacccccacaucaacagucagcauaaguccauccagcagccccagcaugccauccacaucacaaggcauacauuaucccguaaggagucuauugucagucucgagcccuaagacaguaacaacaccgacaccaaugagcccuggagagaugagcccggaaaccagcagucagcacucagccaugagcagaauaccaacccucuacacagcaacccaggucuccacugagaacaucaaccgcagcacaccuagacaaucugaguccucaguacagccggcaacccaaagcccaauaacuuccccagcgcaaacaauccuucugaugagugcugcuccuaaagcuauucaggacaugcaucccagcccaacaaacagguccaagaggaaccuugagguggaaauaauuuuaacucugucucaaggucuaaagaaauauuacgguaaaauacugaagcuucugcaccuuaccuuggaagaggauacugaaggccuguuagaaugguguaagagaaaccuugggucaaauugugaugaugacuucuuucaaaagagaauugaagaauucuucauaacuggugagggcuacuucaaugaaguccuacaauuuaaaacacuaagcacacuaagccccacggagccgucucaugucaggcuaccaacagcggagcccuucaaaucuuacuuugcuaagggcuuccuuucaauagauucggguuacuucucugccaaauguuauccaagaucauccacuucagggcuucagcugaucaaugucacccaacacccagcuaggauagcagaaacaccuggacccaaaacaacgagucugaaaaccaucaacuguaucaaccuaagagcaucagucuucaaagaacacagagaaguugagaucaaugugcuucuuccucagauugcagucaaccucucaaacugccauguugugaucaacucacaugucugugauuacucuuuagacacugacgggccagugaggcuuccucgcauucaccaugaagguacuuucauaccaggaacuuauaaaauagugauagacagaaaaaauaagcuaaaugaccgaugcucgcuagucacuaacugugugauaaagggaagagagguucguaagggccaaucagugcugaggcaguacaaaacagaaauuaagauaggcaaggcaucaacaggcucuaggaaacuacuguccgaagagccaggugacgacugcauaucaagaacucagcuauugaagacagaaacagcagagauccaugacgacaacuauggugguccaggugacaaaauaacuaucugcaaugguucaaccauuguagaucagagacugggcagugaacuaggguguuauaccauuaacagggugaagucauucaagcuaugcgaaaacagugccacagggaaaaccugugagauagacagcacuccggucaagugcaggcaagguuuuuguuugaaaaucacccaagagggaaggggccacguaaaauuauccaggggcucagagguuguuuuggaugcuugcgacucgagcugugaaauaaugauaccuaaaggcacuggagauauccuaguagacuguucagguggacagcaacauuucuuaaaagacaacuugauugaccuagggugcccucauaucccgcuauuggguaaaauggccauuuacauuugcagaaugucaaaucaucccaggacaaccauggcuuuccucuucugguucaguuuuggcuauguaaucaccuguauauuuugcaaggcucuuuuuuauucauugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuagcuaggcaugugacacaaugcccuaagcgaaaggagaaaguugaggagacugaacuguauuugaaccuggaaagaauucccuggauagucagaaagcuauugcaagugucagaguccacugguguggcauugaaacgaagcaguuggcugauugugcugcuuguguuacucacagucucauugucaccgguccaaucagcaccuguuggucaugguaagacaaucgaaacauaucagaccagagaaggauucacaaguaucugucucuuuauguuaggaagcauccuauucauaguuucuugccugguaaaggggcugguugacagugucagugacagcuucuuccccggccugucugucuguaagacaugcucuauuggcagcauaaauggcuuugaaauugaaucgcauaaaugcuacuguaguuuauuuugcugccccuacuguaggcacugcucugcugacagagaaauucaccaguugcacuugaguaucugcaaaaaaagaaaaacggggagcaaugucaugcuggcugucugcaagcgcaugugcuuuaaggcaaccauagaagcaagcagaagagcccugcucauccgaagcauuaucaauaccacuuuuguaauaugcauucuaacauuagcaaucuguguuguuagcaccucugcaguagagauggaagaccuuccagcaggcacuugggagagagaggaagaccuaacaaauuucugccaucaggaaugccagguaaccgagacggaaugccucuguccauacgaagcucuugugcucaggaaaccucuuuucuuagacaguauaguuaaagguaugaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggauuugucacaaauguauuccccuguuuucgaguacuuaucaggagauagacagguugaagaauggcccaaggcaaccugcacaggugauugcccagaaagguguggcugcacaucaucaaccugcuugcauaaagaauggccucauucaagaaacuggagauguaaucccacuuggugcuggggaguaggaaccggcugcacaugcugcggaguggauguaaaagaccuuuuuacagaccacauguuuaucaaauggaagguugaauauauaaaaaccgaagccauaguauguguugagcucaccagccaagaaagacaaugcagucugauugaggcagguacuagauucaacuuggguccugugacuaucacccugucugagccaagaaacauucagcagaagcuucccccugagaucauuacgcugcaucccaaaauugaagaaggcuucuuugacuugaugcaugugcaaaaaguguuaucugcaaguacaguguguaaacugcagaguugcacacauggcauaccaggagaucuacaaauuuaccacauuggcaacuuguugaaaggggauagaguaaacgggcaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaagaaaguugagauaucaggcuugaaauuugcaagucugacuuguacggguugcuaugcuuguagcucuggcaucuccuguaaagucagaauucauguagaugaaccagaugagcucacagugcauguaaagagcagugauccagaugugguugcagcuagcacaagccuuauggcaaggaagcuugaauuugggacagauagcacauucaaggcauuuucagcuaugcccaaaaccucuuuaugcuuuuacauuguggagagggaauacugcaagagcugcagugaagaugauacaaaaaaauguguugacacaaaacuugagcagccacagagcauacuaauugagcacaaagggacgauaauuggaaagcagaaugauacuugcacagccaaggcaaguuguuggcuagagucggucaagaguuuuuuuuauggauugaagaauaugcuuggcaguguuuuugguaguuuuuucguaggcauuuuguuauuccuuaccccuuuugucuuguuggugcuuuucuuuauguuuggauggaaaaucuuguuuugcuuuaaguguugcaggaggaccagaggcuuguuuaaguauagacaccucaaagaugacgaggaaacaggcuacagaaggauuauugaaagacugaacagcaaaaaaggaaaaaacagacugcuugauggugagagguuggcugauaggaaaauugcugagcuguucucuacaaaaacacacauuggcuaa

SEQ ID NO: 3585 - RNA, 5067 nt, Artificial Sequence
  derived and/or modified CDS sequence (wt) from CCHFV(81-R-2014)__KR814865.1__GP
augccuaccaacauuaugcauacacuauuagugugcuucauucuuuaccuacagcuguugggucuaggaggagcucauggacagucaaacgcaacugaacacaauggaacaaacaccaccacaguacccagcacaagucaaagccccaagccacuugugagcacaaccccaccacacgcacuggaaucaucaaccaucaaacccaccacaccaacaagcgaaacagaaggcucaggggaaacggccccacucccaaacaccacccagggcccgccuccaccagagaccacaccagaacgccccgcaacaacugucacaaguacgccaaguacagacaacacgaauuccaccauacaugugaccgacaacaaccccacaucaacaaucagcacaaguccauccagcagccccagcacgccauccacaccacaaggcauacaucauccugcaaggagucuauugucagucucgagcccuaagacagcaacaacaccaacaccgacgagcccuggggagauaaacucagaaaccagcagucugcacucagccaugagcagaacaccaacccuccacacagcaacccaggucuccacugaaaaugccaaccacagcgcaccuagacagucugaguccucagcacagccaacaaccacaagccuaaugacuuccccagcacagucaauccuucuaaugagugcugcuccuacagcuauucagaacacacaucccagcccaacaaauaggucuaagaggaaccuugagauggaaauaauuuuaacucugucucaaggucuaaagaaauacuacgguaagauacugaagcuacuacaccucaccuuggaagaggacacugaaggccuguuagaaugguguaagagaaaccuugggucaaacugugaugaugacuucuuucaaaagagaauaggagaauucuucaugacuggugagggcuacuucaaugaagucuuacaauuuaaaacacuaagcacacuaagccccacggagccgucucaugccaggcuaccaacaguggaacccuucaaaucuuacuucgcuaagggcuuccuuucaauagauucagguuacuucucugccaaauguuauccaagaucaucuacuucagggcuccagcugaucaauguuacccaacacccagcuaggauagcagaaacacccggacccaagacaacgagucugaaaaccaucaacuguauaaaccuaagagcaucagucuucaaagaacacagagaaauugagaucaaugugcuucuuccucagauugcagucaaccucucaaauugccauguugugaucaauucacaugucugugauuacucuuuagacacugaugggccagugaggcuuccucacauuuaccaugaagggacuuucauaccaggaacuuauaaaauagugauagacaagaaaaauaagcuaaaugaccgauguacacuagucaccaacugugugauaaaaggaagagagguucguaagggccaaucagugcugaggcaguacaaaacagaaaucaagauaggcaaggcaucaacaggcucuaggaaacuacuguccgaagagccaggugaugacugcauaucaagaacucagcuauugaggacagaaacagcagagauccaugaugacaacuauggugguccaggugauaaaauaacuaucugcaacgguucaaccauuguagaucagagacugggcagugaacuaggguguuauaccaucaacagagugaagucauucaagcuaugcgaaaacagcgccacagggaaaaccugugagauagacagcacuccgguuaagugcaggcaaggcuuuuguuuaaaaaucacccaagagggaaggggccacguaaaauuaucuagaggcucagagguugucuuggaugccugcgacucaagcugcgaaguaaugauaccuaaaggcacuggagauauccugguggacuguucagguggacagcaacauuucuuaaaagacaacuuaauugaccuagggugcccccauaucccgcuauuggguaaaauggccauuuacaucugcagaaugucaaaucauccuagaacaacuauggcuuuucucuucugguucagcuuuggcuaugugaucaccuguauauuuugcaaggcucuuuuuuauucauugauaauuauugggacacuagggaaaaagaucaagcaauauagggaacugaaaccucaaacuuguaccauaugugagacagcuccugucaaugcaauagaugcugaaaugcaugaccuuaacugcaguuacaauauaugcccuuauugugcaucaagauugaccuccgaugggcuagcuaggcaugugccacagugccccaagcgaaaggaaaaaguugaggagacugagcuguacuugaaccuggaaagaauuccuuggaucgucagaaagcuauugcaagugucagaauccacugguguggcauugaaacgaagcagcuggcugauuguacugcuuguguuacucacaguuucauugucaccgguucaaucagcaccuguuggucaugguaagacaaucgaaacauaucagaccagagaaggauucacaaguaucugucucuuuauguuaggaagcauccuauuuuuagucucuugcuuggugaaggggcugguugacagugucagugacagcuucuuccccggccugucugucuguaagacaugcucuauuggcaguauaaauggcuuugaaauugaaucgcauaaaugcuacuguagccuauuuugcugccccuacuguaggcacugcucugcugacagagaaauucaccaguuacacuugagcaucugcaaaaaaagaaaaacggguagcaaugucaugcuggcugucugcaaacgcaugugcuuuagagcaaccauagaggcaagcagaagagcccugcucauccgaagcauuaucaauaccacuuuuguaauaugcauucuaacauugacaaucuguguuguuagcaccucugcaguagagauggaaaaccuuccagcaggcacuugggagagagaggaagaccugacaaauuucugucaucaggaaugccagguaaccgagacggagugccucuguccauacgaagcucuugugcucagaaaaccucuguucuuagacaguauaguuaaaggcaugaaaaauuugcuaaacucaacaagcuuagaaacaagcuuaucaaucgaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguagaggaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcuggggaguaggaacuggcugcaccugcugcgggguggauguaaaagaccuuuuuacagaucacauguuugucaaguggaagguugaauauauaaaaacugaagccauaguauguguugagcucaccagccaagaaagacagugcagucugauugaggcagguaccagauucaacuugggcccugugacuauuacccugucugagccaagaaacauacagcagaagcuucccccugagauuaucacguugcaucccaaaguugaagagggcuucuuugacuugaugcaugugcaaaaaguguugucugcaaguacaguguguaaacugcagaguugcacacacggcauaccaggagaucuacaaguuuaccacauuggcaacuugcugaaaggagauaggauaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacauugaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcacaccaaaaaaguugagauaucaggcuugaaauuugcaagucuggcuugcacggguugcuaugcuuguagcucuggcaucuccuguaaagucaggauucauguagaugagccagaugagcucacaguacauguaaagagcagugauccagaugugguugcagccagcacaagucucauggcgaggaagcuugaguuugggacagacaguaccuucaaggccuuuucagcuaugcccaaaaccucuuuauguuuuuacauuguggagagagaauacuguaagagcugcagugaagaggacacacaaaaauguguugacacaagacuugagcagccgcagagcauacuaauugagcacaaaggaacgauaauugggaagcagaaugauacuugcacagccaaggcaagcuguugguuagagucagucaagaguuuuuuuuauggauugaagaauaugcuugguagugucuuugguaauuuuuucauaggcauucuguuauuccuugccccuuuuguccuguuggugcuuuucuuuauguuuggguggaaaaucuuguuuugcuuuaaauguugcaggaggaccagaggcuuacuuaaguauagacaccucaaagacgaugaggaaacaggcuacagaaggauuauugaaagacugaacaacaaaaaagggaaaaacagacugcuugauggugaaagguuggcugauaggaaaauugcugagcuguucuccacaaaaacacacauugguuaa

SEQ ID NO: 3586 - RNA, 5067 nt, Artificial Sequence
  derived and/or modified CDS sequence (wt) from CCHFV(75-ST-2010)__KR814864.1__GP
augccuaccaacauuaugcauacacuauuagugugcuucauucuuuaccuacagcuguuggguccaggaggagcccauggacagccaaacgcaacugaacacaacagaacaaacaccaccacagcacccagcacaagccaaagccccaagccacccgugagcacagccccaccacacgcacuggaaucacccaccaucaaauccaccacaccaacaagcgaaacagaaggcucaggggaaacgaccccacccccaaacaccacccagggcccgucucuaccagagaccacaccagaacgccccgcaacaacugccacaaguacgccaagcacagacaacacaaauuccaccacacaugugaccgacaacaacccuacaucaacaaucagcacaaguccauccagcagccccagcacgccauccacaccacgaggcauacaucauccugcaaggaaucuauugucagucucgagcccuaagacagcaacaacaccaacaccaacgagcccuggggagauaagcucagaaaccagcagucugcacucagccaugagcagaacaucaacccucuacacagcaacccaggccuccacugaaaaugccaaccacagcgcaccuagacagucugaguccccagcacagccgacaaccacaagccuaaugaccuccccagcacaaucaauccuuguaaugagugcugcuccuacagcuauucagaacauacaucccagcccaacgaauaggucuaagaggaaccuugagauggaaauaauuuuaacucugucucaaggucuaaagaaauacuacgguaagauacugaagcuucugcaccucaccuuggaagaggacacugaaggccuguuagaaugguguaagagaaaccuugggucaaacugugaugaugacuucuuucagaagagaauagaagaauucuucaugaccggugagggcuacuucaaugaagucuuacaauuuaaaacacuaagcacacuaagccccacggagccgucucaugccaggccaccaacaguggaacccuucaaaucuuacuucgcuaagggcuuccuuucaauagauucagguuacuucucugccaaauguuauccaagaucaucuacuucagggcuucagcugaucaauguuacccaacacccagcuagaauagcagaaacaccuggacccaagacaacgagucugaaaaccaucaacuguauaaaccuaagagcaucagucuucaaagaacacagagaaauugagaucaaugugcuucuuccucagauugcagucaaccucucaaauugccauguuguaaucaauucacaugucugugauuauucuuuagacacugaugggccagugaggcuuccucacauuuaccaugaaggaacuuucauaccaggaacuuacaaaauagugauagacaaaaaaaauaagcuaaaugaccgauguacacuggucaccaacugugugauaaaaggaagagagguucguaagggccaaucagugcugaggcaguacaaaacagaaaucaagauaggcaagguaucaacaggcucuaggaaacuacuguccgaagagucaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauaccaucaacagggugaagucauucaagcuaugcgaaaacagcgccacagggaaaaccugugagauagacagcacuccgguuaagugcaggcaagguuuuuguuuaaaaaucacccaagaaggaaggggccacguaaaauuaucuagaggcucagagguuguuuuggaugcuugcgacucaagcugcgaaguaaugauaccuaaaggcacuggagauaucuugguggacuguucagguggacagcaacauuucuuaaaagacaacuuaauugaccuagggugcccccauaucccgcuauuggguaaaauggccauuuacaucugcagaaugucaaaucacccuagaacaacuauggcuuuucucuucugguucagcuuuggcuaugugaucaccuguuuauuuugcaaggcucuuuuuuauucauugauaaucauugggacacuagggaaaaagaucaagcaauauagggaauugagaccucaaaccuguaccauaugugagacagcuccugucaaugcaauagaugcugaaaugcaugaccuuaacugcaguuacaauauauguccuuauugugcaucaagauugaccuccgaugggcuagcuaggcaugugccacaaugccccaagcggaaggaaaaaguugaggagacugagcuguacuugaaccuggaaagaauaccuuggauugucagaaagcuauugcaagugucagaguccacugguguggcauugaaacgaagcagcuggcugauuguacugcuuguguuacucacaguuucauugucaccgguucaaucagcaccuguuggucaugguaagacaaucgaaacauaucagaccagagaaggauucacaaguaucugucucuuuauguuaggaagcauccuguuuuuagucucuugcuuggugaaggggcugguugacagugucagugacagcuucuuccccggccugucugucuguaagacaugcuccauuggcaguauaaauggcuuugaaauugaaucgcauaaaugcuacuguagccuacuuugcugccccuacuguaggcacugcucugcugacagagaaauccaccaguuacacuugaguaucugcaaaaaaagaaaaacggguagcaaugucaugcuggcugucugcaaacgcaugugcuuuagggcaaccauagaagcaagcagaagagcccugcucauccgaagcauuauaaauaccacuuuuguaauaugcauuuuaacauuaacaaucuguguuguuagcaccucugcaguagagauggaaaaccuuccaucaggcacuugggagaaagaggaagaccugacaaauuucugucaucaggaaugccaggugaccgagacggagugccucuguccauacgaagcucuugugcucagaaaaccucuguucuuagacaguauaguuaaaggcaugaagaauuugcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguagaagaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcuggggaguaggaacuggcugcaccugcugcgggguggauguaaaagaccuuuuuacagaucacauguuugucaaguggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcauguacaaaaaguguugucugcaaguacaguguguaaacugcagaguugcacacaugguauaccaggagaucuacaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacauugaaacugauuacacgaaaaccuuccacuuccacucuaaaagaguuacagcacauggugacacaccacaauuagacuuaaaagcaaggccaaccuacggugcaggugagaucacugugcugguugagguugcugacauggaguugcauaccaagaaaguugagauaucaggccugaaauuugcaagucuggcuugcacggguugcuaugcuuguagcucuggcaucuccuguaaagucaggauucauguagaugagccagaugagcucacaguacauguaaagagcagugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaaugauacuugcacagccaaggcaagcuguuggcuagagucagucaagaguuuuuuuuauggauugaaaaauaugcuugguaguguauuuggcaacuuuuucauaggcauuuuguuauuccuugccccuuuuguccuguuggugcuuuucuuuauguuuggauggaaaaucuuguuuugcuucaaauguugcaggagggccagaggcuugcuuaaguauagacaccuaaaagacgaugaggaaacaggcuacagaaagauuauugaaaggcugaacaacaaaaaaggaaaaaacagacugcuugauggugaaagguuggcugauaggaaaauugcugagcuguucuccacaaaaacacacauugguuaa

SEQ ID NO: 3587 - RNA, 5067 nt, Artificial Sequence
  derived and/or modified CDS sequence (wt) from CCHFV(75-R-2012)__KR814863.1__GP
augccuaccaacauuaugcauacacuauuagugugcuucauucuuuaccuacagcuguugggucuaggaggagcucauagacagucaaacgcaacuggacacaacggaacaaacaccaccacagcacccagcacaagucaaagccccaagccacuugugagcacagccccaccacacgcacuggaaucauccaucaucaaacacaccacaccaguaagcgaaacagaaggcucaggggaaacgaccccacccccaaacaccacccagggcccgucuccacuagagaccacaccagaacgccccgcaacaacugccacaaguacgccaagcacagacaacacgaauuccaccacacaugugaccgacaacaacccuacaucaacaaucagcacaaguccauccagcagccccagcacgccauccacaccacaaggcauacaucauccugcaaggaaucuauugucagucucgagccuuaagacagcaacaacaccaacaccaacgagcccaggggagauaagcucagaaaccagcagucugcacucagccaugagcagaacaucaacccucuacacagcaacccaggucuccacugaaaaugccaaccacagcgcaccuagacagucugaguccucagcacagcagacaaccacaagcccaaugacuuccccagcacaaucaauccuuguaaugagugcugcuccuacagcuauucagaacacacaucccagcccaacgaauaggucuaagaggaaccuugagauggaaauaauuuuaacucugucucaaggucuaaagaaauauuaugguaagauacugaagcuucugcaccucaccuuggaagaggacacugaaggccuguuagaaugguguaagagaaaccuuggaucaaacugugaugaugacuucuuucagaagagaauagaagaauucuucaugaccggugagggcuacuucaaugaagucuuacaauuuaaaacacuaagcacacaaagccccacggagccgucucaugccaggccaccaacaguggagcccuucaaaucuuacuucgcuaagggcuuccuuucaauagauucagguuacuucucugccaaauguuauccaagauuaucuacuucagggcuucagcugaucaaugucacccaacacccagcuagaauagcagaaacaccuggacccaagacaacgagucugaaaaccaucaacuguauaaaccuaagagcaucagucuucaaagaacacagagaaauugagaucaaugugcuucuuccucagauugcagucaaccucucaaauugccauguuguaaucaauucacaugucugugauuauucuuuagacacugaugggccagugaggcuuccucacauuuaccaugaagggacuuucauaccaggaacuuauaaaauagugauagacaaaaaaaauaagcuaaaugaccgauguacacuggucaccaacugugugauaaaaggaagagagguucguaagggccaaucagugcugaggcaguacaagacagaaaucaagauaggcaaggcaucaacaggcucuagaaaacuacuguccgaggagccaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauaccaucaacagggugaagucauucaagcuaugcgaaaacagcgccacagggaaaaccugugagauagacagcgcuccgguuaagugcaggcaagguuuuuguuuaaaaaucacccaagagggaaggggccacguaaaauuaucuagaggcucagagguuguuuuggaugcuugcgacucaagcugcgaaguaaugauaccuaaaggcacuggagauauccugguggacuguucagguggacagcaacauuucuuaaaagacaacuuaauugaccuagggugcccacauaucccgcuauuggguaaaauggccauuuacaucugcagaaugucaaaucauccuagaacaacuauggcuuuucucuucugguucagcuuuggcuaugugaucaccuguauauuuugcaaggcucuuuuuuauucauugauaauuauugggacacuagggaaaaagaucaagcaauauagggaauugaaaccucaaacuuguaccauaugugagacagccccugucaaugcaauagacgcugaaaugcaugaccuuaacugcaguuacaauauaugcccuuauugugcaucaagauugaccuccgaugggcuagcuaggcaugugccacaaugccccaagcggaaggaaaaaguugaggagacugagcuguacuugaaccuagaaagaauuccuuggauugucagaaagcuauugcaagugucagaguccacugguguggcauugaagcgaagcagcuggcugauuguacugcuuguguuacucacaguuucauugucaccgguucaaucagcaccuguuggucaugguaagacaaucgaaacauaucagaccagagaaggauucacaaguaucugucucuuuauguuaggaagcauccuguuuuuagucucuugcuuggugaaggggcugguuaacagugucagugacagcuucuuccccggccugucuguuuguaagacaugcucuauuggcaguauaaauggcuuugaaauugaaucgcauaaaugcuacuguagccuauuuugcugccccuacuguaggcacugcucugcugacagagaaauucaucaguuacacuugaguauuugcaaaaaaagaaaaacggguagcaaugucaugcuggcugucugcaaacgcaugugcuuuagggcaaccauagaagcaagcagaagagcccugcucauccgaagcauuauaaauaccacuuuuguaauaugcauuuuaacauugacaaucuguguuguuagcaccucugcaguagagauggaaaaccuuccaucaggcacuugggagagagaggaagaccugacaaauuucugucaucaggaaugccagguaaccgagacggagugccucuguccauacgaagcucuugugcucagaaaaccucuguucuuagacaguauaguuaaaggcaugaagaauuugcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcagguccgaaucaauuaugaaacuggaggaaaggacaggagucagcugggaucuaggcguagaagaugccucugaguccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcuggggaguagguacuggcugcaccugcugcgggguggauguaaaagaccuuuuuacagaucacauguuugucaaauggaagguugaauauauaaaaacugaagccauaguauguguugagcucaccagucaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcaugugcaaaaaguguugucugcaaguacaguguguaaacugcagaguugcacacaugguauaccaggagaucuacaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacauugaaacugauuacacgaaaaccuuccacuuccacucuaaaagaguuacagcacauggugacacaccacaauuagacuuaaaagcaaggccgaccuacggugcaggugagaucaccgugcugguugagguugcugacauggaguugcauaccaagaaaguugagauaucaggcuuaaaauuugcaagucuggcuugcacggguugcuaugcuuguagcucuggcaucuccuguaaagucaggauucauguagaugagccagaugagcucacaguacauguaaagagcagugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaaugauacuugcacagccaaggcaagcuguuggcuagagucagucaagaguuuucuuuauggauugaaaaauaugcuugguaguguauuugguaacuuuuucauaggcauuuuguuauuccuugccccuuuuguccuguuggugcuuuucuuuauguuuggauggaaaaucuuguucugcuucaaauguugcaggaggaccagaggcuuacuuaaguauagacuccucaaagacgaugaggaaacaggcuacagaaggauuauugaaagacugaacaacaaaaaaggaaaaaacagacugcuugauggugaaagguuggcugauaggaaaauugcugagcuguucuccacaaaaacacacauugguuaa

SEQ ID NO: 3588 - RNA, 5067 nt, Artificial Sequence
  derived and/or modified CDS sequence (wt) from CCHFV(52-R-2014)__KR814862.1__GP
augccuaccaacauuaugcauacgcuauuagugugcuucauucuuuaccuacagcuguugggucuaggaggagcucauagacagucaaacgcaacugaacacaacggaacaaacaccaccacagcacccagcacaagccaaagccccaagccaccugugagcacagccccaccacacgcaccagaaucauccaccaucaaacccaccacaccagcaagcgaaacagaaggcucaggggaaacgaccccacccccaaacaccacccagggcccgucuccaccagaggccacaccagaacgccccgcaacaacugccacaaguacgccaagcacagacaacacgaacuccaccacacacgcgaccgacaacaacccuacaucaacaaucagcacaaguccauccagcagccccagcacgccauccacaccacaaggcauacaucauccugcaaggaaucuauugucagucucgagcccuaagacagcaacaacaccaacaccaacgagcccuggggauauaagcucagaaaccagcagucugcacucagccaugagcagaacaccaacccuccacacagcaacccaggccuccacugaaaaugccaaccacagcgcaccuagacagucugaguccucagcacagcagacaaccacaagcccaaugacuuccccagcacaaccaauccuuguaaugagugcugcuccuacagcuauucagaacauacaucccagcccaacgaauaggucuaagaggaaccuugagauggaaauaauuuuaacucugucucaaggucuaaagaaauacuaugguaagauacugaagcuucugcaccucaccuuggaagaggacacugaaggccuguuagaaugguguaagagaaaccuugggucaaacugugaugaugacuucuuucagaagagaauagaagaauucuucaugaccggugagggcuacuucaaugaagucuuacaauuuaaaacacuaagcacacuaagccccacggagccgucucaugccaggccaccaacaguggaacccuucaaaucuuacuucgcuaagggcuuccuuucaauagauucagguuacuucucugccaaauguuauccaagauuaucuacuucagggcuucagcugaucaaugucacccaacacccagcuagaauagcagaaacaccuggacccaagacaacaagucugaaaaccaucaacuguauaaaccuaagagcaucagucuucaaagaacacagagaaauugagaucaaugugcuccuuccucagauugcagucaaccucucaaauugccauguuguaaucaauucacaugucugugauuauucuuuagacacugaugggccagugaggcuuccucacauuuaccaugaagggacuuucauaccaggaacuuauaaaauagugauagacaaaaaaaauaagcuaaaugaccgauguacacuggucaccaacugugugauaaaaggaagagagguucguaagggccaaucagugcugaggcaguacaaaacagaaaucaagauaggcaaggcaucaacaggcucuaggaaacuacuguccgaggagccaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauacuaucaacagggugaagucauucaagcuaugcgaaaacagcgccacagggaaaaccugugagauagacagcacuccgguuaagugcaggcaagguuuuuguuuaaaaaucacccaagagggaagaggccacguaaaauuaucuagaggcucagagguuguuuuggaugcuugcgacacaagcugcgaaguaaugauaccuaaaggcacuggagauauccugguggacuguucagguggacagcaacauuucuuaaaagacaauuuaauugaccuagggugcccccaugucccgcuauuggguaaaauggccauuuacaucugcagaaugucaaaucauccuagaacaacuauggcuuuucucuucugguucagcuuuggcuaugugaucaccuguauauuuugcaaggcucuuuuuuauucauugauaauuauugggacacuagggaaaaagaucaagcaauauagggaauugaaaccucaaacuuguaccauaugugagacagcuccugucaaugcaauagacgcugaaaugcaugaccuuaacugcaguuacaauauaugcccuuauugugcaucaagauugaccuccgaugggcuagcuaggcaugugccacaaugccccaagcggaaggaaaaaguugaggagacugagcuguacuugaaccuggaaagaauuccuuggauugucagaaagcuauugcaagugucagaguccacugguguggcauugaaacgaagcagcuggcugauuguacugcuuguguuacucacaguuucauugucaccgguucaaucagcaccuguuggucaugguaagacaaucgaaacauaucagaccagagaaggauucacaagugucugucucuuuauguuaggaagcauccuguuuuuagucucuugcuuggugaaggggcugguugacagugucagugacagcuucuuccccggccugucugucuguaagacaugcucuauuggcaguauaaauggcuuugaaauugaaucgcauaaaugcuacuguagccuauuuugcugccccuacuguaggcacugcucugcugacagagaaauucaucaguuacacuugaguaucugcaaaaaaagaaaaauggguagcaaugucaugcuggcugucugcaaacgcaugugcuuuagggcaaccauagaagcaagcagaagagcccugcucauccgaagcauuauaaauaccacuuuuguaauaugcauuuuaacauugacaaucuguguuguuagcaccucugcaguagagauggaaaaccuuccaucaggcacuugggagagagaggaagaccugacaaauuucugucaucaggaaugccagguaaccgagacggagugccucuguccauacgaagcucuugugcucagaaaaccucuguucuuagacaguauaguuaaaggcaugaagaauuugcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguagaugaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaacuugcuugcauaaagaauggccucacucaagaaacuggagauguaaucccacuuggugcuggggaguaggaacuggcugcaccugcugcgggguggauguaaaagaccuuuuuacagaucacauguuugucaaauggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcaugugcaaaaaguguugucugcaaguacaguguguaaacugcagaguugcacacaugguauaccaggagaucuacaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaauaucgaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcauaccaagaaaguugagauaucaggcuuaaaauuugcaagucuggcuugcacggguugcuaugcuuguagcucuggcaucuccuguaaagucaggauucauguagaugagccagaugagcucacaguacauguaaagagcaaugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaaugauacuugcacagccaaggcaggcuguuggcuagagucagucaagaguuuuuuuuauggauugaaaaauaugcuugguaguguauuugguaacuuuuucauaggcauuuugcuauuccuugccccuuuuguccuguuggugcuuuucuuuauguuuggauggaaaaucuuguuuugcuucaaauguugcaggaggaccagaggcuuacuuaaguauagacuccucaaagacgaugaggaaacaggcuacagaaggauuauugaaagacugaacaacaaaaaaggaaaaaacagacugcuugauggugaaagguuggcugauaggaaaauugcugaacuguucuccacaaaaacacacauugguuaa

SEQ ID NO: 3589 - RNA, 5067 nt, Artificial Sequence
  derived and/or modified CDS sequence (wt) from CCHFV(47-ST-2013)__KR814861.1__GP
augcccaucaacauuaugcauacacuauuagcgugcuucauucuuuaccuacagcugucggguuuaggaggagcucauggacagucaaacgcaacugaacacaauggaacaaacaccaccacaguacccggcacaagucaaagccccaaaccacccgcgagcaccacuuuaccacacacaccagaauccuccaccgucaaacucaccacaccaacaagcgaaacagaaggcucaggggaaacgaccccacccccaaacaccacccagggccugcccccaccagggaccacaccagaacgcuccgcaacaaccgccacaagcacgucaagcacagacaacaugaauuccaccacacagaugaccggcaacacccccacaccaacagucaacaugaguccauccagcagccccagcaugccauccacaucacaaggcauacauuaucccguaaggagucuauugucagucccgagccccaagacagcaacaacaccgacaccagugagcccuggagagaugagcccggaaaccagcagucagcacucagccacgagcagaauaccaacccucuacacagcaacccagguuuccacugagaacaccaaccgcagcacaccuagacaaucuaaguccucaguacagccggcaacccaaagcccaauaacucccccagcgcaaacaauccuucugaugagugcugcuccuaaagcuauucaggacaugcaucccagcccaacaaacagguccaagaggaaccuugagguggaaauaauuuuaacucugucucaaggucuaaagaaauauuacgguaaaauacugaagcuucugcaccuuaccuuggaagaggauacugaaggccuguuagaauggugcaagagaaaccuugggucaaauugugaugaugacuucuuucaaaagagaauagaagaauucuucauaacuggugagggcuacuucaaugaaguccuacaauuuaaaacacuaagcacacuaagccccacggagccgucucaugucaggcuaccaacagcggagcccuucaaaucuuacuacgcuaagggcuuccuuucauuagauucggguuacuucucugccaaauguuauccaagaucauccacuucagggcuucagcugaucaaugucacccaacacccagcuaggauagcagaaacaccuggacccaaaacaacaagucugaaaaccaucaacuguaucaaccuaagagcaucagucuucaaagaacacagagaaguugagaucaaugugcuucuuccucagauugcagucaaccucucaaacugccauguugugaucaacucacaugucugugauuauccuuuagacacugacgggccagugaggcuuccucgcauucaccaugaagguacuuucauaccaggaacuuauaaaauagugauagacaaaaaaaauaagcuaaaugaccgaugcucgcuagucacuaacugugugauaaagggaagagagguucguaagggccaaucagugcugaggcaguacaaaacagaaauuaagauaggcaaggcaucaacaggcucuaggaaacuacuguccgaagagccaggugacgacugcauaucaagaacucagcuguugaagacagaaacagcagagauccaugacgacaacuauggugguccaggugacaaaauaacuaucugcaaugguucaaccauuguagaucagagacuggguagugaacuaggguguuauaccaucaacagggugaagucauucaagcuaugcaaaaacagugccacagggaaaaccugugagauagacagcacuccggucaagugcaggcaagguuuuuguuugaaaaucacccaagagggaaggggccacguuaaauuauccaggggcucagagguuguuuuggaugcuugcgacucgagcugugaaauaaugauaccuaaaggcacuggagauauccuaguagacugcucagguggacagcaacauuucuuaaaagacaacuugauugaccuagggugcccucauaucccgcuauuggguaagauggccauuuacauuugcagaaugucaaaucaucccaggacaaccauggcuuuccucuucugguucaguuuuggcuauguaaucaccuguauauuuugcaaggcucuuuuuuauucauugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagauugaccucugaugggcuagcuagacaugugacacaaugcccuaagcgaaaggagaaaguugaggagacugaacuguauuugaaccuggaaagaauuccuuggauagucagaaaguuauugcaagugucagaguccacugguguggcauugaaacgaagcaguuggcugauugugcugcuuguguuacucacagucucauugucaccgguucaaucagcaccuguuggucaugguaagacaauugaaacauaucagaccagagaaggauucacaaguaucugucucuuuauguuaggaagcauccuauucauaguuuccugccugguaaaggggcugguugacagugucagugacagcuucuuccccggccugucugucuguagaacaugcucuauuggcaguauaaauggcuuugaaauugaaucgcacaaaugcuacuguaguuuauuuugcugccccuacuguaggcacugcucugcugacagagaaauucaccaguugcacuugaguaucugcaaaaaaagaaaaacggggagcaaugucaugcuggcugucugcaagcgcaugugcuuuaaggcaaccauagaagcaagcagaagagcccuguucauccggagcauuaucaauaccacuuuuguaacaugcauucuaacauuagcaaucuguguuguuagcaccucugcaguagagauggaagaccuuccagcaggcacuugggagagagaggaagaccugacaaauuucugccaucaggaaugccaggugaccgagacggaaugccucuguccauacgaagcucuugugcucaggaaaccucuuuucuuagacaguauaguuaaagguaugaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagauccuggucacaggcaggucugaaucaauuaugaaacuagaggaaaggacaggagucagcugggaucuagguguagaagaugccucugaauccaaauuacuuaccgucucuaucauggauuugucacaaauguauuccccuguuuuugaguacuuaucaggagauagacagguugaagaauggcccaaggcaaccugcacaggugaaugcccagaaagguguggcugcacaucaucaaccugcuugcauaaagaauggccucacucaagaaacuggagauguaaucccacuuggugcuggggaguaggaaccggcugcacaugcugcggaguggauguaaaagaccuuuuuacagaucacauguuuaucaaauggaagguugaauauauaaaaaccgaagccauaguauguguugagcucaccagccaagaaagacagugcagucugauugaggcagguacuagauucaacuuagguccugugacuaucacccugucugagccaagaaacauucagcagaagcuucccccugagaucauuacgcugcaucccaaaauugaagaaggcuucuuugacuugaugcauguacaaaaaguguuaucugcaaguacaguguguaaacugcagaguugcacacaugguauaccaggagaucuacaaauuuaccacauuggcaacuuguugaaaggggauagaguaaacgggcaucuaauucacaaaauugaaccacauuuuaacaccucuuggauguccugggaugguugugaccuagacuacuacugcaacaugggggauuggccuucuugcacauacacaggagugacccaacauaaucaugcugcauuuguaaacuugcuuaacauugaaacugauuacacaaaaaccuuccacuuccacucuaaaagagucacagcacauggagacacaccacaauuagacuuaaaagcaaggccgaccuacggugcaggugagaucaccgugcugguugagguugcugacauggaguugcauaccaagaaaguugagguaucaggcuugaaauuugcaagucuggcuugcacggguugcuaugcuuguagcucuggcaucuccuguaaagucagaauucauguagaugaaccagaugagcucacagugcauguaaagagcagugauccagaugugguugcagcuagcacaagccuuauggcaaggaagcuugaauuugggacagauaguacauucaaggcauuuucagcuaugccuaaaaccucuuuaugcuuuuacauuguggagagggaauacugcaaaagcugcagugaagaugauacaaaaaaauguguugacacaaaacuugaacagccacagagcauacuaauugagcacaaagggacaauaauuggaaagcagaaugauacuugcacagccaaggcaaguuguuggcuagagucagucaagaguuuuuuuuauggauugaagaauaugcuuggcaguguuuuugguaauuuuuuuguaggcauuuuguuauuccuugccccuuuugucuuguuggugcuuuucuuuauguuuggauggaaaaucuuguuuugcuuuaaguguugcaggaggaccagaggcuuguuuaaguauagacaccucaaagaugaugaggaaacaggcuacagaaggauuauugaaagacugaacagcaaaaaagggaaaaacagacugcuugauggugagagguuggcugauaggaaaauugcugagcuguucucuacgaaaacacacauuggcuaa

SEQ ID NO: 3590 - RNA, 5067 nt, Artificial Sequence
  derived and/or modified CDS sequence (wt) from CCHFV(46-ST-2012)__KR814860.1__GP
augccuaccaacauuaugcauacacuauuagugugcuucauucuuuaccuacagcuguugggucuaggaggagcucauggacagucaaacgcaacugaacacaauggaacaaacaccaccacaguacccagcacaagucaaagccccaagccacuugugagcacaaccccaccacaugcacuggaaucaucaaccaucaaacccaccacaccaacaagcgaaacagaaggcucaggggaaacggccccacucccaaacaccacccagggcccgccuccaccagagaccacaccagaacgccccgcaacaacugucacaaguacgccaaguacagacaacacgaguuccaccauacaugugaccgacaacaaccccacaucaacaaucagcacaaguccauccagcagccccagcacgccauccacaccacaaggcauacaucauccugcaaggagucuauugucagucucgagcccuaagacagcaacaacaccaacaccgacgagcccuggggagauaaacucagaaaccagcagucugcacucagccaugagcagaacaccaacccuccacacagcaacccaggucuccacugaaaaugccaaccacagcgcaccuagacagucugaguccucagcacagccaacaaccacaagccuaaugacuuccccagcacaaucaauccuucuaaugagugcugcuccuacagcuauucagaacauacaucccagcccaacaaauaggucuaagaggaaccuugagauggaaauaauuuuaacucugucucagggucuaaagaaauacuacgguaagauacugaagcuacuacaccucaccuuggaagaggacacugaaggccuguuagaaugguguaagagaaaccuugggucaaacugugaugaugacuucuuucaaaagagaauagaagaauucuucaugacuggugagggcuacuucaaugaagucuuacaauuuaaaacacuaagcacacuaagccccacggagccgucucaugccaggcuaccaacaguggaacccuucaaaucuuacuucgcuaagggcuuccuuucaguagauucagguuacuucucugccaaauguuauccaagaucaucuacuucagggcuccagcugaucaauguuacccaacacccagcuaggauagcagaaacacccggacccaagacaacgagucugaaaaccaucaacuguauaaaccuaagagcaucugucuucaaagaacacagagaaauugagaucaaugugcuucuuccucagauugcagucaaccucucaaauugccauguugugaucaauucacaugucugugauuacucuuuagacacugaugggccagugaggcuuccucacauuuaccaugaagggacuuucauaccaggaacuuauaaaauagugauagacaagaaaaauaagcuaaaugaccgauguacacuagucaccaacugugugauaaaaggaagagagguucguaagggccaaucagugcugaggcaguacaaaacagaaaucaagauaggcaaggcaucaacaggcucuaggaaacuacuguccgaagagccaggugaugacugcauaucaagaacucagcuauugaggacagaaacagcggagauccaugaugacaacuauggugguccaggugauaaaauaacuaucugcaacgguucaaccauuguagaucagagacugggcagugaacuaggguguuauaccaucaacagagugaagucauucaagcuaugcgaaaacagcgccacagggaaaaccugugagauagacagcacuccgguuaagugcaggcaaggcuuuuguuuaaaaaucacccaagagggaaggggccacguaaaauuaucuagaggcucagagguugucuuggaugccugcgacucaagcugcgaaguaaugauaccuaaaggcacuggagauauccugguggacuguucagguggacagcaacauuucuuaaaagacaacuuaauugaccuagggugcccccauaucccgcuauuggguaaaauggccauuuacaucugcagaaugucaaaucauccuagaacaacuauggcuuuucucuucugguucagcuuuggcuaugugaucaccuguauauuuugcaaggcucuuuuuuauucauugauaauuauugggacacuagggaaaaagaucaagcaauauagggaacugaaaccucaaacuuguaccauaugugagacagcuccugucaaugcaauagaugcugaaaugcaugaccuuaacugcaguuacaauauaugcccuuauugugcaucaagauugaccuccgaugggcuagcuaggcaugugccacagugccccaagcgaaaggaaaaaguugaggagacugagcuguacuugaaccuggaaagaauuccuuggaucgucagaaagcuauugcaagugucagaauccacugguguggcauugaaacgaagcagcuggcugauuguacugcuuguguuacucacaguuucauugucaccgguucaaucagcaccuguuggucaugguaagacaaucgaaacauaucagaccagagaaggauucacaaguaucugucucuuuauguuaggaagcauccuauuuuuagucucuugcuuggugaaggggcugguugacagugucagugacagcuucuuccccggccugucugucuguaagacaugcucuauuggcaguauaaauggcuuugaaauugaaucgcauaaaugcuacuguagccuauuuugcugccccuacuguaggcacugcucugcugacagagaaauucaccaguuacacuugagcaucugcaaaaaaagaaaaacggguagcaaugucaugcuggcugucugcaaacgcaugugcuuuagagcaaccauagaggcaagcagaagagcccugcucauccgaagcauuaucaaugccacuuuuguaauaugcauucuaacauugacaaucuguguuguuagcaccucugcaguagagauggaaagccuuccagcaggcacuugggagagagaggaagaccugacaaauuucugucaucaggaaugccagguaaccgagacggagugccucuguccauacgaagcucuugugcucagaaaaccucuguucuuagacaguauaguuaaaggcaugaaaaauuugcuaaacucaacaagcuuagaaacaagcuuaucaaucgaggcaccauggggagcaauaaauguccagucaaccuuuaaaccaacaguaucgacugcaaacauagcacucaguuggagcucaguggagcacagaggcaacaagaucuuagucacaggcaggucugaaucaauuaugaaacuggaggaaaggacaggagucagcugggaucuaggcguagaggaugccucugaauccaaauuacuuaccgucucuaucauggaucugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcuggggaguaggaacuggcugcaccugcugcgggguggauguaaaagaccuuuuuacagaucacauguuugucaaguggaagguugaauauauaaaaacugaagccauaguauguguugagcucaccagccaagaaagacagugcagucugauugaggcagguaccagauucaacuugggcccugugacuauuacccugucugagccaagaaacauacagcagaagcuucccccugagauuaucacauugcaucccaaaguugaagagggcuucuuugacuugaugcaugugcaaaaaguguugucugcaaguacaguguguaaacugcagaguugcacacacgguauaccaggagaucuacaaguuuaccacauuggcaacuuacugaaaggagauaggauaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacauugaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcacaccaaaaaaguugagauaucaggcuugaaauuugcaagucuggcuugcacggguugcuaugcuuguagcucuggcaucuccuguaaagucaggauucauguagaugagccagaugagcucacaguacauguaaagagcagugauccagaugugguugcagccagcacaagucucauggcgaggaagcuugaguuugggacagacaguaccuucaaggccuuuucagcuaugcccaaaaccucuuuauguuuuuacauuguggagagagaauacuguaagagcugcagugaagaggacacacaaaaauguguugacacaagacuugagcagccgcagagcauacuaauugagcacaaaggaacgauaauuggaaagcagaaugauacuugcacagccaaggcaagcuguugguuagagucagucaagaguuuuuuuuauggauugaagaauaugcuugguagugucuuugguaauuuuuucauaggcauucuguuauuccuugccccuuuuguccuguuggugcuuuucuuuauguuuggguggaaaaucuuguuuugcuuuaaauguugcaggaggaccagaggcuuacuuaaguauagacaccucaaagacgaugaggaaacaggcuacagaaggauuauugaaagacugaacaacaaaaaagggaaaaacagacugcuugauggugaaagguuggcugauaggaagauugcugagcuguucuccacaaaaacacacauugguuaa

SEQ ID NO: 3591 - RNA, 5067 nt, Artificial Sequence
  derived and/or modified CDS sequence (wt) from CCHFV(44-ST-2010)__KR814859.1__GP
augcccaucaacauuaugcauacacuauuagugugcuucauucuuuaccuacagcuaucggguuuaggaggagcucauggacagucaaacgcaacugaacacaauggaacaaacaccaccacaguacccggcacaagucaaagccccaagccacccgcgagcaccacucuaccacacacaccagaauccuccaccgucaaacucaccacaccaacaagcgaaacagaaggcucaggggaaacgaccccacccccaaacaccacccagggccugcccccaccagggaccacaccagaacgccccgcaacaaccgccacaagcaugucaagcacagacaacaugaauuccaccacacaggugaccgacaacacccccacaucaacagucagcauaaguccauccagcagccccagcaugccauccacaucacaaggcauacauuaucccguaaggagucuauugucagucucgagcccuaagacaguaacaacaccgacaccaaugagcccuggagagaugagcccggaaaccagcagucaacacucagccaugagcagaauaccaacccucuacacagcaacccaggucuccacugagaacaccaaccgcagcacaccuagacaauccgaguccucagcacagccggcaacccaaagcccaacaacuuccccaacgcaaacaauccuucugaugagugcugcuccuaaagcuauucaggacaugcaucccagcccaacaaacagguccaagaggaaccuugagguggaaauaauuuuaacucugucucaaggucuaaagaaguauuacgguaaaauacugaagcuucugcaccuuaccuuggaagaggauacugaaggccuguuagaaugguguaagagaaaccuugggucaaauugugaugaugacuucuuucaaaagagaauagaagaauucuucauaacuggugagggcuacuucaaugaaguccuacaauuuaaaacacuaagcacacuaagccccacggagccgucucaugucaggcuaccaacagcggagcccuucaaaucuuacuucgcuaagggcuuccuuucaauagauucggguuacuucucugccaaauguuauccaagaucauccacuucagggcuucagcugaucaaugucacccaacacccagcuaggauagcagaaacaccuggacccaaaacaacgagucuaaaaaccaucaacuguaucaaccuaagagcaucagucuucaaagaacacagagaaguugagaucaaugugcuucuuccucagauugcagucaaccucucaaacugccauguugugaucaacucacaugucugugauuacucuuuagacacugacgggccagugaggcuuccucgcauucaccaugaagguacuuucauaccaggaacuuauaaaauagugauagacaaaaaaaauaagcuaaaugaccgaugcucgcuagucacuaacugugugauaaagggaagagagguucguaaaggccaaucagugcugaggcaguacaaaacagaaauuaagauaggcaaggcaucaacaggcucuaggaaacuacuguccgaagagccaggugacgacugcauaucaagaacucagcuauugaagacagaaacagcagagauccaugacgacaacuauggugguccaggugacaaaauaacuaucugcaaugguucaaccauuguagaucagagacugggcagugaacuaggguguuauaccaucaacaggguaaagucauucaagcuaugcgaaaacagugccacagggaaaaccugugagauagacagcacuccggucaagugcaggcaagguuuuuguuugaaaaucacccaagaggggaggggccacguaaaauuauccaggggcucagagguuguuuuggaugcuugcgacucgagcugugaaauaaugauaccuaaaggcacuggagauauccuaguagacuguucagguggacagcaacauuucuuaaaagacaacuugauugaccuagggugcccucauaucccgcuauuggguaagauggccauuuacauuugcagaaugucaaaucaucccaggacaaccauggcuuuccuccucugguucaguuuuggcuauguaaucaccuguauauuuugcaaagcucuuuuuuauucauugauaauuauugggacacuaggaaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuagcuaggcaugugacacaaugcccuaagcgaaaggagaaaguugaggagacugaacuguauuugaaccuggaaagaauuccauggauagucagaaagcuguugcaagugucagaguccacugguguggcauugaaacgaagcagcuggcugauugugcugcuuguguuacucacagucucauugucaccgguucaaucagcaccuguuggucaugguaagacaauugaaacauaucagaccagagaaggauucacaaauaucugucucuuuauguuaggaagcauccuauucauaguuucuugccugguaaaggggcugguugacagugucagugacagcuuuuuccccggccugucugucuguaagacaugcucuuuuggcaguauaaauggcuuugaaauugaaucgcauaaaugcuacuguaguuuauuuugcugccccuacuguaggcacugcucugcugacagagaaauucaccaguugcacuuggguaucugcaaaaaaagaaaaacggggagcaaugucaugcuggcugucugcaagcgcaugugcuuuaaggcaaccauagaagcaagcagaagagccuugcucauccgaagcauuaucaauaccacuuuuguaauaugcauccuaacauuagcaaucuguguuguuagcacuucugcaguagagauggaaaaucuuccagcaggcacuugggagagagaggaagaccugacaaauuucugccaucaggaaugccagguaagcgagacggaaugccucuguccauacgaagcucuugugcucaggaaaccucuuuucuuagacaguauaguuaaagguaugaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggauuugucacaaauguauuccccuguuuuugaguacuuaucaggagauagacagguugaagaauggcccaaggcaaccugcacaggugauugcccagaaagguguggcugcacaucaucaaccugcuugcauaaagaauggccucacucaagaaacuggagauguaaucccacuuggugcuggggaguaggaaccggcugcacaugcugcggaguggauguaaaagaccuuuuuacagaucacauguuuaucaaauggaagguugaauauauaaaaaccgaagccauaguauguguugagcucaccagccaagaaagacagugcagucugauugaggcagguacuagauucaacuuggguccugugacuaucacccugucugagccaagaaacauucagcagaagcuucccccugagaucauuacgcugcauccuaaaauugaagaaggcuucuuugacuugaugcaugugcaaaaaguguuaucugcaaguacaguguguaaacugcagaguugcacacaugguauaccaggagaucuacaaauuuaccacauuggcaacuuguugaaaggggauagauuaaacgggcaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccauucuaaaagagucacagcacauggagacacaccacaauuagacuuaaaagcaaggccgacuuacggugcaggugagaucacugugcugguugagguugcugacauggaguugcauaccaagaaaguugagauaucaggcuugaaauuugcaagucuggcuugcacggguugcuaugcuuguagcucuggcaucuccuguaaagucagaauucauguagaugaaccggaugagcucacagugcauguaaagagcagugauccagaugugguugcagcuagcacaagccuuauggcaaggaagcuugaauuugggacagauagcacauucaaggcauuuucagcuaugcccaaaaccucuuuaugcuuuuacauuguggagagggaauacugcaagagcugcagugaagaugauacaaaaaaauguguugacacaaaacuugaucagccacagagcauacuaauugagcacaaagggaccauaauuggaaagcagaaugacacuugcacagccaaggcaaguuguuggcuagagucagucaagaguuuuuuuuauggauugaagaauaugcuuggcaguguuuuugguaauuuuuucguaggcauuuuguuauuccuugcccccuuugucuuguuggugcuuuucuuuauguguggauggaaaaucuuguuuugcuuuaaguguugcaggaggaccagaggcuuguuuaaguauagacaccucaaagaugaugaggaaacaggcuacagaaggauuauugaaagacugaacagcaaaaaaggaaagaacagacugcuugauggugagagguuggcugauaggaaaauugcugagcuguucucuacaaaaucacacauuggcuaa

SEQ ID NO: 3592 - RNA, 5067 nt, Artificial Sequence
  derived and/or modified CDS sequence (wt) from CCHFV(37-R-2013)__KR814858.1__GP
augccuaccaacauuaugcauacgcuauuagugugcuucauucuuuaccuacagcuguugggucuaggaggagcucauagacagucaaacgcaacugaacacaacggaacaaacaccaccacagcacccagcacaagccaaagccccaagccaccugugagcacagccccaccacacgcaccagaaacauccaccaucaaacccaccacaccagcaagcgaaacagaaggcucaggggaaacgaccccacccccaaacaccacccagggcccgucuccaccagaggccacaccagaacgccccgcaacaacugucacaaguacgccaagcacagacaacacgaacuccaccacacacgcgaccgacaacaacccuacaucaacaaucagcacaaguccauccagcagccccagcacgccauccacaccacaaggcauacaucauccugcaaggaaucuauugucagucucgagcccuaagacagcaacaacaccaacaccaacgagcccuggggauauaagcucagaaaccagcagucugcacucagccaugagcagaacaccaacccuccacacagcaacccaggccuccacugaaaaugccaaccacagcgcaccuagacagucugaguccucagcacagcagacaaccacaagcccaaugacuuccccagcacaaccaauccuuguaaugagugcugcuccuacagcuauucagaacauacaucccagcccaacgaauaggucuaagaggaaccuugagauggaaauaauuuuaacucugucucaaggucuaaagaaauacuaugguaagauacugaagcuucugcaccucaccuuggaagaggacacugaaggccuguuagaaugguguaagagaaaccuugggucaaacugugaugaugacuucuuucagaagagaauagaagaauucuucaugaccggugagggcuacuucaaugaagucuuacaauuuaaaacacuaagcacacuaagccccacggagccgucucaugccaggccaccaacaguggaacccuucaaaucuuacuucgcuaagggcuuccuuucaauagauucagguuacuucucugccaaauguuauccaagauuaacuacuucagggcuucagcugaucaaugucacccaacacccagcuagaauagcagaaacaccuggacccaagacaacaagucugaaaaccaucaacuguauaaaccuaagagcaucagucuucaaagaacacagagaaauugagaucaaugugcuccuuccucagauugcagucaaccucucaaauugccauguuguaaucaauucacaugucugugauuauucuuuagacacugaugggccagugaggcuuccucacauuuaccaugaagggacuuucauaccaggaacuuauaaaauagugauagacaaaaaaaauaagcuaaaugaccgauguacacuggucaccaacugugugauaaaaggaagagagguucguaagggccaaucagugcugaggcaguacaaaacagaaaucaagauaggcaaggcaucaacaggcucuaggaaacuacuguccgaggagccaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauaccaucaacagggugaagucauucaagcuaugcgaaaacagcgccacagggaaaaccugugagauagacagcacuccgguuaagugcaggcaagguuuuuguuuaaaaaucacccaagagggaaggggccacguaaaauuaucuagaggcucagagguuguuuuggaugcuugcgacacaagcugcgaaguaaugauaccuaaaggcacuggagauauccugguggacuguucagguggacagcaacauuucuuaaaagacaauuuaauugaccuagggugcccccauaucccgcuauuggguaaaauggccauuuacaucugcagaaugucaaaucauccuagaacaacuauggcuuuucucuucugguucagcuuuggcuaugugaucaccuguauauuuugcaaggcucuuuuuuauucauugauaauuauugggacacuagggaaaaagaucaagcaauauagggaauugaaaccucaaacuuguaccauaugugagacagcuccugucaaugcaauagacgcugaaaugcaugaccuuaacugcaguuacaauauaugcccuuauugugcaucaagauugaccuccgaugggcuagcuaggcaugugccacaaugccccaagcggaaggaaaaaguugaggagacugagcuguacuugaaccuggaaagaauuccuuggauugucagaaagcuauugcaagugucagaguccacugguguggcauugaaacgaagcagcuggcugauuguacugcuuguguuacucacaguuucauugucaccgguucaaucagcaccuguuggucaugguaagacaaucgaaacauaucagaccagagaaggauucacaagugucugucucuuuauguuaggaagcauccuguuuuuagucucuugcuuggugaaggggcugguugacagugucagugacagcuucuuccccggccugucugucuguaagacaugcucuauuggcaguauaaauggcuuugaaauugaaucgcauaaaugcuacuguagccuauuuugcugccccuacuguaggcacugcucugcugacagagaaauucaucaguuacacuugaguaucugcaaaaaaagaaaaauggguagcaaugucaugcuggcugucugcaaacgcaugugcuuuagggcaaccauagaagcaagcagaagagcccugcucauccgaagcauuauaaauaccacuuuuguaauaugcauuuuaacauugacaaucuguguuguuagcaccucugcaguagagauggaaaaccuuccaucaggcacuugggagagagaggaagaccugacaaauuucugucaucaggaaugccagguaaccgagacggagugccucuguccauacgaagcucuugugcucagaaaaccucuguucuuagacaguauaguuaaaggcaugaagaauuugcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguagaugaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaacuugcuugcauaaagaauggccucacucaagaaacuggagauguaaucccacuuggugcuggggaguaggaacuggcugcaccugcugcgggguggauguaaaagaccuuuuuacagaucacauguuugucaaauggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcaugugcaaaaaguguugucugcaaguacaguguguaaacugcagaguugcacacaugguauaccaggagaucuacaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaauaucgaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcauaccaagaaaguugagauaucaggcuuaaaauuugcaagucuggcuugcacggguugcuaugcuuguagcucuggcaucuccuguaaagucaggauucauguagaugagccagaugagcucacaguacauguaaagagcaaugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaauguuacuugcacagccaaggcaagcuguuggcuagagucagucaagaguuuuuuuuauggauugaaaaauaugcuugguaguguauuugguaacuuuuucauaggcauuuuguuauuccuugccccuuuuguccuguuggugcuuuucuuuauguuuggauggaaaaucuuguuuugcuucaaauguugcaggaggaccagaggcuuacuuaaguauagacuccucaaagacgaugaggaaacaggcuacagaaggauuauugaaagacugaacaacaaaaaaggaaaaaacagacugcuugauggugaaagguuggcugauaggaaaauugcugagcuguucuccacaaaaacacacauugguuaa

SEQ ID NO: 3593 - RNA, 5067 nt, Artificial Sequence
  derived and/or modified CDS sequence (wt) from CCHFV(36-ST-2014)__KR814857.1__GP
augcccaucaacauuaugcauacacuauuagugugcuucauucuuuaccuacagcugucggguuuaggaggagcucauggacagucaaacgcaacugaacacaauggaacaaacaccaccacaguacccggcacaagucaaagccccaagccacccgcgagcaccacucuaccacacacaccagaauccuccaccgucaaacucaccacaccaacaagcgaaacagaaggcucaggggaaacgaccccacccccaaacaccacccagggccugcccccaccagggaccacaccagaacgccccgcaacaaccgccacaagcaugucaagcacagacaacaugaauuccaccacacaggugaccgacaacacccccacaucaacagucagcauaaguccauccagcagccccagcaugccauccacaucacaaggcauacauuaucccguaaggagucuauugucagucucgagcccuaagacaguaacaacaccgacaccaaugagcccuggagagaugagcccggaaaccagcagucaacacucagccaugagcagaauaccaacccucuacacagcaacccaggucuccacugagaacaccaaccgcagcacaccuagacaauccgaguccucagcacagccggcaacccaaagcccaacaacuuccccaacgcaaacaauccuucugaugagugcugcuccuaaagcuauucaggacaugcaucccagcccaacaaacagguccaagaggaaccuugagguggaaauaauuuuaacucugucucaaggucuaaagaaguauuacgguaaaauacugaagcuucugcaccuuaccuuggaagaggauacugaaggccuguuagaaugguguaagagaaaccuugggucaaauugugaugaugacuucuuucaaaagagaauagaagaauucuucauaacuggugagggcuacuucaaugaaguccuacaauuuaaaacacuaagcacacuaagccccacggagccgucucaugucaggcuaccaacagcggagcccuucaaaucuuacuucgcuaagggcuuccuuucaauagauucggguuacuucucugccaaauguuauccaagaucauccacuucagggcuucagcugaucaaugucacccaacacccagcuaggauagcagaaacaccuggacccaaaacaacgagucuaaaaaccaucaacuguaucaaccuaagagcaucagucuucaaagaacacagagaaguugagaucaaugugcuucuuccucagauugcagucaaccucucaaacugccauguugugaucaacucacaugucugugauuacucuuuagacacugacgggccagugaggcuuccucgcauucaccaugaagguacuuucauaccaggaacuuauaaaauagugauagacaaaaaaaauaagcuaaaugaccgaugcucgcuagucacuaacugugugauaaagggaagagagguucguaaaggccaaucagugcugaggcaguacaaaacagaaauuaagauaggcaaggcaucaacaggcucuaggaaacuacuguccgaagagccaggugacgacugcauaucaagaacucagcuauugaagacagaaacagcagagauccaugacgacaacuauggugguccaggugacaaaauaacuaucugcaaugguucaaccauuguagaucagagacugggcagugaacuaggguguuauaccaucaacaggguaaagucauucaagcuaugcgaaaacagugccacagggaaaaccugugagauagacagcacuccggucaagugcaggcaagguuuuuguuugaaaaucacccaagaggggaggggccacguaaaauuauccaggggcucagagguuguuuuggaugcuugcgacucgagcugugaaauaaugauaccuaaaggcacuggagauauccuaguagacuguucagguggacagcaacauuucuuaaaagacaacuugauugaccuagggugcccucauaucccgcuauuggguaagauggccauuuacauuugcagaaugucaaaucaucccaggacaaccauggcuuuccucuucugguucaguuuuggcuauguaaucaccuguauauuuugcaaagcucuuuuuuauucauugauaauuauugggacacuaggaaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuagcuaggcaugugacacaaugcccuaagcgaaaggagaaaguugaggagacugaacuguauuugaaccuggaaagaauuccauggauagucagaaagcuguugcaagugucagaguccacugguguggcauugaaacgaagcagcuggcugauugugcugcuuguguuacucacagucucauugucaccgguucaaucagcaccuguuggucaugguaagacaauugaaacauaucagaccagagaaggauucacaaauaucugucucuuuauguuaggaagcauccuauucauaguuucuugccugguaaaggggcugguugacagugucagugacagcuuuuuccccggccugucugucuguaagacaugcucuauuggcaguauaaauggcuuugaaauugaaucgcauaaaugcuacuguaguuuauuuugcugccccuacuguaggcacugcucugcugacagagaaauucaccaguugcacuuggguaucugcaaaaaaagaaaaacggggagcaaugucaugcuggcugucugcaagcgcaugugcuuuaaggcaaccauagaagcaagcagaagagccuugcucauccgaagcauuaucaauaccacuuuuguaauaugcauccuaacauuagcaaucuguguuguuagcacuucugcaguagagauggaaaaucuuccagcaggcacuugggagagagaggaagaccugacaaauuucugccaucaggaaugccagguaagcgagacggaaugccucuguccauacgaagcucuugugcucaggaaaccucuuuucuuagacaguauaguuaaagguaugaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggauuugucacaaauguauuccccuguuuuugaguacuuaucaggagauagacagguugaagaauggcccaaggcaaccugcacaggugauugcccagaaagguguggcugcacaucaucaaccugcuugcauaaagaauggccucacucaagaaacuggagauguaaucccacuuggugcuggggaguaggaaccggcugcacaugcugcggaguggauguaaaagaccuuuuuacagaucacauguuuaucaaauggaagguugaauauauaaaaaccgaagccauaguauguguugagcucaccagccaagaaagacagugcagucugauugaggcagguacuagauucaacuuggguccugugacuaucacccugucugagccaagaaacauucagcagaagcuucccccugagaucauuacgcugcauccuaaaauugaagaaggcuucuuugacuugaugcaugugcaaaaaguguuaucugcaaguacaguguguaaacugcagaguugcacacaugguauaccaggagaucuacaaauuuaccacauuggcaacuuguugaaaggggauagauuaaacgggcaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccauucuaaaagagucacagcacauggagacacaccacaauuagacuuaaaagcaaggccgacuuacggugcaggugagaucacugugcugguugagguugcugacauggaguugcauaccaagaaaguugagauaucaggcuugaaauuugcaagucuggcuugcacggguugcuaugcuuguagcucuggcaucuccuguaaagucagaauucauguagaugaaccggaugagcucacagugcauguaaagagcagugauccagaugugguugcagcuagcacaagccuuauggcaaggaagcuugaauuugggacagauagcacauucaaggcauuuucagcuaugcccaaaaccucuuuaugcuuuuacauuguggagagggaauacugcaagagcugcagugaagaugauacaaaaaaauguguugacacaaaacuugaucagccacagagcauacuaauugagcacaaagggaccauaauuggaaagcagaaugacacuugcacagccaaggcaaguuguuggcuagagucagucaagaguuuuuuuuauggauugaagaauaugcuuggcaguguuuuugguaauuuuuucguaggcauuuuguuauuccuugcccccuuugucuuguuggugcuuuucuuuauguguggauggaaauucuuguuuugcuuuaaguguugcaggaggaccagaggcuuguuuaaguauagacaccucaaagaugaugaggaaacaggcuacagaaggauuauugaaagacugaacagcaaaaaaggaaagaacagacugcuugauggugagagguuggcugauaggaaaauugcugagcuguucucuacaaaaucacacauuggcuaa

SEQ ID NO: 3594 - RNA, 5067 nt, Artificial Sequence
  derived and/or modified CDS sequence (wt) from CCHFV(24-R-2012)__KR814856.1__GP
augccuaccaacauuaugcauacgcuauuagugugcuucauucuuuaccuacagcuguugggucuaggaggagcucauagacagucaaacgcaacugaacacaacggaacaaacaccaccacagcacccagcacaagccaaagccccaagccaccugugagcacagccccaccacacgcaccggaaucauccaccaucaaacccaccacaccagcaagcgaaacagaaggcucaggggaaacgaccccacccccaaacaccacccagggcccgucuccaccagaggccacaccagaacgcaccgcaacaacugccacaaguacgccaagcacagacaacacgaacuccaccacacacgcgaccgacaacaacccuacaucaacaaucagcacaaguccauccagcagccccagcacgccauccacaccacaaggcauacaucauccugcaaggaaucuauugucagucucgagcccuaagacagcaacaacaccaacaccaacgagcccuggggauauaagcucagaaaccagcagucugcacucagccaugagcagaacaccaacccuccacacagcaacccaggccuccacugaaaaugccaaccacagcgcaccuagacagucugaguccucagcacagcagacaaccacaagcccaaugacuuccccagcacaaccaauccuuguaaugagugcugcuccuacagcuauucagaacauacaucccagcccaacgaauaggucuaagaggaaccuugagauggaaauaauuuuaacucugucucaaggucuaaagaaauacuaugguaagauacugaagcuucugcaccucaccuuggaagaggacacugaaggccuguuagaaugguguaagagaaaccuugggucaaacugugaugaugacuucuuucagaagagaauagaagaauucuucaugaccggugagggcuacuucaaugaagucuuacaauuuaaaacacuaagcacacuaagccccacggagccgucucaugccaggccaccaacaguggaacccuucaaaucuuacuucgcuaagggcuuccuuucaauagauucagguuacuucucugccaaauguuauccaagauuaucuacuucagggcuucagcugaucaaugucacccaacacccagcuagaauagcagaaacaccuggacccaagacaacaagucugaaaaccaucaacuguauaaaccuaagagcaucagucuucaaagaacacagagaaauugagaucaaugugcuccuuccucagauugcagucaaccucucaaauugccauguuguaaucaauucacaugucugugauuauucuuuagacacugaugggccagugaggcuuccucacauuuaccaugaagggacuuucauaccaggaacuuauaaaauagugauagacaaaaaaaauaagcuaaaugaccgauguacacuggucaccaacugugugauaaaaggaagagagguucguaagggccaaucagugcugaggcaguacaaaacagaaaucaagauaggcaaggcaucaacaggcucuaggaaacuacuguccgaggagccaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauaccaucaacagggugaagucauucaagcuaugcgaaaacagcgccacagggaaaaccugugagauagacagcacuccgguuaagugcaggcaagguuuuuguuuaaaaaucacccaagagggaaggggccacguaaaauuaucuagaggcucagagguuguuuuggaugcuugcgacacaagcugcgaaguaaugauaccuaaaggcacuggagauauccugguggacuguucagguggacagcaacauuucuuaaaagacaauuuaauugaccuagggugcccccauaucccgcuauuggguaaaauggccauuuacaucugcagaaugucaaaucauccuagaacaacuauggcuuuucucuucugguucagcuuuggcuaugugaucaccuguauauuuugcaaggcucuuuuuuauucauugauaauuauugggacacuagggaaaaagaucaagcaauauagggaauugaaaccucaaacuuguaccauaugugagacagcuccugucaaugcaauagacgcugaaaugcaugaccuuaacugcaguuacaauauaugcccuuauugugcaucaagauugaccuccgaugggcuagcuaggcaugugccacaaugccccaagcggaaggaaaaaguugaggagacugagcuguacuugaaccuggaaagaauuccuuggauugucagaaagcuauugcaagugucagaguccacugguguggcauugaaacgaagcagcuggcugauuguacugcuuguguuacucacaguuucauugucaccgguucaaucagcaccuguuggucaugguaagacaaucgaaacauaucagaccagagaaggauucacaagugucugucucuuuauguuaggaagcauccuguuuuuagucucuugcuuggugaaggggcugguugacagugucagugacagcuucuucccuggccugucugucuguaagacaugcucuauuggcaguauaaauggcuuugaaauugaaucgcauaaaugcuacuguagccuauuuugcugccccuacuguaggcacugcucugcugacagagaaauucaucaguuacacuugaguaucugcaaaaaaagaaaaauggguagcaaugucaugcuggcugucugcaaacgcaugugcuuuagggcaaccauagaagcaagcagaagagcccugcucauccgaagcauuauaaauaccacuuuuguaauaugcauuuuaacauugacaaucuguguuguuagcaccucugcaguagagauggaaaaccuuccaucaggcacuugggagagagaggaagaccugacaaauuucugucaucaggaaugccagguaaccgagacggagugccucuguccauacgaagcucuugugcucagaaaaccucuguucuuagacaguauaguuaaaggcaugaagaauuugcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguagaagaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaacuugcuugcauaaagaauggccucacucaagaaacuggagauguaaucccacuuggugcuggggaguaggaacuggcugcaccugcugcgggguggauguaaaagaccuuuuuacagaucacauguuugucaaauggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcaugugcaaaaaguguugucugcaaguacaguguguaaacugcagaguugcacacaugguauaccaggagaucuacaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaauaucgaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcauaccaagaaaguugagauaucaggcuuaaaauuugcaagucuggcuugcacggguugcuaugcuuguagcucuggcaucuccuguaaagucaggauucauguagaugagccagaugagcucacaguacauguaaagagcaaugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaaugauacuugcacagccaaggcaagcuguuggcuagagucagucaagaguuuuuuuuauggauugaaaaauaugcuugguaguguauuugguaacuuuuucauaggcauuuuguuauuccuugccccuuuuguccuguuggugcuuuucuuuauguuuggauggaaaaucuuguuuugcuucaaauguugcaggaggaccagaggcuuacuuaaguauagacuccucaaagacgaugaggaaacaggcuacagaaggauuauugaaagacugaacaacaaaaaaggaaaaaacagacugcuugauggugaaagguuggcugauaggaaaauugcugagcuguucuccacaaaaacacacauugguuaa

SEQ ID NO: 3595 - RNA, 5064 nt, Artificial Sequence
  derived and/or modified CDS sequence (wt) from CCHFV(Oman-199809166)__KR864901.1__GP
augcccgucaacacuaugcacacacugcuaguguaugcugucuuuugcuugcagcuauggaguccaggaggaacucguggacugucaaaugaaacucaacacaaugaaacagguaucacaagagcaccugaagggagccaaggacccaguuugccuguaagcacagcaucacccaucaugucagaccccuccaucaccacacucucagcgucgaccaguggacuagaaggcucaggggacacgacucccccagccaucacacaaggcccgacccuaccagagaccacgccggaacccuccacaacaaccggcacaaacgcauucagcacagccauugccaaugucaguacacagacagucaaggacacccccacaccgacaguacaaacaaguccaccuagcacucccgacgcaucuaccauaccacagggcacacaucacaccgcaaggggucugcugucagucaccgucacaaagccagaagaaguaccaacaccaacaggcccagaacaagcaagcauagagaccaauagcucacgccuagcaacuagcaagacaccgucccccucuccaacagcucagguuaccacugaaaacagcaacccuaauaccuccagacagcucgugcucucaacacaaccagcaaccucaagcccagugaccucuccagcacagcugaacuucgugcagagugcuacuaccauagccguucaagaugcacacccaagcccaacaaacagguccaagagaaaccuugagauggaaguaauuuugacuuuaucucaagguuuaagaaaguacuacggcagaauacugaaacuucuggaccuuaccuuagaagaagacaccgaaggacugcuggagugguguaagagaaaucuuggucuaaccugugacgauaacuucuuucagaagaggauagaagaguucuucuugacuggugagggucacuucaaugaaguuuuacaguucaaaaccccaagcacacugagcccuacagaaucugcuaguguaggguuaccaacaguugagcccuucaaaucuuacuuugcuaaaggcuuucuuucaauagacucagguuacuucucugccaaguguuauccaagggcgucuaacucagggcuucaguuaaucaaugucacucaacauucagcuagaauagcagacacaccuggaccuaagaucacaaaucugaaaaccaucaauugcauaaaccuaaaggcauuggucuuuaaagagcauagagagauugaaaucaauguucuucucccucaagucgcagucaaucucucaaacugccauguccacaucaaaucgcaugucugugauuauucuuuagacaucgacggaacagucaggcuaccccguauccaccaugaaggaacuuucauaccaggaacuuacaaaauagugauagacaaaaaaaacaaacaaaacgauagaugcaacuugguuaccaauuguguaauaaaaggaagggaagugcguaaaggccagucaguguuaagacaguacagaacagaaaucaggaucggcaaggcaucuucuggcuccagaagacugcuguccgaagagucuggugaagacuguauaucaaggacucagcuguugaggacagaaacugcagaaauccauggugauaacuauggugguccaggugacaaaauaaccaucugcaaugguucaaccauuguagaucaaaggcuggguagugaacugggguguuacacuaucaauagggugaagucauuuaagcuaugcgaaaacagugccacagguaaguccugugaaauagauaacacuccaguaaaaugcaagcaagguuuuugcuugaaaauaacccaagaaggaaggggccacgugaagcuuucaagagacucagaaguuguccuggacgccugcgauucaagcugugaaauaaugauaccaaagggcacuggagacauccugguugacugcucaggugggcagcagcacuucuuaaaagacaaccugauugaucugggaugccccaacaucccauuauuaggcaaaauggcaaucuacauuuguagaaugucaaaucauccuaaaacaacuauggcuuuucuuuuuugguuuagcuuugguuaugugauaaccugcauacuuuguaaagucauuuuuuaucuauugauaguuguuggaacuuuagggaaaaaguuuaaacaguauagagaguuaaaaccucagaccugcacaauaugugaaacaacuccugucaaugcaauagaugcugagaugcacgaucucaauuguaguuacaauauauguccuuauugugcaucuagguuaacuucagauggucuugccagacauguaaugcaguguccuaagcggaaggaaaaaauagaagaaaccgaauuauaccugaacuuagaaagaaucccuuggguugucagaaaacuacugcagguaucagaauccacugguguagcacuaaagaggagcaguuggcugauugugcuacuugugcuucucacaguuucauugucaccaguacaaucagcaccuaucggucaugggaagaccauagaaacguaucaaacuagagaaggguacacaaguauuugucuuuuugugcuaggaagcauuuuguuuauaguuucucaccuaaugaaggggcugguugacaguguugguaacaguuuuuucccuggguuaucuaucugcaagacaugcucuauuggcaguauaaauggcuuugaaauugaaucucacaaauguuacuguagccuauuuuguugccccuacuguagacacugcucugccgauaaagaaauccauaaguugcauuugagcaucugcaaaaaaagaaaagcugggaguaaugucauguuggccgucuguaagcgcauguguuuuagggcaacuauggaagugagcaacaaggcucuacucauccgaagugucaucaacacuacuuuuguuguaugcauacuaauauuagcaguuuguguuguuagcaccuccgcaguagagauggaaagccugccagcuggcacuugggagagagaggaagaccuaacaaacuucugccaucaagaaugccaggucacugaaacugaaugucucugucccuaugaagcucuuguacucagaaagcccuuauuuuuagacaguauugcuaaggguaugaagaaccugcugaauucaacaagcuuagaaacaagcuuaucaauugaggcaccauggggagcaauaaacguccaaucuacuuucaaaccuacugugucaacugcaaacauagcacuuaguuggagcucaguggaacacagagguaauaagaucuugguuucaggcagaucagagucaaucaugaagcuagaagaaagaacaggaaucagcugggauuugggaguagaagaugccucugaguccaaauuacuuacuguuuccgucauggacuuaucacagauguacucuccugucuuugaguaccuaucaggugacagacaaguagaggaauggccaaaggcaaccuguacaggcgauugcccggaaagauguggcugcacaucaucaaccugccuacacaaggaauggccucacucaagaaacuggagaugcaaccccacuugguguuggggagucggcaccggaugcaccuguuguggacuagauguaaaggaccuuuuuacagauuacauguuuguuaaauggaaggucgaauauauaaaaacagaggcuauaguguguguugagcuuacuagccaagaaagacaauguagcuugauugaggcaggcacaagauucaacuuagguccugugacuaucacauuaucagagccaagaaacauucagcaaaagcucccuccagaaauugucacauuacauccuagaauugaagaagguuuuuuugacuuaaugcauguacagaagguacuaucagcaagcacagugugcaagcuacagaguugcacacauggcguaccaggagacuuacaggucuaccacaucggaaacuuacuaaaaggagacaaagugaaugggcaucugauacauaaaguugaaccacauuucaacaccuccuggaugucuugggacggcugugaccuagauuacuacugcaauaugggggauuggcccucuugcacguauacuggaguuacccaacauaaucaugcugcauuuguaaaccuacuuaacauugaaacugauuacacaaagaacuuccacuuucacucuaagagagucacugcacauggggacacuccacaauuagauuuaaaagccagaccaaauuauggugcaggugaaaucacugugcugguggaaguugcugacauggaguuacacacaaagaaaauugagauaucagguuugaaguuugcaagccuaaccugcacagguuguuaugcuuguagcucuggcaucucauguaagguuaggauccauguagaugaaccagaugagcuuacaguacaugugaagagugaagacccagacauaguugcugcuagcucaagucucauggcaagaaagcuugaauucgggacggauaguacauucaaagccuucucagccaugccuaaaaccuccuugugcuuuuacauuguugagagagaauacuguaaaagcugcaguaaagaagacacacaaaaguguguuaacgcaaagcuugagcgaccacagagcauuuuaauugagcacaaaggaacgauaauuggaaagcagaacgacacuugcacagcuaaagcaagcugcuggcuagagucagucaagaguuucuuuuauggacuaaagaacaugcuuaguggcauuuuuggcaauguuuucauagggauuuucuuauuccuugcuccuuuuauccuguuaauacuuuucuuuauguuuggguggagaauccuauucugcuuuaagugcugcaggagaacuagaggccuauuuaaguacagacaccucaaagaugaugaagaaaccgguuauaggaaaaucauugagagacuaaacaacaaaaaagguaaaaacaagcugcuugacggugaaagauuagcugauagaaagaucgcugagcuguucucuacaaaaacacacauuggcuga

SEQ ID NO: 3596 - RNA, 5064 nt, Artificial Sequence
  derived and/or modified CDS sequence (wt) from CCHFV(Oman_812956)__KY362518.1__GP
augcccgucaacacuaugcacacacugcuaguguaugcugucuuuugcuugcagcuauggaguccaggaggaacucguggacugucaaaugaaacucaacacaaugaaacagguaucacaagagcaccugaagggagccaaggacccaguuugccuguaagcacagcaucacccaucaugucagaccccuccaucaccacacucucagcgucgaccaguggacuagaaggcucaggggacacgacucccccagccaucacacaaggcccgacccuaccagagaccacgccggaacccuccacaacaaccggcacaaacgcauucagcacagccauugccaaugucaguacacagacagucaaggacacccccacaccgacaguacaaacaaguccaccuagcacucccgacgcaucuaccauaccacagggcacacaucacaccgcaaggggucugcugucagucaccgucacaaagccagaagaaguaccaacaccaacaggcccagaacaagcaagcauagagaccaauagcccacgccuagcaacuagcaagacaccgucccccucuccaacagcucagguuaccacugaaaacagcaacccuaauaccuccagacagcucgugcucucaacacaaccagcaaccucaagcccagugaccucuccagcacagcugaacuucgugcagagugcuacuaccauagccguucaagaugcacacccaagcccaacaaacagguccaagagaaaccuugagauggaaguaauuuugacuuuaucucaagguuuaagaaaguacuacggcagaauacugaaacuucuggaccuuaccuuagaagaagacaccgaaggacugcuggagugguguaagagaaaucuuggucuaaccugugacgauaacuucuuucagaagaggauagaagaguucuucuugacuggugagggucacuucaaugaaguuuuacaguucaaaaccccaagcacacugagcccuacagaaucugcuaguguaggguuaccaacaguugagcccuucaaaucuuacuuugcuaaaggcuuucuuucaauagacucagguuacuucucugccaaguguuauccaagggcgucuaacucagggcuucaguuaaucaaugucacucaacauucagcuagaauagcagacacaccuggaccuaagaucacaaaucugaaaaccaucaauugcauaaaccuaaaggcauuggucuuuaaagagcauagagagauugaaaucaauguucuucucccucaagucgcagucaaucucucaaacugccauguccacaucaaaucgcaugucugugauuauucuuuagacaucgacggaacagucaggcuaccccguauccaccaugaaggaacuuucauaccaggaacuuacaaaauagugauagacaaaaaaaacaaacaaaacgauagaugcaacuugguuaccaauuguguaauaaaaggaagggaagugcguaaaggccagucaguguuaagacaguacagaacagaaaucaggaucggcaaggcaucuucuggcuccagaagacugcuguccgaagagucuggugaagacuguauaucaaggacucagcuguugaggacagaaacugcagaaauccauggugauaacuauggugguccaggugacaaaauaaccaucugcaaugguucaaccauuguagaucaaaggcuggguagugaacugggguguuacacuaucaauagggugaagucauuuaagcuaugcgaaaacagugccacagguaaguccugugaaauagauaacacuccaguaaaaugcaagcaagguuuuugcuugaaaauaacccaagaaggaaggggccacgugaagcuuucaagagacucagaaguuguccuggacgccugcgauucaagcugugaaauaaugauaccaaagggcacuggagacauccugguugacugcucaggugggcagcagcacuucuuaaaagacaaccugauugaucugggaugccccaacaucccauuauuaggcaaaauggcaaucuacauuuguagaaugucaaaucauccuaaaacaacuauggcuuuucuuuuuugguuuagcuuugguuaugugauaaccugcauacuuuguaaagucauuuuuuaucuauugauaguuguuggaacuuuagggaaaaaguuuaaacaguauagagaguuaaaaccucagaccugcacaauaugugaaacaacuccugucaaugcaauagaugcugagaugcacgaucucaauuguaguuacaauauauguccuuauugugcaucuagguuaacuucagauggucuugccagacauguaaugcaguguccuaagcggaaggaaaaaauagaagaaaccgaauuauaccugaacuuagaaagaaucccuuggguugucagaaaacuacugcagguaucagaauccacugguguagcacuaaagaggagcaguuggcugauugugcuacuugugcuucucacaguuucauugucaccaguacaaucagcaccuaucggucaugggaagaccauagaaacguaucaaacuagagaaggguacacaaguauuugucuuuuugugcuaggaagcauuuuguuuauaguuucucaccuaaugaaggggcugguugacaguguugguaacaguuuuuucccuggguuaucuaucugcaagacaugcucuauuggcaguauaaauggcuuugaaauugaaucucacaaauguuacuguagccuauuuuguugccccuacuguagacacugcucugccgauaaagaaauccauaaguugcauuugagcaucugcaaaaaaagaaaagcugggaguaaugucauguuggccgucuguaagcgcauguguuuuagggcaacuauggaagugagcaacaaggcucuacucauccgaagugucaucaacacuacuuuuguuguaugcauacuaauauuagcaguuuguguuguuagcaccuccgcaguagagauggaaagccugccagcuggcacuugggagagagaggaagaccuaacaaacuucugccaucaagaaugccaggucacugaaacugaaugucucugucccuaugaagcucuuguacucagaaagcccuuauuuuuugacaguauugcuaaggguaugaagaaccugcugaauucaacaagcuuagaaacaagcuuaucaauugaggcaccauggggagcaauaaacguccaaucuacuuucaaaccuacugugucaacugcaaacauagcacuuaguuggagcucaguggaacacagagguaauaagaucuugguuucaggcagaucagagucaaucaugaagcuagaagaaagaacaggaaucagcugggauuugggaguagaagaugccucugaguccaaauuacuuacuguuuccgucauggacuuaucacagauguacucuccugucuuugaguaccuaucaggugacagacaaguagaggaauggccaaaggcaaccuguacaggcgauugcccggaaagauguggcugcacaucaucaaccugccuacacaaggaauggccucacucaagaaacuggagaugcaaccccacuugguguuggggagucggcaccggaugcaccuguuguggacuagauguaaaggaccuuuuuacagauuacauguuuguuaaauggaaggucgaauauauaaaaacagaggcuauaguguguguugagcuuacuagccaagaaagacaauguagcuugauugaggcaggcacaagauucaacuuagguccugugacuaucacauuaucagagccaagaaacauucagcaaaagcucccuccagaaauugucacauuacauccuagaauugaagaagguuuuuuugacuuaaugcauguacagaagguacuaucagcaagcacagugugcaagcuacagaguugcacacauggcguaccaggagacuuacaggucuaccacaucggaaacuuacuaaaaggagacaaagugaaugggcaucugauacauaaaguugaaccacauuucaacaccuccuggaugucuugggacggcugugaccuagauuacuacugcaauaugggggauuggcccucuugcacguauacuggaguuacccaacauaaucaugcugcauuuguaaaccuacuuaacauugaaacugauuacacaaagaacuuccacuuucacucuaagagagucacugcacauggggacacuccacaauuagauuuaaaagccagaccaaauuauggugcaggugaaaucacugugcugguggaaguugcugacauggaguuacacacaaagaaaauugagauaucagguuugaaguuugcaagccuaaccugcacagguuguuaugcuuguagcucuggcaucucauguaagguuaggauccauguagaugaaccagaugagcuuacaguacaugugaagagugaagacccagacauaguugcugcuagcucaagucucauggcaagaaagcuugaauucgggacggauaguacauucaaagccuucucagccaugccuaaaaccuccuugugcuuuuacauuguugagagagaauacuguaaaagcugcaguaaagaagacacacaaaaguguguuaacgcaaagcuugagcgaccacagagcauuuuaauugagcacaaaggaacgauaauuggaaagcagaacgacacuugcacagcuaaagcaagcugcuggcuagagucagucaagaguuucuuuuauggacuaaagaacaugcuuaguggcauuuuuggcaauguuuucauagggauuuucuuauuccuugcuccuuuuauccuguuaauacuuuucuuuauguuuggguggagaauccuauucugcuuuaagugcugcaggagaacuagaggccuauuuaaguacagacaccucaaagaugaugaagaaaccgguuauaggaaaaucauugagagacuaaacaacaaaaaagguaaaaacaagcugcuugacggugaaagauuagcugauagaaagaucgcugagcuguucucuacaaaaacacacauuggcuga

SEQ ID NO: 3597 - RNA, 5064 nt, Artificial Sequence
  derived and/or modified CDS sequence (wt) from CCHFV(Oman)__DQ211632.1__GP
augcccgucaacacuaugcacacacugcuaguguaugcugucuuuugcuugcagcuauggaguccaggaggaacucguggacugucaaaugaaacucaacacaaugaaacagguaucacaagagcaccugaagggagccaaggacccaguuugccuguaagcacagcaucacccaucaugucagaccccuccaucaccacacccucagcgucgaccaguggacuagaaggcucaggggacacgacucccccagccaucacacaaggcccgaccccaccagagaccacgccggaacccuccacaacaaccggcacaaacgcauucagcacagccauugccaaugucaguacacagacagucaaggacacccccacaccgacaguccaaacaaguccaccuagcacucccgacgcaucuaccauaccacagggcacacaucacaccgcaaggggucugcugucagucaccgucacaaagccagaagaaguaccaacaccaacaggcccagaacaagcaagcauagagaccaauagcccacgccuagcaacuagcaagacaccgucccccucuccaacagcucagguuaccacugaaaacagcaacccuaauaccuccagacagcucgugcucucaacacaaccagcaaccucaagcccagugaccucuccagcacagcugaucuucgugcagagugcuacuaccguagccguucaagaugcacacccaagcccaacaaacagguccaaaagaaaccuugagauggaaguaauuuugacuuuaucucaagguuuaagaaaguacuacggcagaauacugaaacuucuggaccuuaccuuagaagaagacaccgaaggacugcuggagugguguaagagaaaucuuggucuaaccugugacgauaacuucuuucagaagaggauagaagaguucuucuugacuggugagggucacuucaaugaaguuuuacaguucaaaaccccaagcacacugagcucuacagaaucugcuaguguaggguuaccaacaguugagcccuucaaaucuuacuuugcuaaaggcuuucuuucaauagacucagguuacuucucugccaaguguuauccaagggcgucuaacucagggcuucaguuaaucaaugucacucaacauucagcuagaauagcagacacaccuggaccuaagaucacaaaucugaaaaccaucaauugcauaaaccuaaaggcauuggucuuuaaagagcauagagagauugaaaucaauguucuucucccucaagucgcagucaaucucucaaacugccauguccacaucaaaucgcaugucugugauuauucuuuagacaucgacggaacaguuaggcuaccccguauccaccaugaaggaacuuucauaccaggaacuuacaaaauagugauagacaaaaaaaacaaacaaaacgauagaugcaacuugguuaccaauuguguaauaaaaggaagggaagugcguaaaggccagucaguguuaagacaguacagaacagaaaucaggaucggcaaggcaucuucuggcuccagaagacugcuguccgaagagucuggugaagacuguauaucaaggacucagcuauugaggacagaaacugcagaaauccauggugauaacuauggugguccaggugacaaaauaaccaucugcaaugguucaaccauuguagaucaaaggcuggguagugaacugggguguuacacuaucaauagggugaagucauuuaagcuaugcgaaaacagugccacagguaaguccugugaaauagauaacacuccaguaaaaugcaagcaagguuuuugcuugaaaauaacccaagaaggaaggggccacgugaagcuuucaagagacucagaaguuguccuggacgccugcgauucaagcugugaaauaaugauaccaaagggcacuggagacauccugguugacugcucaggugggcagcagcacuucuuaaaagacaaccugauugaucugggaugccccaacaucccauuauuaggcaaaauggcaaucuacauuuguagaaugucaaaucauccuaaaacaacuauggcuuuucuuuuuugguuuagcuuugguuaugugauaaccugcauacuuuguaaagucauuuuuuaucuauugauaguuguuggaacuuuagggaaaaaguuuaaacaguauagagaguuaaaaccucagaccugcacaauaugugaaacaacuccugucaaugcaauagaugcugagaugcacgaucucaauuguaguuacaauauauguccuuauugugcaucuagguuaacuucagauggucuugccagacauguaaugcaguguccuaagcggaaggaaaaaauagaagaaaccgaauuauaccugaacuuagaaagaaucccuuggguugucagaaaacuacugcaggugucagaauccacugguguagcacuaaagaggagcaguuggcugauugugcuacuugugcuucucacaguuucauugucaccaguacaaucagcaccuaucggucaugggaagaccauagaaacguaucaaacuagagaaggguacacaaguauuugucuuuuugugcuaggaagcauuuuguuuauaguuucucaccuaaugaaggggcugguugacaguguugguaacaguuuuuuuccuggguuaucuaucugcaagacaugcucuauuggcaguauaaauggcuuugaaauugaaucucacaaauguuucuguagccuauuuuguugccccuacuguagacacugcucugccgauaaagaaauccauaaguugcauuugagcaucugcaaaaaaagaaaagcugggaguaaugucauguuggccgucuguaagcgcauguguuuuagggcaacuauggaagugagcaacaaggcucuacucauccgaagugucaucaacacuacuuuuguuguaugcauacuaauauuagcaguuuguguuguuagcaccucugcaguagagauggaaagccugccagcuggcacuugggagagagaggaagaccuaacaaacuucugccaucaagaaugccaggucacugaaacugaaugucucugucccuaugaagcucuuguacucagaaagcccuuauuuuuagacaguauugcuaagggcaugaagaaccugcugaauucaacaagcuuagaaacaagcuuaucaauugaggcaccauggggagcaauaaacguucaaucuacuuucaaaccuacugugucaacugcaaacauagcacuuaguuggagcucaguggaacacagagguaauaagaucuugguuucaggcagaucagagucaaucaugaagcuagaagaaagaacaggaaucagcugggauuugggaguagaagaugccucugaguccaaauuacuuacuguuuccgucauggacuuaucacagauguacucuccugucuuugaguaccuaucaggugacagacaaguagaggaauggccaaaggcaaccuguacaggcgauugcccggaaagauguggcugcacaucaucaaccugccuacacaaggaauggccucacucaagaaacuggagaugcaaccccacuugguguuggggagucggcaccggaugcaccuguuguggacuagauguaaaggaccuuuuuacagauuacauguuuguuaaauggaaggucgaauauauaaaaacagaggcuauaguguguguugagcuuacuagccaagaaagacaauguagcuugauugaggcaggcacaagauucaacuuagguccugugacuaucacauuaucagagccaagaaacauucagcaaaagcucccuccagaaauugucacauuacauccuagaauugaagaagguuuuuuugacuuaaugcauguacagaagguacuaucagcaagcacagugugcaagcuacagaguugcacacauggcguaccaggagacuuacaggucuaccacaucggaaacuuacuaaaaggagacaaagugaacgggcaucugauacauaaaguugaaccacauuucaacaccuccuggaugucuugggacggcugugaccuagauuacuacugcaauaugggggauuggcccucuugcacguauacuggaguuacccaacauaaucaugcugcauuuguaaaccuacuuaacauugaaacugauuacacaaagaacuuccacuuucacucuaagagagucacugcacauggggacacuccacaauuagauuuaaaagccagaccaaauuauggugcaggugaggucacugugcugguggaaguugcugacauggaguuacacacaaagaaaauugagauaucagguuugaaguuugcaagccuaacuugcacagguuguuaugcuuguagcucuggcaucucauguaagguuaggauccauguagaugaaccagaugagcuuacaguacaugugaagagugaagacccagacauaguugcugcuagcucaagucucauggcaagaaagcuugaauucgggacggauaguacauucaaagccuucucagccaugccuaaaaccuccuugugcuuuuacauuguugagagagaauacuguaaaagcugcaguaaagaagacacacaaaaguguguuaacgcaaagcuugagcgaccacagagcauuuuaauugagcacaaaggaacgauaauuggaaagcagaacgacacuugcacagcuaaagcaagcugcuggcuagagucagucaagaguuucuuuuauggacuaaagaacaugcuuaguggcauuuuuggcaauguuuucauagggauuuucuuauuccuugcuccuuuuauccuguuaauacuuuucuuuauguuuggguggagaauccuauucugcuuuaagugcugcaggagaacuagaggccuauuuaaguacagacaccucaaagaugaugaagaaaccgguuauaggaaaaucauugagagacuaaacaacaaaaaagguaaaaacaagcugcuugacggugaaagauuagcugauagaaagaucgcugagcuguucucuacaaaaacacacauuggcuga

SEQ ID NO: 3598 - RNA, 5064 nt, Artificial Sequence
  derived and/or modified CDS sequence (wt) from CCHFV(3820-ST-2007)__KR814868.1__GP
augcccaucaacauuaugcauacacuauuagugugcuucauucuuuaccuacagcugucggguuuaggaggagcucauggacagucaaacgcaacugaacacaauggaacaaacaccaccacaguacccggcacaagucaaagccccaagccacccgcgagcaccacucuaccacacacaccagaauccuccaccgucaaacucaccacaccaacaagcgaaacagaaggcucaggggaaacgacccccccaaacaccacccagggccugccccuaccagggaccacaccagaacgcuccgcaacaaccgccacaagcacgucaagcacagacaacaugaauuccaccacacaggugaccgauaacacccccacaucaacagucagcauaaguccauccagcagcuccagcaugccauccacaucacaaggcauacaucaucccguaaggagucuauugucagucucgagcccuaagacaguaacaacaccgacaccaaugagcccuggagagaugagcccggaaaccagcagucagcacucagccaugagcagaguaccaacccucuacacagcaacccagaucuccacugagaacaccgaccgcagcacaccuagacaaucugaguccucaguacagccggcaacccaaagcccaauaacuuccccagcgcaaacaauccuucugaugagugcugcuccuaaagcuauucaggacaugcaucccagcccaacaaacagguccaagaggaaccuugagguggaaauaauuuuaacucugucucaaggucuaaagaaauauuacgguaaaauacugaagcuucugcaccuuaccuuggaagaggauacugaaggccuguuagaaugguguaagagaaaccuugggucaaauugugaugaugacuucuuucaaaagagaauagaagaauucuucauaacuggugagggcuacuucaaugaaguccuacaauuuaaaacacuaagcacacuaagccccacggagccgucucaugucaggcuaccaacagcggagcccuucaaaucuuacuucgcuaagggcuuccuuucaauagauucggguuacuucucugccaaauguuauccaagaucauccacuucagggcuucagcugaucaaugucacccaacacccagcuaggauagcagaaacaccuggacccaaaacaacgagucugaaaaccaucaacuguaucaaccuaagagcaucagucuucaaagaacacagagaaguugagaucaaugugcuucuuccucagauugcagucaaccucucaaacugccauguugugaucaacucacaugucugugauuacucuuuagacacugacgggccagugaggcuuccucgcauucaccaugaagguacuuucauaccaggaacuuauaaaauagugauagacagaaaaaauaagcuaaaugaccgaugcucgcuagucacuaacugugugauaaagggaagagagguucguaagggccaaucagugcugaggcaguacaaaacagaaauuaagauaggcaagacaucaacaggcucuaggaaacuacuguccgaagagccaggugacgacugcauaucaagaacucagcuauugaagacagaaacagcagagauccaugacgacaacuaugguaguccaggugacaaaaucacuaucugcaaugguucaaccauuguagaucagagacugggcagugaacuaggguguuauaccaucaacagggugaagucauucaagcuaugcgaaaacagugccacagggaaaaccugugagauagacagcacuccggucaagugcaggcaagguuuuuguuugaaaaucacccaagagggaaggggccacguaaaauuauccaggggcucagagguuguuuuggaugcuugcgacucgagcugugaaauaaugauaccuaaaggcacuggagauauccuaguagacuguucagguggacagcaacauuucuuaaaagacaacuugauugaccuagggugcccucauaucccgcuauuggguaaaauggccauuuacauuugcagaaugucaaaucaucccaggacaaccauggcuuuccucuucugguucaguuuuggcuauguaaucaccuguauauuuugcaaggcucuuuuuuauucacugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuggcuaggcaugugacacaaugcccuaagcgaaaggagaaaguugaggagacugaacuguauuugaaccuggaaagaauuccuuggauagucagaaagcuauugcaagugucagaguccacugguguggcauugaaacgaagcaguuggcugauugugcugcuuguguuacucgcagucucauugucaccgguccaaucagcaccuguuggucaugguaagacaaucgaaacauaucagaccagagagggauucacaagcaucugucucuuuauguuaggaagcauccuauucauaguuucuugccugguaaaggggcugguugacagugucagugacagcuucuuccccggccugucugucuguaagacaugcucuauuggcaguauaaauggcuuugaaauugaaucgcauaaaugcuacuguaguuuauuuugcugccccuacuguaggcacugcucugcugacagagaaauucaccaguugcacuugaguaucugcaaaaaaagaaaaacggggagcaaugucaugcuggcugucugcaagcgcaugugcuuuaaggcaaccauagaagcaagcagaagagcccugcucauccgaagcauuaucaauaccacuuuuguaaugugcauucuaacauuagcaaucuguguuguuagcaccucugcaguagagauggaagaccuuccagcaggcacuugggagagagaggaagaccuaacaaauuucugccaucaggaaugccaggugaccgagacggaaugccucuguccauacgaagcucuugugcucaggaaaccccuuuucuuagacaguauaguuaaagguaugaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaccuaggcguagaagaugccucugaauccaaauuacuuaccgucucuaucauggauuugucacaaauguauuccccuguuuuugaguacuuaucaggagauagacagguugaagaauggcccaaggcaaccugcacaggugauugcccagaaagguguggcugcacaucaucaaccugcuugcauaaagaauggccucauucaagaaacuggagauguaaucccacuuggugcuggggaguaggaaccggcugcacaugcugcggaguggauguaaaagaccuuuuuacagaccacauguuuaucaaauggaagguugaauauauaaaaaccgaagccauaguauguguugagcucaccagccaagaaagacagugcagucugauugaggcagguacuagauucaacuuggguccugugacuaucacccugucugagccaagaaacauucagcagaagcuucccccugagaucauuacgcugcaucccaaaauugaagaaggcuucuuugacuugaugcaugugcaaaaaguguuaucugcaaguacaguguguaaacugcagaguugcacacaugguauaccaggagaucuacaaauuuaccacauuggcaacuuguugaaaggggauagaguaaacggccaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaaaaaaguugagauaucaggcuugaaauuugcaagucugacuuguacggguugcuaugcuuguagcucuggcaucuccuguaaagucagaauucauguagaugaaccagaugagcucacagugcauguaaagagcagugauccagaugugguugcagcuagcacaagccuuauggcaaggaagcuugaauuugggacagauagcacauucaaggcauuuucagcuaugcccaaaaccucuuuaugcuuuuacauuguggagagggaauacugcaagagcugcagugaagaugauacaaaaaaauguguugacacaaaacuugagcagccacagagcauacuaauugagcacaaagggacgauaauuggaaagcagaaugauacuugcacagccaaggcaaguuguuggcuagagucagucaagaguuuuuuuuauggauugaagaauaugcuuggcaguguuuuugguaguuuuuucguaggcauuuuguuauuccuugccccuuucgucuuguuggugcuuuucuuuauguuuggauggaaaaucuuguuuugcuuuaaguguugcaggaggaccagaggcuuguuuaaguauagacaccucaaagaugacgaggaaacaggcuacagaaggauuauugaaagacugaacagcaaaaaaggaaaaaacagacugcuugauggugagagguuggcugauaggaaaauugcugagcuguucucuacaaaaacacacauuggcuaa

SEQ ID NO: 3599 - RNA, 5058 nt, Artificial Sequence
  derived and/or modified CDS sequence (wt) from CCHFV(SR3)__AJ538199.1__GP
augcauauaucauugauguaugcaguuuucugcuugcaacugugcggucuagggaagacuaacggaccacacaaugggacugaacacaauaauacacacguuaugacaacgccugaugacagucagagcccugaaccgccagugagcacagccuuaccugucacaccggacccuucaacugucacaccuucaacaccagccagcggauuagaaggcucaggagagguuuacacauccucuccaaucaccaccaaggguuugucucugccggaggccacaucugagcccccugcgacuaccagcguggucacuucaagugcaagugauaccgauucuagcacacaggcagccggagacacccccacaccaacaguccgcacgagucugcccagcagcccuagcacaccauccacaucacaaggcacacacuaucccgugaggagucugcuuucagucacgagcccuaagccagaagaaacaccaacaccgucaaaaucaggcaaagaugacuuagcaaccaacagcccccacccagccaccagcagaccaacaaccccucccacaacagcccagaaacccacugaaaacaacagccacaacaccaccgaacagcuugaguccuuaacacacuuagcaacuuuagguuuaaugaucucuccaacacagacaguccucccacagaguguuaccucuauagccauucaagacauucauaacagcccaacaaauaggucuaaaagaaaccuugauauggaaauaaucuuaacguuaucucagggucugaaaaaguauuauggcaaaauacuuaagcuccugcaucucaccuuagaagaagacacugaaggcuuguuagaguggugcaagagaaaucucggucuugacugugaugacaccuucuuccaaaaaagaaucgaagaauucuucauaacuggugagggucauuucaaugaaguuuuacaauuuagaacacuaggcacauugaguaccacagagucaacgcaugcuggaucaccgacaguugaacccuucaaauccuacuuugcuaaagguuuccuuucaauagauucagguuauuucucugccaaauguuauucaagaacauccaauucagggcuccaauugauuaauguuacccgacauucaacuaggauagcugacacgccugggcccaagaucacuaaccugaagaccaucaauugcaugaacuuaaaagcauccgucuuuaaagaacauagagagguugaaaucaaugugcuucucccucaaguagcagucaaccucucaaacugucauguugcaaucaaaucacauaucugugacuauucuuuagacaccgacggggcgauuaggcuuccucaaauucaucaugaaggcacuuuuaucccagguacuuacaaaauagugauagacaaaaaaaguaggcugaaugacagguguacccuauucaccaacugugugauaaaaggaagagaaguucguaaaggccagucaguccuaaggcaauacaagacagaaauuagaauuggcagggcaucaacugguucuaggagauugcuuuccgaagaaucuggugaugacugcauaucaagaacucagcuauugaggacagagacugcagagguccauggcgacaacuacggugguccaggugauaagauaaccaucuguaaugguucaacuguuguagaucaaagacuggguagugaacuaggguguuacacuaucaauagagugaggucauucaagcuaugcgaaaacagugccacagggaagagcugugaaauagacaguaucccagucaaguguaagcaggguuauugccuuaaaaucacucaggaaggaaggggccaugugaaguuaucuagaggcucagaaguugucuuggauguaugugauucaagcugugaagugaugauaccuaagggcacuggugacauucuaguagauuguucaggugggcagcaacauuuuuuaaaagacaaccugguugaccuagggugucccaaaauuccguuacugggcaaaauggcuauuuauaucugcaggaugucgaaucaccccaagacaaccauggccuuccucuuuugguucagcuuuggcuaugugauaacuuguauacuuugcaaggccauuuuuuucuuauuaauaauuuuuggaacacuagggaaaagguucaagcaguacagagaguugaaaccccagaccugcaccauaugugagacaacaccuguaaaugcaauagaugcugaaaugcaugaucucaacugcaguuacaauauaugucccuauugugcgucuagacugacuucagaugggcuugcuaggcauguaacacaauguccuagacggaaggagaaaguggaggaaaccgaauuauaccugaauuuagagagaauucccuggguuguaagaaagcuauugcaggugucagaguccacugguacaguauuaaaaaggagcagcuggcuaauuguauuacuugugcuguucacaguuucauugucaccaguucaaucagcacccauuggucacgggaaaacaauugaaacauaccggguuagggaagaauacacaaguauuugccucuuuguacuagggaguauccuguuuauagucucuuuucuaaugaaaggacugguugacgguguuggcaacaucuucuuuccugggcuguccgucuguaagacaugcucuauagguagcauuaauggcuuugaaauugagucucauaagugcuacuguagcuuguuuuguugcccuuacuguaggcacugcucugcugauggagaaauccaucagcugcacuugagcaucugcaaaaaaaggaagacaggaaguaauguuaugcuggcuguuugcaaacgcauguguuucagggcaacuauggaaguaagcaacaaagcccuauuuauccguagcaucaucaacaccacuuuuguuaugugcauacugaagggcgaauucgcggccguuaaaucaauucacccuauagagauggaaagccuaccagcugggaccugggaaagagaagaagaccuaacaaauuucugccaucaggaaugccagguuacagagacugagugccucugcccuuaugaagcucuagugcucagaaggccccuauuucuagauaguauagucaaagguaugaaaaaucugcuaaacucaacaagucuagaaacaagcuuaucaauugaggcaccguggggagcaaucaauguucagucaaccuacaaaccaacugucucaacugcaaacauagcacuuaguuggagcucaguggaacacagaggcaauaagguuuuggucucaggcagaucagaaucaauuaugaagcuggaagaaaggacaggaaucagcugggaucuuggcguggaagaugccucugagucuaagcuacuuacaguuucaguuauggacuugucucagauguacucuccugucuucgaguacuuaucaggugacagacaaguggaagaguggccuaaagcaaccugcacaggugacugcccagaaagauguggcugcacaucaucaaccugcuuacacaaagaguggccccacucaaggaauuggagauguaauccuacuuggugcugggguguagggacuggcugcaccuguugugguuuagaugugaaagaccuuuucacagauuacauguucgucaaguggaaaguugaguacauuaagacagaggccauaguauguguagaacuaaccagucaggaaagacaguguagcuugauugaggcgggcacaagauucaauuuagguucugugacuauuacauugucagaaccaaggaacauucaacaaaagcucccuccugaaauaaucacacugcaccccaagauugaggaagguuuuuuugaccuaaugcauguacaaaaagugcuaucggcaagcacaguguguaaguugcagaguugcacacauggugugccaggagaucugcaggucuaccacaucggaaaccuauuaaaaggggacagaguaaacggacaccugauucauaaaauugagcaacacuucaacacauccuggaugucuugggaugguugugaccuagacuacuacuguaacaugggagacuggccuuccugcacauauaccggagucacucagcauaaccaugcuucauuuguaaaccugcucaacauugaaacugauuauacaaaaaccuuucacuuucacucuaaaaggguuacugcacauggagacacaccacaacuagaucugaaggcaaggccaaccuauggugcaggugagaucaccgugcugguggaaguugcugacauggaguuacacacaaagaagauugaaauaucaggcuuaaaauuugcaggccuaacuugcacagguuguuaugcuuguaguucuggcaucucuuguaaaguuagaauucauguagaugaaccagaugaacuuacaguacauguuaaaagugaugacccagauguaguugcagcuagcucaagucucauggcgaggaagcuugaauuuggaacagacaguacauuuaaagcuuucucagccaugccuaaaaccucccuauguuucuacauuguggaaagggaauacuguaaaagcugcaauaaagaagauacacaaaaauguguuaacacgaaacucgaacaaccacagagcauuuugaucgaacauaagggaacuauaauuggaaagcaaaacaauacuugcacggcuaaagcgaguugcugguuagagucaguuaagaguuucuuuuauggucugaagaauaugcucgguggcauauuuggcaauguuuuuauaggcauuuucacauuucuuacccccuuuaucuuguuaauacuuuucuuuauguuuggguggaggauccuguuuugcuucaaguguugcagaaggaccagaggccuauucaaguacagacaccucaaagacgaugaagaaacugguuacagaaagaucauugaaagacugaacaacaaaaaaggaaaaaacaggcugcuugauggugaaagacuugcugacagaaagauugcugaacuguucuccacaaaaacacacauuggcuag

SEQ ID NO: 3600 - RNA, 5055 nt, Artificial Sequence
  derived and/or modified CDS sequence (wt) from CCHFV(SPU 187/90)__KJ682814.1__GP
augcauauaucauuaauguaugcaguccuuugccuacagcuguguagucugggagaaacucauagaucacacaaugaaauuggacacaauaaaacagacguuaugacaacgcccggugauaaccugagcucugaacagccagugagcacggccuugucuaucacaccugaccccuccacuguuacacccacaacaccagccaguggaucagaaggcucaggggaaguuuacacauccucuccgaucaccaccgagagcuugucccugccagaaaccacaccggagcucccugcuacaacugguauagacucuucaagugcaaguggugucgauucuaguacgcaagcagccggaggcaccuccgcacuaacaguccgcacaagucugcccaacagcccuagcacaccaucuacaccacaagacacauaccauccugugagaauucuacuuucagucacgggcccugggccagaagaaacaucaacaccuucgggaucaggcaaagagagcucagcaacuaguagccuucauccaaucuccgacagacuaccaaccccucccgcaacagcucagggaccuacugaaaauaacagucacaacgccacugaacaccccaagccccugacacagucagcaaccccaggccuaaugaccucuccaacacagauaguccacccacaaagugccaccuccauaaccguucaagacacauaccccaguccaaagaacaggucuaaaagaaaccuugagauggaaauaaucuugacuuugucucagggcuuaaaaaaauacuauggcaaaauauuaaggcuucugcgucucaccuuagaggaggacacugaaggucuacuggaaugguguaagagaaaucuuggucuugauugugaugacacuuucuuucaaaagagaauugaggaauucuucauaacuggugagggccauuuuaaugaaguucuacaauuuaaaacgccaggcacguugaguacuacagagucaacaccugcugagcugccaacagcugaaccuuuuaaguccuacuucgccaaaggcuuccuuucaauagauucagguuacuauucagccaaauguuacucaggaacaucuaauucagggcuucaauugauuaauauuacccgacauucaacuagaauaguugacacaccugggccuaagaucacuaauuuaaagaccaucaacugcauaaacuuaaaggcaucgaucuucaaagaacauagagagguugaaaucaaugugcuucucccucaaauugcaguuaaucucucaaacugucacguuguaaucaaaucacaugucugugacuauucuuuagacauugacgguacggugaggcuuccucacauuuaccaugaaggaguuuucauuccaggaacuuacaaaauagugauagauaaaaaaaauaaguugaaugacagaugcaccuuauuuaccaacugugugauaaaaggaagggagguucguaagggucagucaguuuugaggcaguacaagacggaaaucaggauuggcaaagcaucaaccggcucuagaagacugcuuuccgaagaaccuagugaugacugcauaucgagaacucaacuauugaggacagagacugcagagauccacggcgacaacuaugguggcccgggugacaaaauaaccaucugcaacggcucaacuauuguagaccaaagacugggcagugagcuaggguguuacacuaucaauagagugaagucauucaagcuaugcgaaaauagugccacagggaagagcugugaaauagacagugucccaguuaaaugcaggcaggguuauugccuaagaaucacucaggaagggaggggccauguaaaauuaucuaggggcucagagguugucuuagaugcaugcgauacaagcugugaaauaaugauaccuaagggcacuggugacauccuaguugacuguucaggugggcagcaacauuuucuaaaggacaauuugauagaucuaggaugccccaaaauuccauuauugggcaaaauggcuauuuacauuugcagaaugucgaaucaccccaaaacaaccauggcuuuccuuuucugguucagcuuuggcuacguaauaacuuguauacuuugcaaggccaucuuuuacuuguuaauaauuauuggaacgcuagggaagagguucaagcaguauagagaguuaaaaccucagaccugcaccauaugugagacaacuccuguaaaugcaauagaugcugagaugcaugaccucaacugcaguuacaacauuugucccuacugugcaucuagacuaaccucagaugggcuugcuaggcaugugacacaaugcccuaagcggaaggagaaaguggaagaaacugaacuauacuugaacuuagaaagaauuccuuggguuguaagaaagcuguugcagguaucagaguccacugguguggcauugaaaagaagcagcuggcugauugugcugcuugugcuguucacgguuucauugucaccaguucaaucagcacccauuggucacgggaagacaauugaggcauaccgggccagggagggauacacaaguauaugucucuuuguacuaggaaguauccuauuuguagucucuugccuaaugaaagggcugguugacaguguuggcaacuccuucuucccuggacuguccauuugcaaaacgugcuccauaggcagcauuaauggcuuugaaauugagucccauaagugcuauugcagcuuauucuguugcccuuauuguaggcacugcucugcugauaaagaaauucauaagcugcacuugagcaucugcaaaaaaagaaaaacaggaaguaaugucauguuggcugucugcaagcgcauguguuucagggccaccauggaaguaaguaacagagcccuguuuauccguagcaucaucaacaccacuuuuguuuuauguauacugauacuagcaguuuguguuguuaguaccucagcaguggagauggaaaaccuaccagccgggaccugggaaagagaagaggaccuaacaaauuucugucaucaggaaugccagguuacagagacugaaugccucugcccuuaugaagcucuaguacucagaaggccucuauuccuagauaguauaguuaaagguaugaaaaaucugcuaaauucaacaaguuuagaaacaaguuuaucaauugaggcaccauggggggcaauaaauguucagucaaccuacaaaccaacugugucaacugcaaacauagcacucaguuggagcucuguggaacacagaggcaauaagaucuugguuucaggcagaucagaaucaauuaugaagcuggaagaaaggacaggaaucagcugggaccucggcguggaagacgccucugagucuaaacugcuuacagucucugucauggacuugucucagauguacucuccugucuucgaguacuuaucaggagacagacagguggaagaguggcccaaggcaacuuguacaggugacugcccagaaagauguggcugcacaucaucaacauguuuacacaaagaauggccccacucaagaaauuggaggugcaaucccacuuggugcugggguguagggacuggcugcaccuguuguggauuagaugugaaggaccuuuuuacagauuauauguuugucaaguggaaaguugaauauauuaagacagaagccauaguguguguagaacuuaccagucaggaaaggcaguguagcuugauugaagcaggcacaagguucaauuuagguccuguaaccaucacacugucagaaccacgaaacauccaacagaagcucccuccugaaauaaucacacugcaucccaggaucgaagaagguuuuuuugaccugaugcauguacagaaaguguuaucggcaagcacaguguguaaguugcagaguugcacacauggugugccaggagaccuacaggucuaccacaucgggaauuuauuaaaaggggauaaggugaauggacaucuaauucauaaaauugagccacacuucaacacuuccuggauguccugggaugguugugaccuagacuacuacugcaacaugggagauuggccuucuugcacauacacaggagucacccaacacaaucaugcuucauuuguaaaccugcucaacauugaaacugauuacacaaaaaacuuccacuuucacucuaaaagggucacugcacacggagacacaccacaacuagaucuuaaggcaagaccaaccuauggugcaggugagaucacuguacugguagaaguugcugacauggaguuacacacaaagaagauugaaauaucaggcuuaaaauuugcaagcuugacuugcacaggcuguuaugcuuguagcucuggcaucucaugcaaaguuagaauucauguggaugaaccagaugaacuuacaguacauguuaaaagugaugauccagauguaguugcagcuagcucaagucucauggcaagaaagcuugaauuuggaacagacaguauauuuaaagcuuucucagccaugccuaaaacuucucuauguuucuacauuguugaaagagaacacuguaagagcugcagcgaagaagacacuaaaaaauguguuaacacaaaacuugagcaaccacaaagcauuuugaucgaacacaagggaacuauaaucggaaagcaaaacagcacuugcacagccaagacgaguugcugguuagagucagucaaaaguuuuuuuuauggucuaaagaacaugcuuaguggcauuuuuggaaauguuuuuauagguauuuucuuguuccuugcccccuucauccuguuaauacuguucuuuauguuuggguggaggauccuauuuugcuuuaaauguugcagaagaacuagaggccuguucaaguauagacacuuaaaggacgaugaagaaacugguuauagaaggauuauugaaagauuaaacaauaaaaaaggaaaaaacaaacugcuugauggugaaagacuugcugauagaagaauugccgaacuguucucuacaaaaacacacauuggcuag

SEQ ID NO: 3601 - RNA, 5055 nt, Artificial Sequence
  derived and/or modified CDS sequence (wt) from CCHFV(SPU 48/90)__KJ682813.1__GP
augcauauaucguuaauguaugcaguccuuugccuacagcuguguggucugggagagacucauagaucacacaaugaaacuggacacaauaaaacagacguugcgacaacgcccggugauaaccugagcucugaacagcuagugagcacggccuuguccauuacaccugaccccuccacuguuacgcccacaacaucagccaguggauuagaaggcucgggggaaguuuacacauccucucugaucaccaccgagagcuuguccuugcuggaaaccacaccgaagcucccuacuacaacugguauagacacuucaagugcaagugaugucgauuccaguacgcaggcagccggagacaccuccgcacuaacaguccgcacaaguccacccagcaaccccagcacaccaucuacaccacaagacacgcaccaucccaugagaaaucuacuuucagucacgagcccugggccagaagaaacaucuacacccucaggaucaggcaaagagagcccagcaaccaguagcccucauccagucuccaacagaucacaaaccccucccgcaacggcccaaggaccuacugaagauaacaguuacaacgccacugaacaccccgagcaccugacacagucagcaaccucaggccuaaugaccucuccaacacagauaguccacccacaaagugccaccuccauaaccguucaagacacauaccccaguccaacgaacagguccaaaagaaaccuugagauggaaauaaucuugacuuugucucaggguuuaaaaaaguacuauggcaaaauauuaaggcuucugcgucucaccuuagaggaggacacugaaggucuacuggaaugguguaagagaaaucuuggucuugauugugaugacacuuucuuucaaaagagaauugaagaauucuucauaacuggugagggccauuuuaaugaaguuuuacaauuuaaaacgccaggcacguugagcacuacagagucaacaccugcugagccgccaacagcugaaccuuuuaaguccuacuucgccaagggcuuccuuucaauagauucagguuacuauucagccaaauguuacucaggaacaucuaauucagggcuucaauugauuaauauuacccgacauucaacuaaaauagcugacacaccugggccuaagaucacuaacuuaaagaccaucaacugcauaaaccugaaggcaucgaucuucaaagaacacagagagguugaaaucaaugugcuucucccccaaguugcaguuaaucucucaaacugucacguuguaaucaaaucucaugucugugacuauccuuuagacauugacgguacggugaggcuuccucacauuuaccaugaagggguuuucauuccaggaacuuacaaaauagugauagauaaaaaaaccaaguugaaugacagaugcaccuuguuuaccgacugugugauaaaaggaagggagguucguaaaggucagucaguuuugaggcaguacaagacggaaaucaggauuggcaaaacaucaaccggcucuagaagauugcuuuccgaagaacccagugaugacugcauaucaagaacucagcuauugaggacagagacugcagagauccacggcgacaacuaugguggcccgggugacaaaauaacuaucugcaauggcucaacuauuguagaccaaagacugggcagugagcuaggguguuacacuaucaacagagugaagucauucaagcuaugcgaaaauagugccacagggaagagcuguguaauagacagugucccaguuaaaugcaggcaagguuauugucuaagaaucacucaggaaggaaggggccauguaaaauuaucuaggggcucagagguugucuuagaugcaugcgauacaagcugugaaauaaugauaccuaagggcaccggugacauccuaguugacuguucaggugggcagcaacauuuucuaaaggacaauuugauagaucuaggaugccccaaaauuccauuauugggcaaaauggcuaucuacauuugcagaaugucgaaucaccccacaacaaccauggcuuuccucuucugguucagcuuuggcuauguaauaacuuguauacuuugcaaggccaucuuuuacuuguuaauaauuauuggaacacuagggaaaagguucaggcaguauagagaguuaaaaccucagaccugcaccauaugugagacaacuccuguaaaugcaauagaugcugagaugcaugaccucaauugcaguuacaacauuugucccuacugugcaucuagacuaaccucagaugggcuugcuaggcaugugacacagugcccuaagcggaaggagaaaguggaagaaacugaacuguacuugaacuuagaaagaauuccuuggguuguaagaaagcuauugcagguaucagaguccaccgguguggcauugaaaagaagcagcuggcugauugugcugcuugugcuguucacgguuucauugucgccaguucaaucagcacccauuggucacgggaagacaauugaggcauaccgugccagggagggauacacaaguauaugucucuuuguacuaggaaguauccuauuuguagucucuugccuaaugaaaagguugguugacaguguuggcaacuccuucuucccuggacuguccauuugcaaaacgugcuccauaagcagcauuaauggcuuugaaauugagucccauaagugcuauugcagcuuauucugcugccccuauuguaggcacugcucugcugauaaagaaauucacaagcugcacuugagcaucugcaaaaaaagaaaaacaggaaguaaugucauguuggcugucugcaagcgcauguguuucagggccaccauggaaguaagugacagagcccuguuuauucguagcaucaucaauaccacuuuuguuuugugcauacugauacuagcaguuuguguuguuagcaccucagcaguggagauggaaaaccuaccagccgggacuugggaaagagaagaagaccuaacaaauuucugucaucaggaaugccagguuacagagacugaaugccucugcccuuaugaagcucuaguacucagaaagccucuauuccgagacaguauaguuaaaggcaugaaaaaucugcuaaacucaacaaguuuagaaacaagucuaucaauugaggcaccauggggggcaauaaauguucagucaaccuacaagccaacugugucgacugcaaacauagcacucagcuggagcucaguggaacacagaggcaauaagaucuugguuucaggcagaucagaaucaauuaugaagcuggaagaaaggacagggaucagcugggaucucggcguagaagacgccucugaguccaaacugcuuacagucucugucauggacuugucucagauguacucuccugucuucgaguacuuaucaggagacagacagguggaagaguggcccaaagcaacuuguacaggugacugcccagaaagauguggcugcacaucaucaacauguuugcacaaagaauggccccacucaagaaauuggagaugcaauccuacuuggugcugggguguagggacuggcugcaccuguuguggauuagaugugaaagaccuuuuuacagauuauauguuugucaaguggaaaguugaauacaucaagacagaggccauaguguguguagaacuuaccagucaggaaaggcaguguagcuugauugaagcgggcacaagguucaauuuagguccugugaccaucacacugucagaaccaagaaacauccaacagaagcucccuccugaaauaaucacacuacauccuaggauugaagaagguuuuuuugaccugaugcacguucagaaaguguuaucagcaagcacaguguguaaguugcagaguugcacacaugguguaccaggagaccuacaggucuaccacaucggaaauuuauuaaaaggggacaagguaaauggacaucuaauucauaaaauugagccacacuucaacacuuccuggauguccugggaugguugugaccuagacuacuacugcaacaugggagauuggccuucuugcacauacacaggagucacccaacacaaucgugcuucauuuguaaaccugcucaacauugaaacugauuacacaaaaaacuuccauuuucacucuaaaagggucacugcacacggagacacaccacaacuggaucuuaaggcaagaccaaccuauggugcaggugagauuacuguacugguagaaguugcugacauggaguuacacacaaagaagauugaaauaucaggcuuaaaauuugcaagcuugacuugcacagguuguuaugcuuguagcucuggcaucucaugcaaaguuagaauucauguggacgaaccagaugaacuuacagugcauguuaaaagugaugauccagauguaguugcagcuagcucaagccucauggcaagaaagcuugaauuuggaacagacagcacauuuaaagcuuucucagccaugccuaaaacuucgcuauguuucuacauuguugaaaaagaauacugcaagagcugcagugaagaagacacaaaaaaauguguuaacacaaaacuugagcaaccacaaagcauuuugaucgaacacaagggaacuauaaucggaaagcaaaacagcacuugcacagccaaagugaguugcugguuagagucagccaagaguuuuuuuuauggucuaaaggacaugcuuaguggcauuuuuggcaaugucuuuauagguauuuucuuguuccuugcccccuucauccuguuaauacuauucuuuauguuuggguggaggauccuacuuugcuuuaaauguuguagaagaacuagaggccuguucaaguauagacaccucaaggacgaugaagaaacugguuauagaaggauuauugaaagacuaaacaauaaaaaaggaaaaaacaaauugcuugauggugaaagacuugcugauagaagaauugcugaacuguucuccacaaaaacacacauuggcuag

SEQ ID NO: 3602 - RNA, 5055 nt, Artificial Sequence
  derived and/or modified CDS sequence (wt) from CCHFV(Sudan AB1-2009)__HQ378187.1__GP
augcauauaucauuaauauaugcaauccuuugccuacagcuguguggucugggagagacucauggaucacacaaugaaacuagacacaauaaaacagacaccauaacaacacccggugauaaccugagcucugaaccgucagugagcacggccuugucuauuacaccugaccccuccacugucacacccacaacaccagccaguggauuagaaggcucaggggaaguuuacacauccccuccgaucaccaccgggagcuugccccugccggggacaacaccggagcucccugcuacaaccggcacagacacuucaagugcaagugaugucgauucuaguacgcagacagccggaggcaccuucacacuaacaguccgcacaagucuacccagaagcccuagcacaccaucuacaccacaagacacacaccauccugugagaaaucuacuuucagucacgaguccugggccagaugaaacaucaacaccuucgggaacaggcaaagagagcccagcaaccaguagcccucauccagucuccaacagaccaccaaccccucccgcaacagcccagggaccuacugaaaaugacagucacaaugccacugaacacccugagucccugacacagucagcaaccacaggcccaaugaccucuccaacacagauaguccauccacaaagugccacccccauaaccguucaagacacacauccuagcccaacgaacaggucuaaaagaaaccuugagauggaaauaaucuugacuuugucucaggguuuaaaaaaguacuaugggaagauauuaaggcuucugcaucucaccuuagaggaggacacugaaggucuacuggagugguguaagagaaaucuuggucuugauugugaugacacuuucuuucaaaagagaauugaagaauucuucauaacuggugagggccauuuuaaugaaguuuuacaauuuagaacgccaggcacguugagcacuacagagucaacaccugccgggcugccaacagcugaaccuuuuaaguccuacuucgccaaaggcuuccuuucaauagauucagguuacuacucagccaaauguuacucaggaacaucuaauucagggcuucaauugauuaacauuacccggcauucaacuagaauaguugacacaccugggccuaaaauuacuaacuuaaagaccaucaacugcauaaacuugaaggcaucgaucuuuaaagaacauagagagguugaaaucaaugugcuucucccccaaguugcaguuaaucucucaaacugucacguuguaaucaaaucacaugucugugacuacucuuuagacauugacggugcggugaggcuuccucacauuuaccaugaaggaguuuucauuccaggaacuuacaaaauagugauagauaaaaaaaacaaguugaaugacagaugcaccuuauucaccaacugugugauaaaaggaagggagguucguaaaggucagucaguuuugagacaguacaagacggaagucaggauuggcaaagcaucaaccggcuccagaagauugcuuucugaagaacccagugaugacuguauaucaagaacucaacuacugaggacagagacugcagagauccacggcgauaacuaugguggcccgggugacaaaauaaccaucugcaauggcucaacuauuguagaccaaagacugggcagugaacuaggguguuacaccaucaauagaguaaagucauucaagcuaugcgaaaacagugccacagggaagaauugugaaauagacagugucccaguuaaaugcaggcaggguuauugccuaagaaucacucaggaagggaggggccacguaaaauuaucuaggggcucagagguugucuuagaugcaugcgacacaagcugugaaauaaugauaccuaagggcacuggugacauccuaguugacuguucaggcgggcagcaacauuuucuaaaggacaauuugauagaucuaggaugccccaaaauuccauuauugggcaaaauggcuauuuacauuugcagaaugucgaaccaccccaaaacaaccauggcuuuccucuucugguucagcuuuggcuauuuaauaaccugcauacuuugcaaggccauuuuuuacuuguugauaauuauuggaacacuagggaaaaggcucaagcaguauagagaguugaaaccucagaccugcaccauaugugagacaacuccuguaaaugcaauagaugcugagaugcaugaccucaauugcaguuacaacauuugccccuacugugcaucuagacuaaccucagaugggcuugcuaggcaugugauacaaugcccuaagcggaaggagaaaguggaagaaacugaacuguacuugaaccuagaaagaauuccuuggguuguaagaaagcuguugcaggugucagagucaacugguguagcauugaaaagaagcaguuggcugauugugcugcuugugcuauucacuguuucauugucaccaguucaaucagcacccauuggucaagggaagacaauugaagcauaccgggccagggagggguacacaaguauaugucucuuuguacuaggaaguauccuauuuauaguuucuugccuaaugaaagggcugguugacaguguuggcaacuccuucuucccuggacuguccauuugcaaaacgugcuccauaagcagcauuaauggcuuugaaauugagucccauaagugcuauugcagcuuauucuguugccccuauuguaggcacuguucuaccgauaaagaaauucauaagcugcacuugagcaucugcaaaaaaaggaaaacaggaaguaaugucauguuggcugucugcaagcgcauguguuucagggccaccauggaaguaagcaacagagcccuguuuauccguagcaucaucaacaccacuuuuguuuugugcauacugauacuagcaguuuguguuguuaguaccucagcaguggagauggaaaaccuaccagcagggaccugggaaagagaagaagaccugacaaauuucugucaucaggaaugucagguuacagagacugaaugccucugcccuuaugaagcucuaguacucagaaagccuuuauucuuagauaguauagcuaaaggcaugaaaaaucugcuaaauucaacaaguuuagaaacgaguuuaucaauugaggcaccauggggagcaauaaauguucagucaaccuacaaaccaacugugucaacugcaaacauagcacucaguuggagcucaguggaacacagaggcaauaagaucuugguuucaggcagaucagaaucaauuaugaagcuggaagaaaggacaggaaucagcugggaucuuggcguagaagaugccucugagucuaaacugcuuacagucucugucauggacuugucucagauguacucuccugucuucgaguacuuaucaggugacagacagguggaagaguggcccaaagcaaccuguacaggugacugcccagaaagauguggcugcacaucaucaaccuguuugcacaaagaauggccucacucaagaaauuggagaugcaaucccaccuggugcugggguguagggacuggcugcaccuguuguggauuagaugugaaggaccuuuuuacagauuacauguuugucaaguggaaaguugaauacaucaagacagaggccauaguguguguagaacuuacuagucaggaaaggcaguguagcuugauugaagcgggcacaagguucaauuuggguccugugaccaucacacugucagaaccaagaaacauccaacaaaaacucccuccugaaauaaucacacuacauccuaggaucgaagaagguuuuuuugaccugaugcauguacaaaagguguuaucggcaagcacaguguguaaguugcagaguugcacacauggugugccaggagaccuacaggucuaccacaucggaaauuuauuaaaaggggauaagguaaaugggcaucuaauucauaaaauugagccacacuucaacaccuccuggauguccugggaugguugugaccuagacuacuacugcaacaugggagauuggccuuccugcacauacacaggggucacccaacacaaucaugcuucauuuguaaacuuacucaacauugaaacugauuacacaaagaauuuccacuuucacucuaaaagggucacugcacacggagauacaccacaacuagaucuuaaggcaagaccaaccuauggugcaggugagaucacuguucugguagaaguugcugacauggaguuacauacaaagaagauugagauaucaggcuuaaaauuugcaagcuugacuugcacagguuguuaugcuugcagcucugguaucucaugcaaaguuagaauucauguggaugaaccagaugaacuuacaguacauguuaaaagugaugauccagaugugguugcagcuagcucaagucucauggcaagaaagcuugaauuuggaacagacaguacauuuaaagcuuucucggccaugccuaaaacuucuuuauguuucuacauuguugaaagggaacacuguaagagcugcaaugaagaagacacaaaaaaauguguuaacacaaaacuugagcaaccacaaagcauuuugaucgaacacaagggaaccauaaucggaaagcagaacagcacuugcacggcuagggcgaguugcugguuggagucagucaagaguuucuuuuauggccuaaagaacaugcuuaguggcauuuuuggcaaugucuuuaugggcaucuucuuauuccuugcccccuucauccuguuaauacuauucuuuauguuuggguggaggauccuauucugcuuuaaauguuguagaagaaccagaggccuguucaaguauagacaccucaaagacgaugaagaaacugguuauagaaggauuauugaaagacuaaacaauaaaaaaggaaaaaacaaacugcuugauggugaaagacuugcugauagaagaauugccgaacuguucucuacaaaaacacacauuggcuag

SEQ ID NO: 3603 - RNA, 5055 nt, Artificial Sequence
  derived and/or modified CDS sequence (wt) from CCHFV(Sudan Al-Fulah 9-2008)__HQ378185.1__GP
augcauauaucauuaauguaugcaguccuuugccuacagcuguguggucuaggagagacucauagaucacacaaugaaacuguacacaauaaaacagacauugugacaacgcccagugaugaccugaguucugaacagcuagugagcacggccuugucaauuacaccugaccccuccacuguuacgcccacaacaucagccaguggauuagaaggcucgggggaaguuuacacauccucuccgaucaccaccgagagcuugucccagccggaaaccacaccgaagcucccugccacaacugguauagacaccucaagugcaagugauguugauuccaguacgcaggcagccggagacacuuccacacuaacaguccgcacaaguccacccaacagcccuagcacaccauccacaccacaagacacacaccauccuaugagaaaucuacuuucagucacgagcccugggccagaagaaacaucuacaccuuccggaucaggcaaagagagcucagcaacuaguagcccucauccagucuccaacagaccacaaacuccucccgcaacggcccaaggaccuacugaagauaacagucacaacgccacugaacaccccgagcaccugacacagucagcaaccucaggcccaaugaccucuccaacacagauaguccacccacaaagugccaccaccauaaccguucaagacacauaccccaguccaacgaacagguccaaaagaaaccuugagauggaaauaaucuugacucugucucaggguuuaaaaaaguacuauggcaaaauauuaaggcuucugcgucucaccuuagaggaggacacugaaggucuacuggaaugguguaagagaaaucuuggucuugauugugaugacacuuucuuucaaaagagaauugaagaauucuucauaacuggugaaggccauuuuaaugauguuuuacaauuuaaaacgccaggcacguugagcacuacagagucaacaccugcuaagccgccaacagcugaaccuuuuaaguccuacuucgccaaaggcuuccuuacaauagauucagguuacuauucagccaaauguuacucaggaacaucuaauucagggcuccaauugauuaauauuaccagacauucaacuagaauaguugacacaccugggccuaagaucaccaacuuaaagaccaucaacugcauuaaccugaaggcaucaaucuucaaggaacauagagagguugaaaucaaugugcuucucccccaaguugcaguuaaucucucaaacugucacguuguaaucaaaucacaugucugugacuauccuuuagacauugacgguacggugaggcuuccucacauuuaccaugaagggguuuucauuccaggaacuuacaaaauagugauagacaaaaaaaauaaguugaaugacagaugcaccuuguuuaccgacuguguaauaaaaggaagggagguucguaaaggucagucaguuuugaggcaguacaagacggaaaucaggauuggcaaggcaucaaccggcucuagaagauugcuuuccgaagaacccagugaugacugcauaucaagaacucaacuauugaggacagagacugcagaaauccacggcgacaacuaugguggcccgggugacaaaauaaccaucugcaacggcucaacuauuguagaccaaagacugggcagugaguuaggguguuacacuaucaauagagugaagucauucaagcuaugugaaaauagugccacugggaagagcugugugauagacagugucccaguuaaaugcaggcaggguuauugccuaaggauuacucaagaaggaaggggccauguaaaauuaucuaggggcucagagguugucuuagaugcaugcgauacaagcugugaaauaaugauaccuaagggcaccggugacauccuaguugacuguucaggugggcagcaacauuuucuaaaggacaauuugguagaucuaggaugccccaaaaucccauuacugggcaaaauggcuaucuacauuugcagaaugucgaaucaccccaaaacaaccauggcuuuccucuucugguucagcuuuggcuauguaauaacuuguauacuuugcaaggccaucuuuuacuuguuaauaauuauuggaacacuagggaaaagguucaggcaguauagagaguuaaagccucagaccugcaccauaugugagacaacuccuguaaaugcaauagaugcugagaugcaugaccucaauugcaguuacaacauuugucccuacugugcaucuagacuaaccucggaugggcuugcuaggcaugugacacagugcccuaagcggaaggagaaaguggaagaaacugaacuguacuugaacuuagaaagaauuccuuggguugugagaaagcuguugcagguaucagaguccaccgguguggcauugaaaagaagcagcuggcugauugugcugcuugugcuguucacgguuucauugucgccaguucaaucagcacccauuggucacgggaagacgauugaggcauaccgugccagggagggauacacaaguauaugucucuuuguacuaggaaguauccuauuuauagucucuugccuaaugaaaggguugguugacaguguuggcaacuccuucuucccuggacuguccauuugcaaaacgugcuccauaagcagcauuaauggcuuugaaauugagucccauaagugcuauugcagcuuguucuguugccccuauuguaggcacugcucugcugauaaagaaauucacaagcugcacuugagcaucugcaaaaaaaggaaaacaggaaguaaugucauguuggcuguuugcaagcgcauguguuucagggccaccauggaaguaaguaacagagcccuguuuauucguagcaucaucaauaccacuuuuguuuugugcauacugauacuagcaguuuguguuguuagcaccucagcaguggagauggaaaaccuaccagccgggacuugggaaagagaagaagaccuaacaaauuucugucaucaggaaugccaaguuacagagacugaaugccucugcccuuaugaagcucuaguacucagaaggccucuauuccuagacaguauaguuaaaggcaugaaaaaucugcuaaacucaacaaguuuagaaacaagucugucaauugaggcaccauggggggcaauaaauguucagucaaccuacaagccaacugugucgacugcaaauauagcacucagcuggagcucaguggaacacagaggcaauaagaucuugguuucaggcagaucagaaucaauuaugaagcuggaagaaaggacagggaucagcugggaucucggcguagaagacgccucugagucuaaacugcuuacagucucuguuauggauuugucucagauguacucuccugucuucgaguacuuaucaggagacagacagguggaggaguggcccaaagcaacuugcacaggugacugcccagaaagauguggcugcacaucaucaacaugucugcacaaagaauggccccacucaagaaauuggagaugcaaucccacuuggugcugggguguagggacuggcugcaccugcuguggauuagaugugaaagaccuuuuuacagauuauauguuugucaaguggaaaguugaauacaucaagacagaggccauaguguguguagaacucaccagucaggaaaggcaguguagcuugauugaagcaggcacaagguucaauuuagguccugugaccaucacacugucagaaccaagaaacauccaacagaagcucccuccugaaauaaucacacuacauccuaggauugaagaagguuuuuuugaccugaugcacguucagaaaguguuaucagcaagcacaguguguaaguugcagaguugcacacaugguguaccaggagaccuacaggucuaccacaucggaaauuuauuaaaaggggacaagguaaauggacaucuaauucauaaaauugagccacacuucaacacuuccuggauguccugggaugguugugaccuagacuacuacugcaacaugggagauuggccuucuugcacauacacaggagucacccaacacaaucaugcuucauuuguaaaccugcucaacauugaaacugauuacacaaaaaacuuccacuuucacucuaaaagggucacugcacacggagacacaccacaacuggaucuuaaggcaagaccaaccuauggugcaggugagauuacuguacugguagaaguugcugacauggaguuacacacaaagaagauugaaauaucaggcuuaaaauuugcaagcuugacuugcacagguuguuaugccuguagcucuggcaucucaugcaaaguuagaauucauguagacgaaccagaugaacuuacagugcauguuaaaagugaugauccagauguaguugcagcuagcucaagccucauggcaagaaagcuugaauuuggaacagacaguacauuuaaagcuuuuucagccaugccuaaaacuucgcuauguuucuacauuguugaaaaagaauacugcaagagcugcagugaagaagacacaaaaaaauguguuaacacaaaacuugagcaaccacagagcauuuugaucgaacacaagggaacuauaaucggaaagcaaaacagcacuugcacagccaaggugaguugcugguuagagucagccaagaguuuuuuuuauggucuaaaggacaugcuuaguggcauuuuuggcaaugucuuuauagguauuuucuuauuccuugcccccuucguccuguuagugcuguucuuuauguuuggguggaggauccuacuuugcuuuagauguuguagaagaacuagaggccuguucaaguauagacaccucaaggacgaugaagaaacugguuauagaaggauuauugaaagacuaaacaauaaaaagggaaaaaacaaacugcuugauggugaaagacuugcugauagaaaaauugcugaacuguucuccacaaaaacacacauugguuag

SEQ ID NO: 3604 - RNA, 5055 nt, Artificial Sequence
  derived and/or modified CDS sequence (wt) from CCHFV(SPU4/81)__DQ157175.1__GP
augcauauaucauuaauguaugcaguccuuugccuacagcuguguggucugggagagacucauggaucauacaaugaaacuggacacaauaaaacagacguuaugacaacgcccggugauaaccugagcucugaacagccagugaguacggccuugucuaucacaccugaccccuccacuguuacacccacaacaccagccaauggauuagaaggcucaggggaaguuuacacauccucuccgaucaccaccgagagcuugucccugccagaaaccacaccagagcucccugcuacagcugguauagacacuucaagugcaagugaugucgacuccaguacgcaagcagccggaggcaccuccgcaccaacaguccgcacaagucuacccaacagcccuagcacaccaucuacaccacaagaaacacaccauccugugaggaaucuacuuucagucacgagccuugggccagaagaaacaucaacaccuucgggaccaggcaaagagagcucagcaacuaguagcccccauccagucuccaacaaaccaccaaccccucccgcaagagcccagggaccuacugaaaauaacagucacaacgccacugaacaccccgagccccugacacagucagcaaccccaggccuaaugaccucuccaacacagguaguccacccacaaagugccaccuccauaaccguucaagacacauaccccaguccaacgaacaggucuaaaagaaaccuugagacggaaauaaucuugacuuugucucaggguuuaaaaaaguacuauggcaaaauauugaggcuucugcgucucaccuuagaggaggacacugaaggucuacuggaaugguguaagagaaaucuuggucuugauugugaugacacuuucuuucaaaagagaauugaggaauucuucauaacuggugagggccauuuuaaugaagucuuacaauuuaaaacgccaggcacguugaguacuacagagucaacaccugcugagcugccaacagcugaaccauuuaaguccuacuucgccaaaggcuuccuuucaauagauucagguuacuauucagccaaauguuacucaggaacaucuaauucagggcuucaauugauuaauauuacccgacauucaacuagaauaguugacacaccugggccuaagaucaccaacuuaaagaccaucaacugcauaaacuugaaggcaucgaucuucaaagaacauagagagguugaaaucaaugugcuucucccucaagccgcaguuaaucucucaaacugucacguuguaaucaaaucacaugucugugacuauucuuuagacauugacgguacggugaggcuuccucacauuuaccaugaaggaguuuucauuccaggaacuuacaaaauagugauagauaaaaaagauaaguugaaugacagaugcaccuuauuuaccgacugugugauaaaaggaagggagguucguaaaggucaaucaguuuugaggcaguacaagacggaaauuaggauuggcaaagcaucaaucggcucuagaagauugcuuuccgaagaacccagugaugacugcauaucaagaacucaacuauugaggacagagacugcagagauccacggcgacaacuaugguggcccgggugacaaaauaaccaucugcaacggcucaacuauuguagaccaaagacuaggcagugagcuaggguguuacacuaucaacagagugaagucauucaagcuaugcgaaaauagugccacagggaagagcugugaaauagaaagugucccaguuaaaugcaggcaggguuauugccugagaaucacucaggaagggaggggccauguaaaauuaucuaggggcucagagguugucuuagaugcaugugauacaagcugugaaauaaugauaccuaagggcacuggugacaucuugguugacuguucaggugggcagcaacauuuucuaaaggacaauuugauagaucuaggaugccccaaaauuccauuauugggcaaaauggcuauuuacauuugcagaaugucgaaucaccccaaaacaaccauggcuuuccucuucugguucagcuuuggcuacguaauaacuuguauacuuugcaaggccaucuucuacuuguuaauaauuauuggaacacuagggaaaagguucaagcaguauagagaguuaaaaccucagaccugcaccauaugugagacaacuccuguaaaugcaauagaugcugagaugcacgaccucaauugcaguuacaacauuugucccuacugugcaucuagacuaaccucagaugggcuugcuaggcaugugacacaaugcccuaagcggaaggagaaaguggaagaaacugaacuguacuugaacuuagaaagaauuccuuggguuguaagaaagcuguugcagguaucagaguccacugguguggcauugaaaagaagcagcuggcugauugugcugcuugugcuguucacgguuucauugucaccaguucaaucagcacccauuggucacgggaagacaauugaggcauaccgggccagggagggauacacaaguauaugucucuuuguacuaggaaguauccuauucauagucucuugccuaaugaaagggcugguugacaguguuggcaacuccuucuucccuggacuguccauuugcaagacgugcuccauaagcagcauuaauggcuuugaaauugagucccauaagugcuauugcagcuuauucuguugccccuauuguaggcacugcucugcugauaaagaaauucauaagcugcacuugagcaucugcaaaaaaagaaaaacaggaaguaaugucauguuggcugucugcaagcgcauguguuucagggccaccauggaaguaaguaacagagcccuguuuauccguagcaucaucaacaccacuuuuguuuuguguauacugauacuagcaguuuguguuguuagcacgucagcaguggagauggaaaaccuaccagccgggaccugggaaagagaagaagaccuaacaaauuucugucaucaggaaugucagguuacagagacugaaugccucugcccuuaugaagcucuaguacucagaaagccucuauuccuagauaguauaguuaaaggcaugaaaaaucugcuaaacucaacaaguuuagaaacaaguuuaucaauugaggcaccauggggggcaauaaauguucagucaaccuacaaaccaacugugucaacugcaaacauagcacucaguuggagcucuguggaacacagaggcaauaagaucuugguuucaggcagaucagaaucaauuaugaagcuggaagaaaggacaggaaucagcugggaucucggcguagaagacgccucugagucuaaacugcuuacagucucugucauggacuugucucagauguacucuccugucuucgaguacuuaucaggagacagacagguggaagaguggcccaaagcaacuuguacaggugacugcccagaaagaugcggcugcacaucaucaacguguuugcacaaagaauggccccauucaagaaauuggagaugcaaucccacuuggugcugggguguagggacuggcugcaccuguuguggauuagaugugaaagaccuuuuuacagauuauauguuugucaaguggaaaguugaauauauuaagacagaggccauaguguguguagaacuuaccagucaggaaaggcaguguagcuugauugaagcgggcacaagguucaauuuagguccugugaccaucacacugucagaaccaagaaacauccaacagaagcucccuccugaaauaaucacacugcaucccaggaucgaagaagguuuuuuugacuugaugcauguacagaaaguguuaucggcaagcacaguauguaaguugcagaguugcacacaugguguaccaggagaccuacaggucuaccacaucggaaauuuauugaaaggggauaagguaaauggacaucuaauucauaaaauugagccacacuucaacacuuccuggauguccugggaugguugugaccuggacuacuacugcaacaugggagauuggccuucuugcacauacacaggagucacccaacacaaucaugcuucauuuguaaaccugcucaacauugagacugauuacacaaaaaacuuccacuuucacucuaaaagggucacugcacacggagacacaccacaacuagaucuuaaggcaagaccaaccuauggugcaggugagaucacuguacugguagaaguugcugacauggaguuacacacaaagaagauugaaauaucaggcuuaaaauuugcaagcuugacuugcacagguuguuaugcuuguagcucuggcaucucaugcaaaguuagaauucauguggaugaaccagaugaacuuacaguacauguuaaaagugaugauccagauguaguugcagcuagcucaagucucauggcaagaaagcuugaauuuggaacagacaguacauuuaaagcuuucucagccaugccuaaaacuucucuauguuucuacauuguugaaagagaacacuguaagagcugcagcgaagaagacacaaaaaaaugcgucaacacaaaacuugagcaaccacaaagcauuuugaucgaacacaagggaacuauaaucggaaagcaaaacagcacuugcacagccaaggcgaguugcugguuagagucagucaaaaguuuuuuuuauggucuaaagaacaugcuuagugguauuuuuggcaauguuuuuauagguauuuucuuguuccuuggccccuucaucuuguuaauacuauucuuuauguuuggguggaggauccuauuuugcuuuaaauguuguagaagaacuagaggccugcucaaguauagacaccucaaggaagaugaagaaacugguuauagaaggauuauugaaagacuaaacaauaaaaaaggaaaaaacaaacugcuugauggugaaagacuugcugauagaagaauugccgaacuguucucuacaaaaacacacauuggcuag

SEQ ID NO: 3605 - RNA, 5055 nt, Artificial Sequence
  derived and/or modified CDS sequence (wt) from CCHFV(NIV 11703)__JN572086.1__GP
augcauacaucuuugauauauguaguucucugcuugcagcuguguagucuagggaaaacucacggaucacauaauggaacugaacacaauaaaacagacguuaugacaacgcccggugauaaccagagcccugaaccgcuagugagcacggcccugccugucacaccggacccuuccacugucacaccuacagcaccagccagcggauuagaaggcucaggggaaguuuauacaucuuccucaaucaccaccaagggcuuaucucugccgaaggcuacgucugagcuccuugcgacuaccggcauggucacuucaagugcaagcgauaucgauccuagcacacaggcagccggagacacccccacaccaacaguccgcacaagucugcccaacagccccagcacaccaucuacaucgcaagacacacaccauccuguaaggaaucuacuuucagucacgagcccuaagccagaagaaacaccaacaccgucaaaaucugacaaagauagcucagcaaccaacagcccucacccagccgccagcagacuaucaaccccucccacaacagaccagggacccacugaaaacaacaaccacaacuccaccgaacagcuugaguccuuaacacgaucagcaacuucaagcucaauggucucucuaacacagacaguacuuccacagagugccaccucuauagccacucaagacacacaucccagcccaacgaacaggucuaaaagaaaccuugaaauggaaauaaucuugacauugccucaagguuuaaaaaaauauuauggcaaaauacuuaagcuccugcaucuuacuuuagaagaagacacugaaggcuugcuagaaugguguaaaaggaaucucggucuugacugugaugacaccuucuuucaaaaaagaauugaagaauucuuuauaacuggugagggucauuucaaugaaguuuuacaauuuagagcaccaggcacauugagcaccacagagccaacacaugcugggucgccaacagcugaacccuuuaaauccuacuuugcuaaagguuuccuuucaauagauucagguuauuucucugccaaauguuauucaagaacauccaauucagggcuucaguugauuaauguuacccgacacucaacuaggauagcugacacgcccggacccaagaucacuaacuuaaagacuaucaauugcauaaacuuaaaagcauccguauuuaaagaacauagagagguugaaaucaaugugcuucucccucaaguugcaguuaaccuuucaaauugucacguugcaaucaaaucacaugucugcgauuauucuuuggacacugacggggcgauuaggcuaccucauauucauuaugaaggaacuuuuauuccaggaacuuacaagauagugauagauaaaaaaaacaagcugaaugacagguguacccuauucaccaacugugugauaaaaggaagagaaguucguaagggccagucaguccuaaggcaauauaagacagaaauuagaauugguagagcaucaacugguucuaggagacugcuuuccgaagaaucuggugaugacugcauaucaagaacucagcuauuaaggacagagacugcagagguccauggcgacaacuauggugguccgggugauaagauaaccaucugcaaugguucaacuguuguagaucaaagacuggguagugaacugggguguuacacuaucaauagagugaaguccuuuaagcuaugcgaaaacagugccacagggaagagcugugaaauagacaguaucccaguuaaguguaggcaggguuauugccuaaaaaucacucaggaaggaaggggccauguuaaauuaucuagggguucagaaguugucuuggaugcaugugacucaagcugugaagugaugauaccuaagggcacuggugacauucuaguagauuguucaggugggcagcaacauuuuuuaaaggacaaccugauugaucuaggaugucccaaaauuccauuauugggcaaaauggcuauuuauaucugcagaaugucgaaucaccccaaaacaaccauggccuuucucuuuugguucagcuucggcuaugugauaacuuguauacuuugcaagguaauuuuuuacuuauuaauaauuuuuggaacacuagggaaaagguucaagcaguacagagaguugaaaccccagaccugcaccauaugugagacaacaccugugaaugcaauagaugcugaaaugcaugaucuuaacugcaguuacaauauaugucccuauugugcgucuaggcuaacuucagaugggcucgcuaggcauguaacacaaugcccuaagcggaaggagaagguggaagagaccgaauuguacuugaacuuagagagaauuccuuggguuguaagaaagcuauugcaggugucagaguccacuggcauagcauuaaaaaggagcagcuggcuaauugugcugcuuguguuauucacaguaucaauaacaccgguucaaucagcgcccauuggucacgggaagacaauugaagcguaccgggcuagggaggaauacacaagcauuugucucuuugugcugggaagugucuuguuuguggucucuugucuaaugaaaggacugguugacaguguuggcaauaucuucuuuccugggcuguucauuuguaagacauguucuauagguagcauuaauggcuuugaaauugagucucauaagugcuauuguagcuuguuuuguugcccuuacuguaggcacugcucugcugauagagaaauucaucagcugcacuugagcaucugcaaaaaaaggaagacaggaaguaaugucaugcuggcuguuugcaaacgcauguguuucagaacaacuauggaaguaagcaacaaagcccuauuuguccgaagcaucaucaacaccacuuuuguugugugcauacugauacuagcagucuguguuguuagcacuucagcaguagagauggaaagccuaccagcugggaccugggaaagagaagaagaccuuacaaauuucugccaucaggaaugccaggucacggagacugagugccucugccccuaugaagcucuagugcucagaaggccccuauuucuagauaguauagucaaagguaugaaaaaucugcuaaacucaacaagucuagaaacaagcuuaucaauugaggcaccguggggagcaauuaauguucagucaaccuacaaaccaacuguaucagcagcaaacauagcacucaguuggagcucaguggaacacagaggcaauaagauuuuggucucaggcagaucagaaucaauuaugaagcuggaagaaaggacaggaaucagcugggaucucggcguagaagaugccucugagucuaagcuacuuacagucucagucauggacuugucucagauguacucuccugucuucgaguauuuaucaggugacagacaaguggaagaguggccuaaagcgaccuguacaggugacugcccagaaagauguggcugcacaucaucaaccugcuuacacaaagaguggccccacucaaggaauuggagauguaauccuacuuggugcugggguguagggacuggcugcaccugcuguggauuggaugugaaagaccuuuucacagauuacauguucgucaaguggaaaguugaguacauuaagacagaggccauaguauguguagaacuaaccagucaggaaagacaguguagcuugauugaggcgggcacaagauuuaauuuagguucugugaccauuacauugucagaaccaaggaacauucaacaaaagcucccuccugaaauaaucacacugcauccuagaauugaggaagguuuuuuugaccuaaugcaugugcaaaaagugcuaucagcaagcacaguguguaaguuacaaagcugcacacauggugugccaggagaucuacaggucuaccacauuggaaaccuauuaaaaggggacagaguaaacggacaccuaauucacaaaauugaacaacaccucaacacuucuuggauguccugggaugguugugaucuagacuacuacugcaauaugggagacuggccuucuugcacauauacaggagucacccaacauaaucaugcuucauuuguaaaccugcucaacauugaaacugauuacacaaaaaccuuccacuuucacucuaaaaggguuacugcacauggagacacaccacagcuagaucugaaggcaaggccaaccuauggugcaggugagaucacuguacugguggaaguugccgauauggaguuacacacaaagaagauugaaauaucaggcuugaaguuugcaagccuauccugcacagguuguuaugcuuguaguucuggcaucuccugcaaagucagaauucauguagaugaaccagaugaacuuacaguacauguuaaaagugaugauccagauguaguugcagcuagcucaagucucauggcaaggaagcuugaaucuggaacagacaguacauuuaaagcuuuuucagccaugccuaaaacuuccuugugcuucuacauuguagagagagaauacuguaagggcugcaguaaagaagacacacaaaaauguguuaacacgaaacucgagcaaccacagagcauuuugaucgaacacaagggaacuauaauuggaaagcaaaacaauacuugcacagcuaaggcaaguugcugguuagagucaguuaagaguuuuuuuuauggucugaagaauaugcuuaguggcauuuuuggcaauguuuuuuuaggcauuuucucauuucuugcccccuuuguccuauuaauacuuuucuuuauguuuggguggaggauccuguuuugcuucaaguguugcagaagaaccagaggccuauucaaguacagacaccucaaagacgaugaagaaacugguuacagaaagaucauugaaagacugaacaacaaaaaggggaaaaacaaacugcuugauggugaaaggcuugcugacagaaaaauugccgaacuguucuccacaaaaacacacauuggcuag

SEQ ID NO: 3606 - RNA, 5055 nt, Artificial Sequence
  derived and/or modified CDS sequence (wt) from CCHFV(NIV 112143)__JN572085.1__GP
augcauacaucuuugauauauguaguucucugcuugcagcuguguagucuagggaaaacucacggaucacauaauggaacugaacacaauaaaacagacguuaugacaacgcccggugauaaccagagcccugaaccgcuagugagcacggcccugccugucacaccggacccuuccacuaucacaccuacagcaccagccagcggauuagaaggcucaggggaaguuuauacaucuuccucaaucaccaccaagggcuuaucucugccgaaggcuacgucugagcuccuugcgacuaccggcauggucacuucaagugcaagcgauaucgauccuagcacacaggcagccggagacacccccacaccaacaguccgcacaagucugcccaacagccccagcacaccaucuacaucgcaagacacacaccauccuguaaggaaucuacuuucagucacgagcccuaagccagaagaaacaccaacaccgucaaaaucugacaaagauagcucagcaaccaacagcccucacccagccgccagcagacuaucaaccccccccacaacagaccagggacccacugaaaacaacaaccacaacuccaccgaacagcuugaguccuuaacacgaucagcaacuucaagcucaauggucucucuaacacagacaguacuuccacagagugccaccucuauagccacucaagacacacaucccagcccaacgaacaggucuaaaagaaaccuugaaauggaaauaaucuugacauugccucaagguuuaaaaaaauauuauggcaaaauacuuaagcuccugcaucuuacuuuagaagaagacacugaaggcuugcuagaaugguguaaaaggaaucucggucuugacugugaugacaccuucuuucaaaaaagaauugaagaauucuuuauaacuggugaaggucauuucaaugaaguuuuacaauuuagagcaccaggcacauugagcaccacagagccaacacaugcugggucgccaacagcugaacccuuuaaauccuacuuugcuaaagguuuccuuucaauagauucagguuauuucucugccaaauguuauucaagaacauccaauucagggcuucaguugauuaauguuacccgacacucaacuaggauagcugacacgcccggacccaagaucacuaacuuaaagacuaucaauugcauaaacuuaaaagcauccguauuuaaagaacauagagagguugaaauuaaugugcuucucccucaaguugcaguuaaccuuucaaauugucacguugcaaucaaaucacaugucugcgauuauucuuuggacacugacggggcgauuaggcuaccucauauucauuaugaaggaacuuuuauuccaggaacuuacaagauagugauagauaaaaaaaacaagcugaaugacagguguacccuauucaccaacugugugauaaaaggaagagaaguucguaaaggccagucaguccuaaggcaauauaagacagaaauuagaauugguagagcaucaacugguucuaggagacugcuuuccgaagaaucuggugaugacugcauaucaagaacucagcuauuaaggacagagacugcagagguccauggcgacaacuauggugguccgggugauaagauaaccaucugcaaugguucaacuguuguagaucaaagacuggguagugaacugggguguuacacuaucaauagagugaaguccuuuaagcuaugcgaaaacagugccacagggaagagcugugaaauagacaguaucccaguuaaguguaggcaggguuauugccuaaaaauuacucaggaaggaaggggccauguuaaauuaucuaggggcucagaaguugucuuggaugcaugugacucaagcugugaagugaugauaccuaagggcacuggugacauucuaguagauuguucaggugggcagcaacauuuuuuaaaggacaaccugauugaucuaggauguccuaaaaucccauuauugggcaaaauggcuauuuauaucugcagaaugucgaaucaccccaaaacaaccauggccuuucucuuuugguucagcuucggcuaugugauaacuuguauacuuugcaagguaauuuuuuacuuauuaauaauuuuugggacacuagggaaaagguucaagcaguacagagaguugaaaccccagaccugcaccauaugugagacaacaccugugaaugcaauagaugcugaaaugcaugaucuuaacugcaguuacaauauaugucccuauugugcgucuaggcuaacuucagaugggcucgcuaggcauguaacacaaugcccuaagcggaaggagaagguggaagagaccgaauuguacuugaacuuagagagaauuccuuggguuguaagaaagcuauugcaggugucagaguccacuggcauagcauuaaaaaggagcagcuggcuaauugugcugcuuguguuauucacaguaucaauaacaccgguucaaucagcgcccauuggucacgggaagacaauugaagcguaccgggcuagggaggaauacacaagcauuugucucuuugugcugggaagugucuuguuuguggucucuugucuaaugaaaggacugguugacaguguuggcaauaucuucuuuccugggcuguucauuuguaagacauguucuauagguagcauuaauggcuuugaaauugagucucauaagugcuauuguagcuuguuuuguugcccuuacuguaggcacugcucugcugauagagaaauucaucagcugcacuugagcaucugcaaaaaaaggaagacaggaaguaaugucaugcuggcuguuugcaaacgcauguguuucagagcaacuauggaaguaagcaacaaagcccuauuuguccgcagcaucaucaacaccacuuuuguugugugcauacugauacuagcaaucuguguuguuagcacuucagcaguagagauggaaagccuaccagcugggaccugggaaagagaagaagaccuuacaaauuucugccaucaggaaugccaggucacggagacugagugccucugccccuaugaagcucuagugcucagaaggccccuauuucuagauaguauagucaaagguaugaaaaaucugcuaaacucaacaagucuagaaacaagcuuaucaauugaggcaccguggggagcaauuaauguucagucaaccuacaaaccaacuguaucagcagcaaacauagcacucaguuggagcucaguggaacacagaggcaauaagauuuuggucucaggcagaucagaaucaauuaugaagcuggaagaaaggacaggaaucagcugggaucucggcguagaagaugccucugagucuaagcuacuuacagucucagucauggacuugucucagauguacucuccugucuucgaguauuuaucaggugacagacaaguggaagaguggccuaaagcgaccuguacaggugacugcccagaaagauguggcugcacaucaucaaccugcuuacacaaagaguggccccacucaaggaauuggagauguaauccuacuuggugcugggguguagggacuggcugcaccugcuguggauuggaugugaaagaccuuuucacagauuacauguucgucaaguggaaaguugaguacauuaagacagaggccauaguauguguagaacuaaccagucaggaaagacaguguagcuugauugaggcgggcacaagauuuaauuuagguucugugacuauuacauugucagaaccaaggaacauucaacaaaagcucccuccugaaauaaucacacugcauccuagaauugaggaagguuuuuuugaccuaaugcaugugcaaaaagugcuaucagcaagcacaguguguaaguuacaaagcugcacacauggugugccaggagaucuacaggucuaccacauuggaaaccuauuaaaaggggacagaguaaacggacaccuaauucacaaaauugaacaacaccucaacacuucuuggauguccugggaugguugugaucuagacuacuacugcaauaugggagacuggccuucuugcacauauacaggagucacccaacauaaucaugcuucauuuguaaaccugcucaacauugaaacugauuacacaaaaaccuuccacuuucacucuaaaaggguuacugcacauggagacacaccacagcuagaucugaaggcaaggccaaccuauggugcaggugagaucacuguacugguggaaguugccgauauggaguuacacacaaagaagauugaaauaucaggcuugaaguuugcaagccuauccugcacagguuguuaugcuuguaguucuggcaucuccugcaaaguuagaauucauguagaugaaccagaugaacuuacaguacauguuaaaagugaugauccagauguaguugcagcuagcucaagucucauggcaaggaagcuugaauuuggaacagacaguacauuuaaagcuuuuucagccaugccuaaaacuuccuugugcuucuacauuguagagagagaauacuguaagggcugcaguaaagaagacacacaaaaauguguuaacacgaaacucgagcaaccacagagcauuuugaucgaacacaagggaacuauaauuggaaagcaaaauaauacuugcacagcuaaggcaaguugcugguuagagucaguuaagaguuuuuuuuauggucugaagaauaugcuuaguggcauuuuuggcaauguuuuuuuaggcauuuucucauuucuugcccccuuuguccuauuaauacuuuucuuuauguuuggguggaggauccuguuuugcuucaaguguugcagaagaaccagaggccuauucaaguacagacaccucaaagacgaugaagaaacugguuacagaaagaucauugaaagacugaacaacaaaaaggggaaaaacaaacugcuugauggugaaaggcuugcugacagaaaaauugccgaacuguucuccacaaaaacacacauuggcuag

SEQ ID NO: 3607 - RNA, 5055 nt, Artificial Sequence
  derived and/or modified CDS sequence (wt) from CCHFV(NIVA 118594)__JN572084.1__GP
augcauacaucuuugauauauguaguucucugcuugcagcuguguagucuagggaaaacucacggaucacauaauggaacugaacacaauaaaacagacguuaugacaacgcccggugauaaccagagcccugaaccgcuagugagcacggcccugccugucacaccggacccuuccacugucacaccuacagcaccagccagcggauuagaaggcucaggggaaguuuauacaucuuccucaaucaccaccaagggcuuaucucugccgaaggcuacgucugagcuccuugcgacuaccggcauggucacuucaagugcaagcgauaucgauccuagcacacaggcagccggagacacccccacaccaacaguccgcacaagucugcccaacagccccagcacaccaucuacaucgcaagacacacaccauccuguaaggaaucuacuuucagucacgagcccuaagccagaagaaacaccaacaccgucaaaaucugacaaagauagcucagcaaccaacagcccucacccagccgccagcagacuaucaaccccucccacaacagaccagggacccacugaaaacaacaaccacaacuccaccgaacagcuugaguccuuaacacgaucagcaacuucaagcucaauggucucucuaacacagacaguacuuccacagagugccaccucuauagccacucaagacacacaucccagcccaacgaacaggucuaaaagaaaccuugaaauggaaauaaucuugacauugccucaagguuuaaaaaaauauuauggcaaaauacuuaagcuccugcaucuuacuuuagaagaagacacugaaggcuugcuagaaugguguaaaaggaaucucggucuugacugugaugacaccuucuuucaaaaaagaauugaagaauucuuuauaacuggugagggucauuucaaugaaguuuuacaauuuagagcaccaggcacauugagcaccacagagccaacacaugcugggucgccaacagcugaacccuuuaaauccuacuuugcuaaagguuuccuuucaauagauucagguuauuucucugccaaauguuauucaagaacauccaauucagggcuucaguugauuaauguuacccgacacucaacuaggauagcugacacgcccggacccaagaucacuaacuuaaagacuaucaauugcauaaacuuaaaagcauccguauuuaaagaacauagagaguuugaaaucaaugugcuucucccucaaguugcaguuaaccuuucaaauugucacguugcaaucaaaucacaugucugcgauuauucuuuggacacugacggggcgauuaggcuaccucauauucauuaugaaggaacuuuuauuccaggaacuuacaagauagugauagauaaaaaaaacaagcugaaugacagguguacccuauucaccaacugugugauaaaaggaagagaaguucguaagggccagucaguccuaaggcaauauaagacagaaauuagaauugguagagcaucaacugguucuaggagacugcuuuccgaagaaucuggugaugacugcauaucaagaacucagcuauuaaggacagagacugcagagguccauggcgacaacuauggugguccgggugauaagauaaccaucugcaaugguucaacuguuguagaucaaagacuggguagugaacugggguguuacacuaucaauagagugaaguccuuuaagcuaugcgaaaacagugccacagggaagagcugugaaauagacaguaucccaguuaaguguaggcaggguuauugccuaaaaaucacucaggaaggaaggggccauguuaaauuaucuagggguucagaaguugucuuggaugcaugugacucaagcugugaagugaugauaccuaagggcacuggugacauucuaguagauuguucaggugggcagcaacauuuuuuaaaggacaaccugauugaucuaggaugucccaaaauuccauuauugggcaaaauggcuauuuauaucugcagaaugucgaaucaccccaaaacaaccauggccuuucucuuuugguucagcuucggcuaugugauaacuuguauacuuugcaagguaauuuuuuacuuauuaauaauuuuuggaacacuagggaaaagguucaagcaguacagagaguugaaaccccagaccugcaccauaugugagacaacaccugugaaugcaauagaugcugaaaugcaugaucuuaacugcaguuacaauauaugucccuauugugcgucuaggcuaacuucagaugggcucgcuaggcauguaacacaaugcccuaagcggaaggagaagguggaagagaccgaauuguacuugaacuuagagagaauuccuuggguuguaagaaagcuauugcaggugucagaguccacuggcauagcauuaaaaaggagcagcuggcuaauugugcugcuuguguuauucacaguaucaauaacaccgguucaaucagcgcccauuggucacgggaagacaauugaagcguaccgggcuagggaggaauacacaagcauuugucucuuugugcugggaagugucuuguuuguggucucuugucuaaugaaaggacugguugacaguguuggcaauaucuucuuuccugggcuguucauuuguaagacauguucuauagguagcauuaauggcuuugaaauugagucucauaagugcuauuguagcuuguuuuguugcccuuacuguaggcacugcucugcugauagagaaauucaucagcugcacuugagcaucugcaaaaaaaggaagacaggaaguaaugucaugcuggcuguuugcaaacgcauguguuucagaacaacuauggaaguaagcaacaaagcccuauuuguccgaagcaucaucaacaccacuuuuguugugugcauacugauacuagcagucuguguuguuagcacuucagcaguagagauggaaagccuaccagcugggaccugggaaagagaagaagaccuuacaaauuucugccaucaggaaugccaggucacggagacugagugccucugccccuaugaagcucuagugcucagaaggccccuauuucuagauaguauagucaaagguaugaaaaaucugcuaaacucaacaagucuagaaacaagcuuaucaauugaggcaccguggggagcaauuaauguucagucaaccuacaaaccaacuguaucagcagcaaacauagcacucaguuggagcucaguggaacacagaggcaauaagauuuuggucucaggcagaucagaaucaauuaugaagcuggaagaaaggacaggaaucagcugggaucucggcguagaagaugccucugagucuaagcuacuuacagucucagucauggacuugucucagauguacucuccugucuucgaguauuuaucaggugacagacaaguggaagaguggccuaaagcgaccuguacaggugacugcccagaaagauguggcugcacaucaucaaccugcuuacacaaagaguggccccacucaaggaauuggagauguaauccuacuuggugcugggguguagggacuggcugcaccugcuguggauuggaugugaaagaccuuuucacagauuacauguucgucaaguggaaaguugaguacauuaagacagaggccauaguauguguagaacuaaccagucaggaaagacaguguagcuugauugaggcgggcacaagauuuaauuuagguucugugaccauuacauugucagaaccaaggaacauucaacaaaagcucccuccugaaauaaucacacugcauccuagaauugaggaagguuuuuuugaccuaaugcaugugcaaaaagugcuaucagcaagcacaguguguaaguuacaaagcugcacacauggugugccaggagaucuacaggucuaccacauuggaaaccuauuaaaaggggacagaguaaacggacaccuaauucacaaaauugaacaacaccucaacacuucuuggauguccugggaugguugugaucuagacuacuacugcaauaugggagacuggccuucuugcacauauacaggagucacccaacauaaucaugcuucauuuguaaaccugcucaacauugaaacugauuacacaaaaaccuuccacuuucacucuaaaaggguuacugcacauggagacacaccacagcuagaucugaaggcaaggccaaccuauggugcaggugagaucacuguacugguggaaguugccgauauggaguuacacacaaagaagauugaaauaucaggcuugaaguuugcaagccuauccugcacagguuguuaugcuuguaguucuggcaucuccugcaaagucagaauucauguagaugaaccagaugaacuuacaguacauguuaaaagugaugauccagauguaguugcagcuagcucaagucucauggcaaggaagcuugaaucuggaacagacaguacauuuaaagcuuuuucagccaugccuaaaacuuccuugugcuucuacauuguagagagagaauacuguaagggcugcaguaaagaagacacacaaaaauguguuaacacgaaacucgagcaaccacagagcauuuugaucgaacacaagggaacuauaauuggaaagcaaaacaauacuugcacagcuaaggcaaguugcugguuagagucaguuaagaguuuuuuuuauggucugaagaauaugcuuaguggcauuuuuggcaauguuuuuuuaggcauuuucucauuucuugcccccuuuguccuauuaauacuuuucuuuauguuuggguggaggauccuguuuugcuucaaguguugcagaagaaccagaggccuauucaaguacagacaccucaaagacgaugaagaaacugguuacagaaagaucauugaaagacugaacaacaaaaaggggaaaaacaaacugcuugauggugaaaggcuugcugacagaaaaauugccgaacuguucuccacaaaaacacacauuggcuag

SEQ ID NO: 3608 - RNA, 5055 nt, Artificial Sequence
  derived and/or modified CDS sequence (wt) from CCHFV(UCCR4448)__KY484042.1__GP
augcauauaucauuaauguaugcaguccuuugccuacagcuguguggucugggagagacucauggaucacacaaugaaacuggacacaauaaaacagacguuaugacaacucccggugauaaccugagcucugaacagccagugaguacggccuugucuaucacaccugaccccuccacuguuacacccacaacaccagccaguggauuagaaggcucaggggaaguuuacacauccccuccgaucaucaccgagagcuugucccugccagaaaccacaccagagcucucugcuacagccgguauagacacuucaagugcaagugaugucgauucuaguacgcaagcagccagaggcaccuccgcacuaacaguccgcacaagucuacccaacagcccuagcacaccaucuacaccacaagaaacacaccauccugugagaaaucuacuuucagucacgaguccuaggccagaagaaacaucaacaccuucgggaucaggcaaagagagcucagcaacuaguggcccucauccagucuccaacaaaccaccaaccccucccgcaaaaacccagggaccuacugaaaauaacagucacaacgccacugaacaccccgagccccugacacagucagcaacccuaggccuaaugaccucuccaacacagauaguccacccacaaagugccaccuccauaaccguucaagacacauaccccaguccaacaaacaggucuaaaagaaaccuugagauggaaauaaucuugacuuugucucaggguuuaaaaaaguacuauggcaaaauauugaggcuucugcgucucaccuuagaggaggacacugaaggucuacuggaaugguguaagagaaaucuuggucuugauugugaugacacuuucuuucaaaagagaauugaggaauucuucauaacuggugagggccauuuuaaugaaguuuuacaauuuaaaacgccaggcacguugaguacuacagagucgacaccugcugagcugccaacagcugaaccuuuuaaguccuacuucgccaaaggcuuccuuucaauagauucagguuacuauucagccaaauguuacucaggaacaucuaauucagggcuucaauugauuaauauuacccgacauucagcuagaauaguugacacaccugggccuaaggucaccaacuuaaagaccaucaacugcauaaacuugaaggcaucgaucuucaaagaacauagagagguugaaaucaaugugcuucucccucaaguugcaguuaaucucucaaacugucacguuauaaucaaaucacaugucugugacuauucuuuagacauugacgguacggugaggcuuccucacauuuaccaugaaggaguuuucauuccaggaacuuacaaaauagugauagauaaaaaagauaaguugaaugacagaugcaccuuauuuaccgacugugugauaaaaggaagggagguucguaaaggucagucaguuuugaggcaguacaagacggaaaucaggauuggcaaagcaucaaccggcucuagaagauugcuuuccgaagaaaccagugaugacugcauaucaagaacucaacuauugaggacagagacugcagagauccacggcgacaacuaugguggcccgggugacaaaauaaccaucugcaacggcucaacuauuguagaccaaagacuaggcagugagcuaggguguuacacuaucaacagagugaagucauucaagcuaugcgaaaauagugccacagggaagagcugugaaauagacagugucccaguuaaaugcaggcaggguuauugccuaagaaucacucaggaagggaggggccauguaaaauuaucuaggggcucagagguugucuuagaugcaugugauacaagcugugaaauaaugauaccuaagggcacuggugacaucuugguugacuguucaggugggcagcaacauuuucuaaaggacaauuugauagaucuaggaugccccaaaauuccauuauugggcaaaauggcuauuuacauuugcagaaugucgaaucaccccaaaacaaccauggcuuuccucuucugguucagcuuuggcuacgugauaacuuguauacuuugcaaggccaucuucuacuuguuaauaauuauuggaacacuagggaaaagguucaagcaguauagagaguuaaaaccccagaccugcaccauaugugagacaacuccuguaaaugcaauagaugcugagaugcacgaccucaauugcaguuacaacauuugucccuacugugcaucuagacuaaccucagaugggcuugcuaggcauguaacacaaugcccuaagcggaaggagaaaguggaagaaacugaacuguacuugaacuuagaaagaauuccuuggguuguaagaaagcuguugcagguaucagaguccacugguguggcauugaaaagaagcagcuggcugauugugcugcuugugcuguucacgauuucauugucaccaguucaaucagcacccauuagucacgggaagacaauugaggcauaccgggccagggagggauacacaaguauaugucucuuuguacuaggaaguauccuauucauagucucuuaccuaaugaaagggcugguugacaguguuggcaacuccuucuucccuggacuguccauuugcaagacgugcuccacaagcagcauuaauggcuuugaaauugagucccauaagugcuauugcagcuuauucuguugcccuuauuguaggcacugcucugcugauaaagaaauucauaagcugcaccugagcaucugcaaaaaaagaaaaacaggaagcaaugucauguuggcugucugcaagcgcauguguuucagggccaccauggaaguaaguaacagagcccuguuuauccguagcaucaucaacaccacuuuuguuuuguguauacugauacuagcaguuuguguuguuagcaccucagcaguggagauggaaaaccuaccagccgggaccugggaaagagaagaagaccuaacaaauuucugucaucaggaaugucagguuacagagacugaaugccucugcccuuaugaagcucuaguacucagaaagccucuauuccuagauaguauaguuaaaggcaugaaaaaucugcuaaacucaacaaguuuagaaacaaguuuaucaauugaggcaccauggggggcaauaaauguucagucaaccuacaaaccaacugugucaacugcaaacauagcacucaguuggagcucuguggaacacagagguaauaagaucuugguuucaggcagaucagaaucaauuaugaagcuggaagaaaagacaggaaucagcugggaucucggcguagaagacgccucugagucuaaacugcuuacagucucugucauggacuugucucagauguacucuccugucuucgaguacuuaucaggagacagacagguggaagaguggcccaaagcaacuuguacaggugacugcccagaaagaugcggcugcacaucaucaacguguuugcacaaagaauggccccacucaagaaauuggagaugcaaucccacuuggugcugggguguagggacuggcugcaccuguuguggauuagaugugaaagaccuuuuuacagauuauauguuugucaaguggaaaguugaauauauuaagacagaggccauaguguguguagaacuuaccagucaggaaaggcaguguagcuugauugaagcgggcacaagguucaauuuagguccugugaccaucacacugucagaaccaagaaacauccaacagaagcucccuccugaaauaaucacacugcaucccaggaucgaagaagguuuuuuugaccugaugcauguacaaaaaguguuaucggcaagcacaguauguaaguugcagaguugcacacaugguguaccaggagaccuacaggucuaccacaucggaaauuuauugaaaggggauaagguaaauggacaucuaauucauaaaauugagccacacuucaacacuuccuggauguccugggaugguugugaccuggacuacuacugcaacaugggagauuggccuucuugcacauauacaggagucacccaacacaaucaugcuucauuuguaaaccugcucaacauugaaacugauuacacaaaaaacuuccacuuucacucuaaaagggucacugcacauggagacacaccacaacuagaucuuaaggcaagaccaaccuauggugcaggugagaucacuguacugguagaaguugcugacauggaauuacacacaaagaagauugaaauaucaggcuuaaaauuugcaagcuugacuugcacagguuguuaugcuuguagcucuggcaucucaugcaaaguuagaauucauguggaugaaccagaugaacuuacaguacauguuaaaagugaugauccagauguaguugcagcuagcucaagucucauggcaagaaagcuugaauuuggaacagacaguacauuuaaagcuuucucagccaugccuaaaacuucucuauguuucuacauuguugaaagagaacacuguaagagcugcagcgaagaagacacaaaaaaauguguuaacacaaaacuugagcaaccacaaagcauuuugaucgaacacaagggaacuauaaucggaaagcaaaacagcacuugcacagccaaggcgaguugcugguuagagucagucaaaaguuucuuuuauggucuaaagaacaugcuuagugguauuuuuggcaauguuuuuauagguauuuucuuguuccuugcccccuucauccuauuaauacuauucuuuauguuuggguggaagauccuauuuugcuuuaaauguuguagaagaacuagaggccuauucaaguauagacaccucaaggacgaugaagaaacugguuauagaaggauuauugaaagacuaaacaauaaaaaaggaaaaaacaaacugcuugauggugaaauacuugcugauagaagaauugccgaacuguucucuacaaaaacacacauuggcuag

SEQ ID NO: 3609 - RNA, 5055 nt, Artificial Sequence
  derived and/or modified CDS sequence (wt) from CCHFV(UCCR4401)__KY484035.1__GP
augcauauaucauuaauguaugcaauccuuugccuacagcuguguggucugggagagacucauggaucacacaaugaaacuagacacaauaaaacagacaccaugacaacacccggugauaacccgagcucugaaccgccagugagcacggccuugucuauuacacuugaccccuccacugucacacccacaacaccagccaguggauuagaaggcucaggggaagucuacacauccccuccgaucaccaccgggagcuugccccugucggagacaacaccagaacucccuguuacaaccggcacagacaccuuaagcgcaggugaugucgaucccagcacgcagacagccggaggcaccuccgcaccaacaguccgcacaagucuacccaacagcccuagcacaccaucuacaccacaagacacacaccauccugugagaaaucuacuuucagucacgaguccugggccagaugaaacaucaacacccucgggaacaggcaaagagagcucagcaaccaguagcccucauccagucuccaacagaccaccaaccccuccugcaacagcccagggacccacugaaaaugacagucacaacuccacugaacacccugagucccugacacagucagcaaccccaggccuaaugaccucuccaacacagauaguccacccacaaagugccacccccauaaccguucaagacacacaucccaguccaacgaacaggucuaaaagaaaccuuaagauggaaauaaucuugacuuuaucucaggguuuaaaaaaguacuaugggaaaauauuaaggcuucugcaacucaccuuagaggaggacacugaaggucuacuggaaugguguaagagaaaucuuggucuugauugugaugacacuuucuuucaaaagagaauugaagaauucuuuauaacuggugagggccauuuuaaugaaguuuuacaauuuagaacgccaggcacguugagcaccacagagucaacaccugcugggcugccaacagcugaaccuuuuaaguccuacuucgccaaaggcuuccucucgauagauucagguuacuacucagccaaauguuacucaggaacauccaauucagggcuucaauugauuaacauuacccgacauucaacuagaauaguugacacaccugggccuaagaucacuaaccuaaagaccaucaacugcauaaacuugaaggcaucgaucuucaaagaacauagagagguugaaaucaaugugcuucucccccaaguugcaguuaaucucucaaacugucacguuguaaucaaaucacaugucugugacuacucuuuagacauugacggugcggugaggcuuccucacauuuaccaugaaggaguuuucaucccaggaacuuacaaaauagugauagauaaaaaaaauaaguugaaugacagaugcaccuuauuuaccgacugugugauaaaaggaagggagguucguaaaggacagucaguuuugaggcaguacaagacggaaaucaggauuggcaaggcaucaaccggcucuagaagauugcuuucagaagaacccagugaugacuguauaucaagaacucaacuauuaaggacagagacugcagagauccacggcgacaacuaugguggcccgggugacaaaauaaccaucugcaauggcucaacuauuguagaccaaagacugggcagugaacuaggaugcuacaccaucaauagagugaggucauucaagcuaugcgaaaacagugccacagggaagaauugugaaauagacagugucccaguuaaaugcaggcaggguuauugccuaagaaucacucaggaagggaggggccacguaaaauuaucuaggggcucagagguugucuuagaugcaugcgauacaagcugugaaauaaugauaccuaagggcacuggugacauccuaguugacuguucaggugggcagcaacauuuucuaaaggacaauuugauagaucuaggaugccccaaaauuccauuauugggcaaaauggcuauuuacauuugcagaaugucaaaccaccccaaaacaaccauggcuuuccucuucugguucagcuuuggcuauguaauaaccugcauacuuugcaaggccauuuuuuacuuguuaauaauuguuggaacacuagggaaaaggcucaagcaguauagagaguugaaaccucagacuugcaccauaugugagacaacuccuguaaaugcaauagaugcugagaugcaugaccucaauugcaguuacaacauuugucccuacugugcaucuagacuaaccucagaugggcuugcuaggcaugugauacaaugcccuaagcggaaggagaaaguggaagaaacugaacuguacuugaacuuagaaagaauuccuuggguuguaagaaagcuguugcaggugucagagucaacugguguggcauugaaaagaagcaguuggcugauugugcugcuugugcuauucacuguuucauuaucaccaguucaaucagcacccauuggucaagggaagacaauugaggcauaccgggccagggaaggguacacaaguauaugccucuuuguacuaggaaguauccuauuuauaguuucuugccuaaugaaagggcugguugacaguguuggcaacuccuucuucccuggacuguccauuugcaaaacgugcuccauaagcagcauuaauggcuuugaaauugagucccauaagugcuauugcagcuuauucuguugccccuauuguaggcacugcucuaccgauaaagaaauucauaagcugcacuugagcaucugcaaaaaaaggaaaacaggaaguaaugucauguuggcugucugcaagcucauguguuucagggccaccauggaaguaaguaacagagcccuguuuauccguagcaucaucaacaccacuuuuguuuugugcauacugauacuagcaguuuguguuguuagcaccucagcaguggagauggaaaaccuaccagcagggaccugggaaagagaagaagaccuaacaaauuucugucaucaggaaugccagguuacagagacugaaugccucugcccuuaugaagcucuaguacucagaaagccuuuauuccuagauaguacagcuaaaggcaugaaaaaucugcuaaauucaacaaguuuagaaacgaguuuaucaauugaggcaccauggggagcaauaaauguucagucaaccuacaaaccaacugugucaacugcaaacauagcacucaguuggagcucaguggaacacagaggcaauaagaucuugguuucaggcagaucagaaucaauuaugaagcuggaagaaaggacaggaaucagcugggaucucgguguagaagaugccucugaaucuaaacugcuuacaguaucugucauggacuugucucagauguacucuccugucuucgaguacuuaucaggggacagacagguggaagaguggcccaaagcaacuugcacaggugacugcccagaaagauguggcugcacaucaucaaccuguuugcacaaagaauggccucacucaagaaauuggagaugcaaucccacuuggugcugggguguagggacuggcugcaccuguuguggauuagaugugaaagaccuuuuuacagauuauauguuugucaaguggaaaguugaauacaucaagacagaggccauaguguguguagaacuuacuagucaggaaaggcaguguagcuugauugaagcgggcacaagguucaauuuagguccugugaccaucacacugucagaaccaagaaacauccaacaaaaacucccuccugaaauaaucacacugcauccuaggaucgaagaagguuuuuuugaccugaugcaugugcaaaagguguuaucggcaagcacaguguguaaguugcagaguugcacacauggugugccaggagaccuacaggucuaccacaucggaaauuuauuaaaaggggauaagguaaauggacaucuaauucauaaaauugagccacacuucaacaccuccuggauguccugggaugguugugaccuagacuacuacugcaacaugggagauuggccuucuugcacauacacaggggucacccaacacaaucaugcuucauuuguaaacuuacucaacauugaaacugauuacacaaagaacuuccacuuucacucuaaaagggucacugcacacggagauacaccacaacuagaucuuaaggcaagaccaaccuauggugcaggcgagaucacuguucugguagaaguugcugacauggaguuacauacaaagaagauugaaauaucaggcuuaaaauuugcaagcuuagcuugcacagguuguuaugcuuguagcucuggcaucucaugcaaaguuagaauucauguggaugaaccagaugaacuuacaguacauguuaaaagugaugauccagaugugguugcagcuagcucaagucucauggcaaggaagcuugaauuuggaacagacaguacauuuaaagcuuucucggccaugccuaaaacuucucuauguuucuacauuguugaaagagaacacuguaagagcugcagugaagaagacacaaaaaaauguguuaacacaaaacuugagcaaccacaaagcauuuugaucgaacacaagggaacuauaaucggaaagcaaaacagcacuugcacggcuaaggcaaguugcugguuagagucagucaagaguuuuuuuuauggccuaaagaacaugcuuaguggcauuuuuggcaaugucuuuaugggcauuuucuuguuccuugcccccuucauccuguuaauacuauucuuuauguuuggguggaggauccuauucugcuuuaaauguuguagaagaaccagaggccuguucaaguauagacaccucaaagacgaugaagaaacugguuauagaaggauuauugaaaaacuaaacaauaaaaaaggaaaaaacaaacugcuugauggugaaagacuugcugauagaagaauugccgaacuguucucuacaaaaacacacauuggcuag

SEQ ID NO: 3610 - RNA, 5055 nt, Artificial Sequence
  derived and/or modified CDS sequence (wt) from CCHFV(IbAn7620)__KX013451.1__GP
augcauauaucauuaauauaugcaauccuuugccuacagcuguguggucugggagagacuuauggaucacacaaugaaacuagacacaauaaaacagacaccaugacaacaccuggugauaaccugagcucugaaccgccagugagcacggccuuguuuauuacaccugaccccuccacugucacacccacaacaccagccaguggauuagaaggcucaggggaaguuuacacaucuccuccgaucaccaccgggagcuugccccugccagagacaacaccagagcucccugcuacaaccggcacagacacuucaagugcaagugaugucgauuuuagcacgcagacagccggaggcaccuccgcacuaacaguccguacaggucuacccgacagcccuagcacaccaucuacaccacaagacacacaccauccuaugagaaaucuacuuucagucacgaguccugggccagaugaaacaucaacaccuucgggaacaggcagagagagcucagcaacuaguagcccucauccaguuuccaacagaccaccaaccccucccgcaacagcccagggaccuacugaaaaugacagucacaacgccacugaacauccugagucccugacacagucagcaaccccaggccuaaugaccucuccaacacagacaauccacccacaaagugccacccccauaaccguucaagacaaacagccuaguccaacgaacaggucuaaaagaaaccuugaaauggaaauaaucuugacuuugucucagggguuaaaaaaauacuaugggaaaauauuaaggcuucugcaucucaccuuagaggaggacacugaaggucuacuggaaugguguaagagaaaucuuggucuugauugugaugacaauuucuuucaaaagagaauugaagaauucuucauaacuggugagggccauuuuaaugaaguuuuacaauuuagaacgccaggcacguugagcacuacagagucaacaccugcugggcugccaacagcugaaccuuuuaaguccuacuucgccaaaggcuuccuuucaauagauucaggcuacuacucagccaaauguuacucgggaacauccaauucagggcuucaauugauuaacauuacccgacauucaacuagaauaguugacacaccugggccuaagaucacuaacuuaaagaccaucaacugcauaaacuugaaggcaucgaucuucaaagaacauagagagguugaaaucaaugugcuucucccccaaguugcaguuaaucucucaaacugucacguuguaaucaaaucacaugucugugacuacucuuuagacauugacggugcggugaggcuuccucacauuuaccaugaaggaguuuucauuccaggaacuuacaaaauagugauagauaaaaaaaauaaguugaaugacagaugcaccuuauuuaccgacugugugauaaaaggaagggagguucguaaaggucagucaguuuugaggcaguacaagacggaaaucaggauuggcaaagcaucaaccggcucuagaagauugcuuuccgaagaacccagugaugacuguauaucaagaacucaacuauugaggacagagacugcagagauccacggcgacaacuaugguggcccgggugauaaaauaaccaucugcaauggcucaacuauuguagaccaaagacugggcagugaacuaggguguuacaccaucaauagagugaagucauucaagcuaugcgaaaacagugccacagggaagaauugugaaauagacagugucccaguuaaaugcaggcaggguuauugccuaagaaucacucaagaagggaggggccacguaaaauuaucuaggggcucagagauugucuuagaugcaugcgauacaagcugugaaauaaugauaccuaagggcacuggugacauccuaguugacuguucaggugggcagcaacauuuucuaaaggacaauuugauagaucuaggaugcccuaaaauuccauuauugggcaaaauggcuauuuacauuugcagaaugucgaaccaccccaaaacaaccauggcuuuccucuucugguucagcuuugguuauguaauaaccuguauacuuugcaaggccauuuuuuacuuguuaauaauuauuggaacacuagggaaaaggcucaagcaguauagagaguugaaaccucagaccugcaccauaugugagacaacuccuguaaaugcaauagaugcugagaugcaugaccucaauugcaguuacaacauuugucccuacugugcaucuagacuaaccucagaugggcuugcuaggcaugugauacaaugcccuaagcggaaggagaaaguggaagaaacugaacuguacuugaacuuagaaagaauuccuuggguuguaagaaagcuguugcaggugucagagucaacugguguggcauugaaaagaagcaguuggcugauugugcugcuugugcuauucacuguuucauuaucaccaguucaaucagcacccauuggucaagggaagacaacugaggcauaccgggccagggaaggguacacaaguauaugucucuuuguacuaggaaguauccuauuuauaguuucuugccuaaugaaagggcugguugacaguguuggcaacuccuucuucccuggacuguccauuugcaaaacgugcuccauaagcagcauuaauggcuuugaaauugagucccauaagugcuauugcagcuuauucuguugccccuauuguaggcacugcucuaccgauaaagaaauucauaagcugcacuugagcaucugcaaaaagaggaaaacaggaaguaaugucauguuggcugucugcaagcgcauguguuucagggccaccauggaagugaguaacagagcccuguuuauccguagcaucaucaacaccacuuuugucuugugcauacugauacuagcaguuuguguuguuagcaccucagcaguggagauggaaaaccuaccagcagggaccugggaaagagaagaagaucugacaaauuucugucaucaggaaugccagguuacagagacugaaugccucugcccuuaugaagcucuaguacucagaaagccuuuguuccuagauaguauagcuaaaggcaugaaaaauccgcuaaauucaacaaguuuagaaacgaguuuaucaauugaggcaccauggggagcaauagauguucagucaaccuacaaaccaacugugucaacugcaaacauagcacucaguuggagcucaguggaacacagagguaauaagaucuugguuucaggcagaucagaaucaauuaugaagcuagaagaaaggacgggaaucagcugggaucucggcguagaagaugccucugagucuaaacugcuuacagucucugucauggaccugucucagauguacucuccugucuucgaguacuuaucaggggacagacagguggaagaguggcccaaagcaacuuguacaggugauugcccagaaagaugugguugcacaucaucaaccuguuugcacaaagaauggccucacucaagaaauuggagaugcaaucccacuuggugcuggggaguagggacuggcugcaccuguuguggauuagaugugaaagaccuuuuuacagauuauauguuugucaaguggaaaguugaauacaucaagacagaggccauaguguguguagaacuuaccagucaggaaaggcaguguagcuugauugaagcgggcacgagguucaauuuagguccugugaccaucacacugucagaaccaagaaacauccaacaaaaacucccuccugaaauaaucacacugcauccuaggaucgaagaagguuuuuuugaucugaugcaugugcaaaagguguuaucggcaagcacaguguguaaguugcagaguugcacacauggugugccaggagaccuacaggucuaccacaucggaaauuuauuaaaaggggauaagguaaauggacaucuaauucauaaaauugagccacacuucaacacuuccuggauguccugggaugguugugaccuagacuacuacugcaacaugggagauuggccuucuugcacauacacaggggucacccaacacaaucaugcuucauuuguaaacuuacucaacauugaaacugauuacacaaagaacuuccacuuucacucuaaaagggucacugcacacggagacacaccacaacuagaucuuaaggcaagaccaaccuauggugcaggcgagaucacuguucugguagaaguugcuaacauggaguuacauacaaagaagauugaaauaucaggcuuaaaauuugcaagcuugacuuguacagguuguuaugcuuguagcucuggcaucucaugcaaaguuagaauucauguggaugaaccagaugaacuuacaguacauguuaaaagugaugauccagaugugguugcagcuagcucaagucucauggcaagaaagcuugaauuuggaacagacaguacauuuaaagcuuucucggccaugcccaaaacuucucuauguuucuacauuguugaaagagaacacuguaagagcugcagugaagaagauacaaaaaaauguguuaacacaaagcuugagcaaccacaaagcauuuugaucgaacacaagggaacuauaauaggaaagcaaaacagcacuugcacggcuaaggcgaguugcugguuggagucagucaagaguuuuuuuuauggccuaaagaacaugcuuaguggcauuuuuggcaaugucuuuaugggcauuuucuuguuccuugcccccuucauccuguuaauacuauucuuuauguuuggguggaggauccuauucugcuuuaaauguuguagaagaaccagaggccuguucaaguacagacaccucaaagacgaugaagaaacugguuauagaaggauuauugaaagacuaaacaauaaaaaaggaaaaaacaagcugcuugauggugaaagacuugcugauagaagaauugccgaacuguucucuacaaaaacacacauuggcuag

SEQ ID NO: 3611 - RNA, 5055 nt, Artificial Sequence
  derived and/or modified CDS sequence (wt) from CCHFV(Zahedan 2007)__KC867273.1__GP
augcauauaucauugauguaugcaguuuucugcuugcaacugugcggucuagggaagacuaacggaccacacaaugggacugaacacaauaauacacacguuaugacaacgccugaugacagucagagcccugaaccgccagugagcacagccuuaccugucacaccggacccuucaacugucacaccuucaacaccagccagcggauuagaaggcucaggagagguucacacauccucuccaaucaccaccaaggguuugucucugccggaggccacaucugagcccccuucgacuaccagcguggucacuucaagugcaagugauaccgauucuagcacacaggcagccggagacaccccuacaccaacaguccgcacgagucugcccagcagcccuagcacaccauccacaucacaaggcacacacuaucccgugaggagucugcuuucagucacgggcccuaagccugaagaaacaccaacaccgucaaaaucaggcaaagauaacuuagcaaccaacagcccccacccagccaccagcagaccaacaaccccuuccacaauagcccagaaacccacugaaaacaacagccacaacaccaccgaacagcuugaauccuuaacacacuuagcaacuuuagguucaaagaucucuccaacacagacaguccucccacagaguguuaccucuauagccauucaagacauucauaccagcccaacaaauaggucuaaaagaaaccuugauauggaaauaaucuuaacguuaucucaaggucugaaaaaguauuauggcaaaauacuuaagcuccugcgucucaccuuagaggaagacacugaaggcuuguuagaguggugcaagagaaaucucggucuugacugugaugacaccuucuuccaaaaaagaaucgaagaauucuucauaacuggugagggucauuucaaugaaguuuuacaauuuagaacacuaggcacauugaguaccacagagucaacgcaugcuggaucaccaacaguugaacccuucaaauccuacuuugcuaaagguuuccuuucaauagauucagguuauuucucugccaaauguuauucaagaacauccaauucagggcuccaauugauuaauguuacccgacauucaacuaggauagcugacacgccugggcccaagaucacuaaccuaaagaccaucaauugcauaaacuuaaaagcauccgucuuuaaagaacauagagagguugaaaucaaugugcuucucccucaaguugcagucaaccucucaaacugucauguugcaaucaaaucacauaucugugacuauucuuuagacaccgacggggcgauuaggcuuccucaaauucaucaugaaggcacuuuuaucccagguacuuacaaaauagugauagacaaaaaaaguaagcugaaugacagguguacccuauucaccaacugugugauaaaaggaagagaaguucguaaaggccagucaguccuaaggcaauauaagacagaaauuagaauuggcagggcaucaacugguucuaggagacugcuuuccgaagaaucuggugaugacugcauaucaagaacucagcuauugaggacagagacugcagagguccauggcgauaacuauggugguccaggugauaagauaaccaucuguaaugguucaacuguuguagaucaaagacuggguagugaacugggguguuacacuaucaauagagugaggucauucaagcuaugcgaaaacagugccacagggaagagcugugaaauagacaguaucccagucaaguguaagcaggguuuuugccuaaaaaucacucaggaaggaaggggccaugugaaguuaucuagaggcucagaaguugucuuggauguaugugauucaagcugugaagugaugauaccuaagggcacuggugacauucuaguggauuguucaggugggcagcaacauuuuuuaaaagacaaccugguugaccuagggugucccaaaauuccguuacugggcaaaauggcuauuuauaucugcaggaugucgaaucaucccaagacaaccauggccuuccucuuuugguucagcuuuggcuaugugauaacuuguauacuuugcaaggccauuuuuuucuuauuaauaauuuuuggaacacuagggaaaagguucaagcaguacagagaguugaaaccccagaccugcaccauaugugagacaacaccuguaaaugcaauagaugcugaaaugcaugaucucaacugcaguuacaauauaugucccuauugugcgucuagacugacuucagauggacuugcuaggcaugugacacaauguccuagacggaaggagaaaguggaggaaaccgaauuauaccugaauuuagaaagaauucccuggguuguaagaaagcuauugcaggugucagaguccacugguacaguauuaaaaaggagcagcuggcuaauuguauuacuugugcuguucacaguuucauugucaccaguucaaucagcacccauuggucacgggaaaacaauugaaacauaccggguuagggaagaauacacaaguauuugccucuuuguacuaggaaguauccuguuuauagucucuuuucuaaugaaaggacugguugacgguguuggcaacaucuucuuuccugggcuguccgucuguaagacaugcucuauagguagcauuaauggcuuugaaauugagucucauaggugcuacuguagcuuguuuuguugcccuuacuguaggcacugcucugcugauggagaaauccaucagcugcacuugagcaucugcaaaaaaaggaagacaggaaguaacguuaugcuggcuguuugcaaacgcauguguuucagggcaacuauggaaguaagcaacaaaguccuauuuauccguagcauuaucaacaccacuuuuguugugugcauacugauacuagcgguuuguguuguuagcaccucagcaguagagauggaaagccuaccagcugggaccugggaaagagaagaagaccuaacaaauuucugccaucaggaaugccaggucacagagacugagugccucugcccuuaugaagcucuagugcucagaaggccccuauuucuagauaguauagucaaagauaugaaaaaucugcuaaacucaacaagucuagaaacaagcuuaucaauugaggcaccauggggagcaauuaauguucagucaaccuacaaaccaacuguaucaacugcaaacauagcacuuaguuggagcucaguggaacacagaggcaauaagguuuuggucucaggcagaucagaaucaauuaugaagcuggaagaaaggacaggaaucagcugggaucuuggcguggaagaugccucugagucuaagcuacuuacaguuucagucauggacuugucucagauguacucuccugucuucgaguacuuaucaggugacagacaaguggaagaguggccuaaagcaaccugcacaggugacugcccagaaagauguggcugcacaucaucaaccugcuuacacaaagaguggccccacucaaggaauuggagauguaauccuacuuggugcugggguguagggacuggcugcaccuguugugguuuagacgugaaagaccuuuucacagauuacauguucgucaaguggaaaguugaguacauuaagacagaggccauaguauguguagaacuaaccagucaggaaagacaguguagcuugauugaggcgggcacaagauucaauuuagguucugugacuauuacauugucagagccaaggaacauucaacaaaagcucccuccugaaauaaucacacugcaccccaagauugaggaagguuuuuuugaccuaaugcauguacaaaaagugcuaucggcaagcacaguguguaaguugcagaguugcacacauggugugccaggagaucugcaggucuaccacaucggaaaccuauuaaaaggggacagaguaaacggacacuugauucauaaaauugagcaacacuucaacacauccuggaugucuugggaugguugugaccuagacuacuacuguaacaugggagacuggccuuccugcacauauaccggagucacucagcauaaccaugcuucauuuguaaaccugcucaacauugaaacugauuauacaaaaaccuuucacuuucacucuaaaaggguuacugcacauggagacacaccacaacuagaucugaaggcaaggccaaccuauggugcaggugagaucaccgugcuuguggaaguugcugacauggaguuacacacaaagaagauugaaauaucaggcuuaaaauuugcaggccuaacuugcacagguuguuaugcuuguaguucuggcaucucuuguaaaguuagaauucauguagaugaaccagaugaacuuacaguacauguuaaaagugaugacccagauguaguugcagcuagcucaagucucauggcgaggaagcuugaauuuggaacagacaguacauuuaaagcuuucucagccaugccuaaaaccucccuauguuucuacauuguggaaagagaauacuguaagagcugcaguaaagaagauacacaaaaauguguuaacacgaaacucgaacaaccacagagcauuuugaucgaacauaagggaacuauaauuggaaagcaaaacaauacuugcacggcuaaagcgaguugcugguuagagucaguuaagaguuuuuuuuauggucugaagaauaugcucgguggcauauuuggcaauguuuuuauaggcauuuucacauuucuuacccccuuuaucuuguuaauauuuuucuuuauguuuggguggaggauccuguuuugcuucaaguguugcagaagaaccagaggccuauucaaguacagacaccucaaagacgaugaagaaacugguuacagaaagaucauugaaagacugaacaacaaaaagggaaaaaacaggcugcuugauggugaaagacuugcugacagaaagauugcugaacuguucuccacgaaaacacacauuggcuag

SEQ ID NO: 3612 - RNA, 5055 nt, Artificial Sequence
  derived and/or modified CDS sequence (wt) from CCHFV(Afg09-2990)__HM452306.1__GP
augcauauaucauugauguaugcaguuuucugcuugcaacugugcggucuagggaagacuaacggaccacacaaugggacugaacacaauaauacacacguuaugacaacgccugaugacagucagagcccugaaccgccagugagcacagccuuaccugucacgccggauccuucaacugucacaccuucaacaccagccagcggauuagaaggcucaggagagguuuacacauccucuccaaucaccaccaaggguuugucucugccggaggccacaucugagcccccugcgacuaccagcguggucacuucaagugcaagugauaccgauucuagcacacaggcagccggagacacccccacaccaacaguccgcacgagucugcccagcagcccuagcacaccauccacaucacaaggcacacacuaucccgugaggagucugcuuucagucacgagcccuaagccagaagaaacaccaacaccgucaaaaucaggcaaagauaacuuagcaaccaacagcccccacccagccaccagcagaccaacaaccccucccacaacagcccagaaacccacugaaaacaacagccacaacaccaccgaacagcuugaguccuuaacgcauuuagcaacuuuagguucaaugaucucuccaacacagacaguccucccacagaguguuaccucuauagccauucaagacauucauaacagcccaacaaauaggucuaaaagaaaccuugauauggaaauaaucuuaacguuaucucagggucugaaaaaguauuauggcaaaauacuuaagcuccugcaucucaccuuagaggaagacacugaaggcuuguuagaguggugcaagagaaaucucggucuugacugugaugacaccuucuuccaaaaaagaaucgaagaauucuucauaacuggugagggucauuucaaugaaguuuuacaauuuagaacacuaggcacauugaguaccacagagucaacgcaugcuggaucaccaacaguugaacccuucaaauccuacuuugcuaaagguuuccuuucaauagauucagguuauuucucugccaaauguuauucaagaacauccaauucagggcuccaauugauuaauguuacccgacauucaacuaggauagcugacacgccugggcccaagaucacuaaccuaaagaccaucaauugcaugaacuuaaaagcauccgucuuuaaagaacauagagagguugaaaucaaugugcuucucccucaaguugcagucaaccucucaaacugucauguugcaaucaaaucacauaucugugacuauucuuuagacaccgacggggcgauuaggcuuccucaaauucaucaugaaggcacuuuuaucccagguacuuacaaaauagugauagacaaaaaaaguaagcugaaugacagguguacccuauucaccaacugugugauaaaaggaagagaaguucguaaaggccagucaguccuaaggcaauauaagacagaaauuagaauuggcagggcaucagcugguucuaggagauugcuuuccgaagaaucuggugaugacugcauaucaagaacucagcuauugaggacagagacugcagagguccauggcgauaacuauggugguccaggugauaagauaaccaucuguaaugguucaacuguuguagaucaaagacuggguagugaacugggguguuacacuaucaauagagugaggucauucaagcuaugcgaaaacagugccacagggaagagcugugaaauagacaguaucccagucaaguguaagcaggguuauugccuuaaaaucacucaggaaggaaggggccaugugaaguuaucuagaggcucagaaguugucuuggauguaugugauucaagcugugaagugaugauaccuaagggcacuggugacauucuaguagauuguucaggugggcagcaacauuauuuaaaagacaaccugguugaccuagggugucccaaaauuccguuacugggcaaaauggcuauuuauaucugcaggaugucgaaucaccccaagacaaccauggccuuccucuuuugguucagcuuuggcuaugugauaacuuguauacuuugcaaggccauuuuuuucuuauugauaauuuuuggaacacuagggaaaagguucaagcaguacagagaguugaaaccccagaccugcaccauaugugagacaacaccuguaaaugcaauagaugcugaaaugcaugaucucaacugcaguuacaauauaugucccuauugugcgucuagacugacuucagaugggcuugcuaggcauguaacacaauguccuagacggaaggagaaaguggaggaaaccgaauuauaccugaauuuagagagaauucccuggguuguaagaaagcuauugcaggugucagaguccacugguacaguauuaaaaaggagcagcuggcuaauuguauuacuugugcuguucacaguuucauugucaccaguucaaucagcacccauuggucacgggaaaacaauugaaacauaccggguuagggaagaauacacaaguauuugccucuuuguacuagggaguauccuguuuauagucucuuuucuaaugaaaggacugguugacgguguuggcaacaucuucuuuccugggcuguccgucuguaagacaugcucuauagguagcauuaauggcuuugaaauugagucucauaagugcuacuguagcuuguuuuguugcccuuacuguaggcacugcucugcugauggagaaauccaucagcugcacuugagcaucugcaaaaaaaggaagacaggaaguaauguuaugcuggcuguuugcaaacgcauguguuucagggcaacuauggaaguaagcaacaaagcccuauuuauccguagcauuaucaacaccacuuuuguugugugcauacugauacuagcgguuuguguuguuagcaccucagcaguagagauggaaagcuuaccagcugggaccugggaaagagaagaagaccuaacaaauuucugccaucaggaaugccaggucacagagacugagugccucugcccuuaugaagcucuagugcucagaaggccccuauuucuagauaguauagucaaagguaugaaaaaucugcuaaacucaacaagucuagaaacaagcuuaucaauagaggcaccguggggagcaauuaauguucagucaaccuacaaaccaacuguaucaacugcaaacauagcacuuaguuggagcucaguggaacacagaggcaauaagguuuuggucucaggcagaucagaaucaauuaugaagcuggaagaaaggacaggaaucagcugggaucuuggcguggaagaugccucugagucuaagcuacuuacaguuucaguuauggacuugucucagauguacucuccugucuucgaguacuuaucaggugacagacaaguggaagaguggccuaaagcaaccuguacaggugacugcccagaaagauguggcugcacaucaucaaccugcuuacacaaagaguggccccacucaaggaauuggagauguaauccuacuuggugcugggguguagggacuggcugcaccuguugugguuuagaugugaaagaccuuuucacagauuacauguucgucaaguggaaaguugaguacauuaagacagaggccauaguauguguagaacuaaccagucaggaaagacaguguagcuugauugaggcgggcacaagauucaauuuagguucugugacuauuacauugucagaaccaaggaacauucaacaaaagcucccuccugaaauaauuacacugcaccccaagauugaggaagguuuuuuugaccuaaugcauguacaaaaagugcuaucggcaagcacaguguguaaguugcagaguugcacacauggugugccaggagaucugcaggucuaccacaucggaaaccuauuaaaaggggacagaguaaacggacaccugauucauaaaauugagcaacacuucaacacauccuggaugucuugggaugguugugaccuagacuacuacuguaacaugggagacuggccuuccugcacauauaccggagucacucagcauaaccaugcuucauuuguaaaccugcucaacauugaaacugauuauacaaaaaccuuucacuuucacucuaaaaggguuacugcacauggagacacaccacaacuagaucugaaagcaaggccaaccuauggugcaggugagaucaccgugcugguggaaguugcugacauggaguuacacacaaagaagauugaaauaucaggcuuaaaauuugcaggccuaacuugcacagguuguuaugcuuguaguucuggcaucucuuguaaaguuagaauucauguagaugaaccagaugaacuuacaguacauguuaaaagugaugacccagauguaguugcagcuagcucaagucucauggcgaggaagcuugaauuuggaacagacaguacauuuaaagcuuucucagccaugccuaaaaccucccuauguuucuacauuguggaaagagaauacuguaagagcugcaguaaagaagauacacaaaaauguguuaacacgaaacucgaacaaccacagagcauuuugaucgaacauaagggaacuauaauuggaaagcaaaacaauacuugcacggcuaaagcgaguugcugguuagagucaguuaagaguuucuuuuauggucugaagaauaugcucgguggcauauuuggcaauguuuuuauaggcauuuucacauuucuuacccccuuuaucuuguuaauacuuuucuuuauguuuggguggaggauccuguuuugcuucaaguguugcagaagaaccagaggccuauucaaguacagacaccucaaagacgaugaagaaacugguuacagaaagaucauugaaagacugaacaacaaaaaaggaaaaaacaggcugcuugauggugaaagacuugcugacagaaagauugcugaacuguucuccacaaaaacacacauuggcuag

SEQ ID NO: 3613 - RNA, 5055 nt, Artificial Sequence
  derived and/or modified CDS sequence (wt) from CCHFV(SPU41/84)__AY900142.1__GP
augcauauaucauuaauguaugcaguucuuugccuacagcuguguggucugggggagacucauggaucacauaauggaacuagauacaauaauacagacgcuacgacaacgcccggugauagccagagcccugaaccgccagugagcacggccucguccaucacacacaaccccuccacugucacauccacaacaccaaccagcggaucugaaggcucaggggaaguuuacacauccucuccaaucaccaccgagggccuaucuccaccggggaccacuccagagcucccagccacaaccgguauagacacuucaggugcaagugaugccaaccccagcacacaggcagccagaggcaccucugcacuaacaguccacacaaguuugcccagcagcccuagcacaccaccuauaucacaagacacacaccacccugugaggaaccuacuuucaguuacgagcccuaugccagaagagacaacagcaccuucggguucaggcaaggagagcucagcaaccagcagcccccauccagcuuccgacagaccaccaaccccucccgcaacagcccaggggcucacugaaaguaacagucacaacgccaccgaacaucuugagucccugacacagucagcaaccccaggccuaguaaccucuccagcacagacaguccacccacauagcgcaaccuccauagccgcuccagacacacaccccaacccaacaaacagaucuaaaagaaaccuugaaauggaaauaaucuugaccuugucucagggcuuaaaaaaauacuacggcaaaauacucagacuucugcaucuuaccuuggaagaagacacugaaggucuacuggaaugguguaagaggaaucuuggucuugauugugaugacaccuucuuucaaaagaggauugaagaauucuucauaacuggugagggccauuuuaaugaaguuuuacaauuuagaacgccaggcacagugagcacuacagagucaacacaugcuggaccgccaacagcugaacccuuuaaguccuauuucgcuaaaggcucccuuucaauagauucagguuacuauucagccaaauguuacucaggaacaucuaauucagggcuucagcugaucaacauuacccgacauucaacuaaaauagcugacacaccugggccuaagaucacuaacuugaagaccaucaacugcauaaacuuaaaggcauugaccuucaaagaacacagagagguugaaaucaauguacuucucccucaaguugcaguuaaucucucaaauugucauguuguaaucaaaucacaugucugugacuacucuuuggacauugacgggacggugaggcucccucacauucaucaugaagguauuuucauuccaggaacuuauaaaauagugauagauaagaaaaacaagaugaaugacagauguacccuauucaccaacugugugauaaaagggagggagguucguaaaggccagucaguuuugaagcaguacaagacagaaaucaggauuggcaaggcaucaaccggcucuagaagauugcucuccgaggagucuagcgacgacugcauaucaagaacucaacuauugaggacagagacugcagagauccacggcgauaacuaugguggcccaggugacaagauaaccaucugcaauggcucaacuguuguagaccagagacuggguagugagcugggguguuacacuaucaauagaguaaagacauucaaacuaugcgaaaacagugcuacagggaagaguugugagauagauagugucccaguuaaaugcaggcaggguuauugccuaaaaaucacucaggaaggaaggggccauguaaaauuaucuagaggcucagagguugucuuggaugcaugugauacaagcugugaaguaaugauacccaaaggcacuggugacauccuaguugacuguucaggugggcagcaacauuuucuaaaagacaaucuaauagaccuaggaugccccaaaauuccauuacuggguaaaauggcuauuuacauuugcagaaugucgaaucaccccaaaacaacuauggcuuuccucuucugguucagcuuuggcuaugugauaacuuguauaauuuguaaggucauuuuuuacuuguuaauaauuguuggaacacuaggaaaaagguucaagcaguacagagaguuaaaaccucagaccugcaccauaugugagacaacuccugugaaugcaauagaugcugagaugcaugaccucaauugcaguuacaacauaugucccuauugugcaucuagacuaaccucagacgggcuugcuaggcaugugacacagugcccuaagcggaaggaaaaaguggaggaaacugaauuguacuugaacuuggagagaauucccuggguugugagaaagcuguugcagguaucagaguccacugguguggcauugaaaaggagcagcuggcugguugugcugcuggugcuguugacgguuucauugucaccgguucagucagcgcccauuagucaugggaagacaguugaggcauaccgggcaagagagggguacacaaguaugugucucuuugugcugggaaguguccuguuuuuagucuccugucuaaugaaaggacugguugacagugucggcaacaccuucuucccuggacuguccauuugcaaaacgugcucuauaagcagcauuaauggcuuugaaauugagucucauaggugcuauugcagcuuguuuuguugcccauauuguaggcacugcucugcuaauaaagaaauucaucagcugcacuugagcaucugcaaaaaaaggaaagcaggaaguaaugucaugcuggcugucugcaagcgcaugugcuuuagggccaccauggaaguaagcaacagagcccuguuuauccguagcaucaucaacaccacuuuuguuuuaugcauacugauacuagcagccuguguugucagcaccucagcaguggagauggaaagccuaccagccgggaccugggagagagaagaagaccuaacaaacuucugucaucaggaaugccaaguugcggauacugaaugccucugcccuuaugaagcucuagugcucagaagaccucuauucuuagauaguauaguuaagggcaugaaaaauuugcuaaacucaacaaguuuagagacaaguuuaucaauugaggcaccauggggagcaauaaauguucagucaaccuacaaaccaacuguaucaacugcaaacauagcgcuuaguuggagcucaguggaacacagaggcaauaagauacugguuucaggcagaucagaaucaauuaugaagcuggaagaaaggacaggaauaagcugggaucucgguguggaagacgccucugagucuaaacugcuuacagucucugucauggacuugucucagauguacucaccugucuucgaguacuuaucaggagacagacagguggaggaguggcccaaagcaacuuguacgggugacugcccagaaagauguggcugcacaucaucaaccugcuugcacaaagaauggccccacucaagaaauuggagauguaaucccacuuggugcugggguguaggaacuggcugcaccuguuguggauuagacgugaaagaccucuuuacagauuauauguuugucaaguggaaaguugaauacauuaagacagaagcaauaguguguguagaacuuacuagucaggaaagacaguguagcuugauugaagcgggcacaagguucaacuuggguccugugaccaucacauugucagaaccaagaaacauccagcaaaagcucccaccugaaauaaucacacugcaucccaggauugaggaggguuuuuuugaccugaugcauguacaaaaaguguugucggcaagcacaguguguaaguugcagaguugcacacauggugugccaggagaucuacaggucuaccacaucggaaauuuacuaaaaggggauaagguaaaugggcaccuaguucauaaaauugagccacacuucaauacuucuuggauguccugggaugguugugaucuagacuauuauugcaacaugggagauuggccuucuugcacauacacaggaguuacccagcacaaucaugccucauuuguaaacaugcucaacauugaaacugauuacacaaaaaacuuccacuuucacucuaaaagggucacugcacacggagacacaccacaacuagaucuuaaagcaagaccaaccuauggugcaggugagaucacuguauugguggagguugcugacauggaguuacacacaaagaagauugaaauaucaggcuuaaaauuuacuagcuugacuuguacagguuguuaugcuuguaguucuggcaucucaugcaaaguuagaauucauguggaugaaccagaugagcuuacagugcauguuaaaagugaagauccagauguuguugcagcuagcucaagucucauggcaagaaagcuugaauuuggaacagacaguacauuuaaagcuuuuucagccaugccuaaaacuucucuauguuucuacauuguggaaagagaauacuguaagagcugcagugaagaagacacacaaaaauguguuaacacaaaacuugagcagccacagagcauuuugaucgaacguaagggaacuauaaucgggaagcaaaacaacacuugcaaggcuaaggcggguugcugguuagagucaguuaagaguuuuuuuuacggccuaaagaacaugcucaguggcauuuuuggcaauguauuuauaggcauuuucuuauuccuugcccccuucauccuguuaauacuauucuuuauguuuggguggaggaucuuguuuuguuuuaaguguuguagaagaaccagaggccuguucaaguacagacaccugaaagacgaugaagaaacugguuauagaaagaucauugaaagacuaaacaacaaaaaagggaaaaauaaacugcuugauggugaaagacuugcugauagaagaauugccgaacuguucucuacaaaaacacacauuggcuag

SEQ ID NO: 3614 - RNA, 5055 nt, Artificial Sequence
  derived and/or modified CDS sequence (wt) from CCHFV(SPU103/87)__DQ211634.1__GP
augcauauaucauuaauguaugcaguucuuugccuacagcuguguggucuggggggagcucauggaucacauaauggaacuagauacaauaauacaggcgcuuugacaacgcucggugauggccagagcucugaaccgccagugagcacggccccauccaccacacacaaccccuccacugucacauccacaacaccagcuagcgggucugaaggcucaggggaaguuuacacagccucuccagucaccaccgagggccugucuccaccggggaccacuccagagcuccccgccacaaccgguauagacacuucaggugcaagugaugccgaccccagcacacaggcagccggagacaccucugcacuaacaguccgcacaaguuugcccagcagcccuagcacacugccuacaucacaagacacacaccauccugugaggaaccuacuuucaguuacgagcccuaggccagaagagacaacagcaccuucagguucaggcauagagagcucagcaaccagcagcccccauccagcuuccgacagaccaccaaccccucccgcagcagcccagggacccacugaaaguaacagucacaacgccaccgaacaucuugagucccugacacagucagcaaccccagaucuaguaaccucuccagcacagacaguccacccacagagcgccaccuccauagccgcuccagacacacaccccagcccaacaaacagaucuaaaagaaaccuugaaguggaaauaaucuugaccuugucucaggguuuaaaaaaauacuacggcaaaauacuuaggcuucugcaucuuaccuuggaggaggacacugaaggucuacuggaaugguguaagagaaaucuuggccuugauugugaugacacuuucuuucaaaaaagaauugaagaauucuucauaacuggggagggccauuuuaaugaaguuuuacaauuuagaacgccaggcacaguaagcacuacagagucaacacaugcuggaccgccaacagcugaacccuuuaaguccuauuuugcuaaaggcuuccuuucaauagauucagguuacuauucagccaaauguuacucaggaacaucuaauucagggcuucaguugaucaauauuacccgacauucaacuagaauagcugacacaccugggccuaagaucacuaacuuaaagaccaucaacugcauaaacuuaaaggcauugaccuucaaagaacacagagagguugaaaucaaugugcuucucccucaaguugcaguuaaucucucaaauugucauguuguaaucaaaucacaugucugugacuacucucuagacaucgacgggacggugaggcucccucacauucaucaugaaggaauuuucaucccaggaacuuauaaaauagugauagauaaaaaaaacaagcugaaugacagauguacccuauucaccgacugugugauaaaaggaagggagguucguaaaggccagucaguuuugaagcaguacaagacagaaaucaggauuggcaaggcaucaaccggcucuagaagauugcucuccgaggagucuagcgacgacuguauaucaagaacucaacuauugaggacagagacugcagagauccacggcgauaacuaugguggcccaggugacaagauaaccaucugcaauggcucaacuauuguagaccagagacuggguagugagcugggguguuacacuaucaauagaguaaagacauucaaacuaugcgaaaacagugcuacagggaagaguugugaaauagauagugucccaguuaaaugcaggcaggguuauugccuaaaaaucacucaggaaggaaggggucauguaaaauuaucuagaggcucagagguugucuuagaugcaugugacacaagcugugaaguaaugauacccaaaggcacuggugacauccuaguugacuguucaggugggcagcaacauuuucugaaagacaaucugauagaucuaggaugccccaaaauuccauugcuggguaaaauggcuauuuauauuugcagaaugucgaaucaccccaaaacaacuauggcuuuccucuucugguucagcuuuggcuaugugauaacuuguguacuuugcaaggccauuuuuuacuuguuaauaauuguuggaacacuaggaaaaaggcucaagcaguacagagaguuaaaaccucagaccugcaccauaugugagacaacuccugugaaugcaauagaugcugagaugcaugaccucaauugcaguuacaacauaugucccuauugugcaucuagacuaaccucagacgggcuugcuaggcaugugacacagugcccuaagcggaaggaaaaaguggaggaaacugaauuguacuugaacuuggaaagaauuccuuggguugugagaaggcuguugcagguaucagaguccacugguguggcauugaaaagaagcagcuggcugauugugcuacuggugcuguucacgguuucauugucaccgguucagucagcgcccauuagucaugggaagacaguugaggcauaccaggccagagagggguacacaggcaugugucucuuugugcugggaaguauccuguuuuuagucucuugucuaaugaaaggacugguugacagugucggcaacaccuucuucccuggacuguccauuugcaaaacgugcucuauaagcagcauuaauggcuuugaaauugagucgcauaggugcuauugcagcuuguuuuguugcccauacuguagacacugcucugcuaauaaagaaauucaucagcugcacuugagcaucugcaaaaaaaggaaaacaggaagcaaugucaugcuggcugucugcaagcgcaugugcuuuagggccaccauggaaguaagcaacagagcccuguuuauccguagcaucaucaacaccacuuuuguuuuaugcauacugauacuagcaguuuguguuguuagcaccucagcaguggagauggaaagccuaccagccggaaccugggagagagaagaagaccuaacaaauuucugucaucaggaaugccaaguuacggauacugaaugccucugcccuuaugaggcucuagugcucagaagaccccuauucuuagauaauauaguuaaaggcaugaaaaauuugcuaaacucaacaaguuuggagacaaguuuaucaauugaggcaccauggggagcaauaaauguucagucaaccuacaaaccaacuguaucaacugcaaacauagcgcuuaguuggagcucaguagaacacagaggcaauaagauacugguuucgggcagaucagaaucaauuaugaagcuggaagaaaggacaggaauaagcugggaucucgguguagaagacgccucugagucuaaacugcuuacagucucugucauggacuugucacagauguacucaccugucuucgaguacuuaucaggagacagacagguggaagaguggcccaaagcaacuuguacgggugauugcccagaaagauguggcugcacaucaucaaccugcuuacauaaagaauggccccauucaaggaauuggagauguaaccccacuuggugcugggguguagggacuggcugcaccuguuguggauuagacgugaaagaccucuuuacagauuauauguuugucaaguggaaaauugaauacauuaaaacagaagcaauaguguguguagaacuuacuagucaggaaagacaguguagcuugauugaagcgggcacaagguucaauuugggucccgugaccaucacauugucagaaccaagaaacauccagcaaaagcucccuucugaaauaaucacacugcaucccaggauugaggaggguuuuuuugaccugaugcauguacaaaaaguguugucggcaagcacaguguguaaguugcagaguugcacacauggugugccaggagaucuacaggucuaccacaucggaaauuuauuaaaaggggauaagguaaauggacaccuaguucauaaaauugagccacacuucaauacuucuuggauguccugggaugguugugaucuagacuauuauugcaacaugggagauuggccuucuugcacauacacaggaguuacccagcacaaucaugcuucauuuguaaaccugcucaacauugaaacugauuacacaaaaaacuuccacuuucacucuaaaagggucacugcacacggagacacaccacaacuggaucuuaaggcaagaccaaccuauggugcaggugagaucacuguauugguggaaguugcugacauggaguuacacacaaagaagauugaaauaucaggcuuaaaauuuacaagccugacuuguacaggcuguuaugcuuguaguucuggcaucucaugcaaaguuagaauucauguggaugaaccagaugaacuuacagugcauguuaaaagugaugauccagauguuguugcagcuagcucaagucucauggcaagaaagcuugaauuuggaacagacaguacauuuaaggcuuuuucagccaugccuaaaacuucucuauguuucuacauuguggaaagagaauacuguaagagcugcagugaagaagacacacaaaaauguguuaacacaaaacuugagcagccacagagcauuuugaucgaacauaaggguacuauaaucgggaagcaaaacaacacuugcaaggcuagggcggguugcugguuagagucaguuaagaguuuuuuuuacggccuaaagaacaugcucaguggcauuuuuggcaauguauuuauaggcauuuucuuauuucuugcccccuucauccuauuaauacuauucuuuauguuuggguggaggaucuuguuuuguuuuaaguguuguagaagaacuagaggccuguucaaguauagacaccugaaagacgaugaagaaacugguuauagaaagaucauugaaagacuaaacaacaaaaaagggaaaaauaaacugcuugauggugaaagacuugcugauagaagaauugccgaacuguucucuacaaaaacacacauuggcuag

SEQ ID NO: 3615 - RNA, 5055 nt, Artificial Sequence
  derived and/or modified CDS sequence (wt) from CCHFV(Iran-53)__DQ446216.1__GP
augcauauaucauugauguaugcaguuuucugcuugcaacugugcggucuagggaagacuaacggaccacacaaugggacugaacacaauaauacacacguuaugacaacgccugaugacagucagagcccugaaccgccagugagcacagccuuaccugucacaccggacccuucaacugucacaccuucaacaccagccagcggauuagaaggcucaggagagguuuacacauccucuccaaucaccaccaaggguuugucucugccggaggccacaucugagcccccugcgacuaccagcguggucacuucaagugcaagugacaccgauucuagcacacaggcagccggaggcaccccuacaccaacaguccgcacgagucugcccagcagcccuagcacaccauccacaucacaaggcacacacuaucccgugaggagucugcuuucagucacgagcccuaagccagaagaaacaccaacaccgucaaaaucaggcaaagauaacuuagcaaccaacagcccccacccagccaccagcagaccaacagccccucccacaacagcccagaaacccacugaaaacaacagccacaacaccaccgaacagcuugaguccuuaacacacuuagcaacuuuagguucaaugaucucuccaacacagacaguccucccacagaguguuaccucuauagccauucaagacauucauaccagcccaacaaauaggucuaaaagaaaccuugauguggaaauaaucuuaacguuaucucagggccugaaaaaguauuauggcaaaauacuuaagcuccugcaucucaccuuagaggaagacacugaaggcuuguuagaguggugcaagagaaaucucggucuugacugugaugacaccuucuuccaaaaaagaaucgaagaauucuucauaacuggugagggucauuucaaugaaguuuuacaauuuagaacacuaggcacauugaguaccacagagucaacgcaugcuggaucaccaacaguugaacccuucaaauccuacuuugcuaaagguuuccuuucaauagauucagguuauuucucugccaaauguuauucaagaacauccaauucagggcuccaauugauuaauguuacccgacauucaacuaggauagcugacacgccugggccuaagaucacuaaccuaaagaccaucaauugcauaaacuuaaaagcauccgucuuuaaagaacauagggagguugaaaucaaugugcuucucccucaaguugcagucaaccucucaaacugucauguugcaaucaaaucacauaucugugacuauucuuuagacaccgacggggcaauuaggcuuccucaaauucaucaugaaggcacuuuuaucccagguacuuacaaaauagugauagacaaaaaaaguaagcugaaugacagguguacccuauucaccaacugugugauaaaaggaagagaaguucguaaaggccagucaguccuaaggcaauauaagacagaaauuagaauuggcagggcaucaacugguucuaggagauugcuuuccgaagaaucuggugaugacugcauaucaagaacucagcuauugaggacagagacugcagagguccauggcgauaacuauggugguccaggugauaagauaaccaucuguaaugguucaacuguuguagaucaaagacuggguagugaacugggguguuacacuaucaauagagugaggucauucaagcuaugcgaaaacagugccacagggaagagcugugaaauagacaguaucccagucaaguguaagcaggguuauugccuaaaaaucacucaggaaggaaggggccaugugaaguuaucuagaggcucagaaguugucuuggauguaugugauucaagcugugaagugaugauaccuaagggcacuggugacauucuaguagauuguucaggugggcagcaacauuuuuuaaaagacaaccugguugaccuagggugucccaaaauuccguuacugggcaaaauggcuauuuauaucugcaggaugucgaaucaccccaagacaaccauggccuuccucuuuugguucagcuuuggcuaugugauaacuuguauacuuugcaaggccauuuuuuucuuauuaauaauuuuuggaacacuagggaaaagguucaagcaguacagagaguuaaaaccccagaccugcaccauaugugagacaacaccuguaaaugcaauagaugcugaaaugcaugaucucaacugcaguuacaauauaugucccuauugugcgucuagacugacuucagaugggcuugcuaggcaugugacacaauguccuagacggaaggagaaaguggaggaaaccgaauuauaccugaauuuagagagaauucccuggguuguaagaaagcuauugcaggugucagaguccacugguacaguguuaaaaaggagcagcuggcuaauuguauuacuugugcuguucacaguuucauugucaccaguucaaucagcacccauuggucacgggaaaacaauugaaacauaccggguuagggaagaauacacaaguauuugccucuuuguacuaggaaguauccuguuuauagucucuuuucuaaugaaaggacugguugacgguguuggcaacaucuucuuuccugggcuguccgucuguaagacaugcucuauagguagcauuaauggcuuugaaauugagucucauaagugcuacuguagcuuguuuuguugcccuuacuguaggcacugcucugcugauggagaaauccaucagcugcacuugagcaucugcaaaaaaaggaaaacaggaaguaauguuaugcuggcuguuugcaaacgcauguguuucagggcaacuauggaaguaagcaacaaggcccuauuuauccguagcauuaucaacaccacuuuuguugugugcauacugauacuagcgguuuguguuguuagcaccucagcaguagagauggaaagccuaccagcugggaccugggaaagagaagaagaccuaacaaauuucugccaucaggaaugccaggucacagagacugagugccucugcccuuaugaagcuuuagugcucagaaggccccuauuucuagauaguauagucaaagguaugaaaaaucugcuaaacucaacaagucuagaaacaagcuuaucaauugaggcaccauggggagcaauuaauguucagucaaccuacaaaccaacuguaucaacugcaaacauagcacuuaguuggagcucaguggaacacagaggcaauaagguuuuggucucaggcagaucagaaucaauuaugaagcuggaagaaaggacaggaaucagcugggaucuuggcguggaagaugccucugagucuaagcuacuuacaguuucagucauggacuugucucagauguacucuccugucuucgaguacuuaucaggugacagacaaguggaagaguggccuaaagcaaccugcacaggugacugcccagaaagauguggcugcacaucaucaaccugcuuacacaaagaguggccccacucaaggaauuggagauguaauccuacuuggugcugggguguagggacuggcugcaccuguugugguuuagaugugaaagaccuuuucacagauuacauguucgucaaguggaaaguugaguacauuaagacagaggccauaguauguguagaacuaaccagucaggaaagacaguguagcuugauugaggcgggcacaagauucaauuuagguucugugacuauuacauugucagaaccaaggaacauucaacaaaagcucccuccugaaauaaucacacugcaccccaagauugaggaagguuuuuuugaccuaaugcauguacaaaaagugcuaucggcaagcacaguguguaaguugcagaguugcacacauggugugccaggagaucugcaggucuaccacaucggaaaccuauuaaaaggggacagaguaaacggacaccugauucauaaaauugagcaacacuucaacacauccuggaugucuugggaugguugugaccuagacuacuacuguaacaugggagacuggccuuccugcacauauaccggagucacucagcauaaccaugcuucauuuguaaaccugcucaacauugaaacugauuauacaaaaaccuuucacuuucacucuaaaaggguuacugcacauggagacacaccacagcuagaucugaaggcaaggccaaccuauggugcaggugaggucaccgugcugguggaaguugcugacauggaguuacacacaaagaagauugaaauaucaggcuuaaaauuugcaggccuaacuugcacagguuguuaugcuuguaguucuggcaucucuuguaaaguuagaauucauguagaugaaccagaugaacuuacaguacauguuaaaagugaugacccagauguaguugcagcuagcucaagucucauggcgaggaagcuugaguuuggaacagacaguacauuuaaagcuuucucagccaugccuaaaaccucccuauguuucuacauuguggaaagagaauacuguaagagcugcaguaaagaagauacacaaaaauguguuaacacgaaacucgaacaaccacagagcauuuugaucgaacauaagggaacuauaauuggaaagcaaaacaauacuugcacggcuaaagcgaguugcugguuagagucaguuaagaguuuuuuuuauggucugaagaauaugcucgguggcauauuuggcaauguuuuuauaggcauuuucacauuucuuacccccuuuaucuuguuaauacucuucuuuauguuuggguggaggauccuguuuugcuucaaguguugcagaagaaccagaggccuauucaaguacagacaccucaaagacgaugaagaaacugguuacagaaagaucauugaaagacugaacaacaaaaagggaaaaaacaggcugcuugauggugaaagacuugcugacagaaagauugcugaacuguucuccacaaaaacacacauuggcuag

SEQ ID NO: 3616 - RNA, 5055 nt, Artificial Sequence
  derived and/or modified CDS sequence (wt) from CCHFV(Iran-52)__DQ446215.1__GP
augcauauaucauugauguaugcaguuuucugcuugcagcugugcggucuagggaagacuaacggaccacacaaugggacugaacacaauaauacacacguuaugacaacgccugaugacagucagagcccugaaccgccagugagcacagccuuaccugucacaccggacccuucaacugucacaccuucaacaccagccagcggauuagaaggcucaggagagguuuacacauccucuccaaucaccaccaaggguuugucucugccggaggccacaucugagcccccugcgacuaccagcguggucacuucaagugcaagugauaccgauucuagcacacaggcagccggagacacccccacaccaacaguccgcacgagucugcccagcagcccuagcacaccauccacaucacaaggcacacacuaucccgugaggagucugcuuucagucacgagcccuaagccagaagaaacaccaacaccgucaaaaucaggcaaagaugacuuagcaaccaacagcccccacccagccaccagcagaccaacaaccccucccacaacagcccagaaacccacugaaaacaacagccacaacaccaccgaacagcuugaguccuuaacacacuuagcaacuuuagguuuaaugaucucuccaacacagacaguccucccacagaguguuaccucuauagccauucaagacauucauaacagcccaacaaauaggucuaaaagaaaccuugauauggaaauaaucuuaacguuaucucagggucugaaaaaguauuauggcaaaauacuuaagcuccugcaucucaccuuagaagaagacacugaaggcuuguuagaguggugcaagagaaaucucggucuugacugugaugacaccuucuuccaaaaaagaaucgaagaauucuucauaacuggugagggucauuucaaugaaguuuuacaauuuagaacacuaggcacauugaguaccacagagucaacgcaugcuggaucaccgacaguugaacccuucaaauccuacuuugcuaaagguuuccuuucaauagauucagguuauuucucugccaaauguuauucaagaacauccaauucagggcuccaauugauuaauguuacccgacauucaacuaggauagcugacacgccugggcccaagaucacuaaccugaagaccaucaauugcaugaacuuaaaagcauccgucuuuaaagaacauagagagguugaaaucaaugugcuucucccucaaguagcagucaaccucucaaacugucauguugcaaucaaaucacauaucugugacuauucuuuagacaccgacggggcaauuaggcuuccucaaauucaucaugaaggcacuuuuaucccagguacuuacaaaauagugauagacaaaaaaaguaagcugaaugacagguguacccuauucaccaacugugugauaaagggaagagaaguucguaaaggccagucaguccuaaggcaauauaagacagaaauuagaauuggcagggcaucaacugguucuaggagauugcuuuccgaagaaucuggugaugacugcauaucaagaacucagcuauugaggacagagacugcagagguccauggcgauaacuauggugguccaggugauaagauaaccaucuguaaugguucaacuguuguagaucaaagacuggguagugaacugggguguuacacuaucaauagagugaggucauucaagcuaugcgaaaacagugccacagggaagagcugugaaauagacaguaucccagucaaguguaagcaggguuauugccuaaaaaucacucaggaaggaaggggccaugugaaguuaucuagaggcucagaaguugucuuggauguaugugauucaagcugugaagugaugauaccuaagggcacuggugacauucuaguagauuguucaggugggcagcaacauuuuuuaaaagacaaccugguugaccuagggugucccaaaauuccguuacugggcaaaauggcuauuuauaucugcaggaugucgaaucaccccaagacaaccauggccuuccucuuuugguucagcuuuggcuaugugauaacuuguauacuuugcaaggccauuuuuuucuuauuaauaauuuuuggaacacuagggaaaagguucaagcaguacagagaguugaaaccccagaccugcaccauaugugagacaacaccuguaaaugcaauagaugcugaaaugcaugaucucaacugcaguuacaauauaugucccuauugugcgucuagacugacuucagaugggcuugcuaggcaugugacacaauguccuagacggaaggagaaaguggaggaaaccgaauuauaccugaauuuagagagaauucccuggguuguaagaaagcuauugcaggugucagaguccacugguacaguauuaaaaaggagcagcuggcuaauuguauuacuugugcuguucacaguuucauugucaccaguucaaucagcacccauuggucacgggaaaacaauugaaacauaccggguuagggaagaauacacaaguauuugccucuuuguacuaggaaguauccuguuuauagucucuuuucuaaugaaaggacugguugacgguguuggcaacaucuucuuuccugggcuguccgucuguaagacaugcucuauagguagcauuaauggcuuugaaauugagucucauaagugcuacuguagcuuguuuuguugcccuuacuguaggcacugcucugcugauggagaaauccaucagcugcacuugagcaucugcaaaaaaaggaaaacaggaaguaauguuaugcuggcuguuugcaaacgcauguguuucagggcaacuauggaaguaagcaacaaggcccuauuuauccguagcauuaucaacaccacuuuuguugugugcauacugauacuagcgguuuguguuguuagcaccucagcaguagagauggaaagccuaccagcugggaccugggaaagagaagaagaccuaacaaauuucugccaucaggaaugccaggucacagagacugagugccucugcccuuaugaagcucuagugcucagaaggccccuauuucuagauaguauagucaaagguaugaaaaaucugcuaaacucaacaagucuagaaacaagcuuaucaauugaggcaccauggggagcaauuaauguucagucaaccuacaaaccaacuguaucaacugcaaacauagcacuuaguuggagcucaguggaacacagaggcaauaagguuuuggucucaggcagaucagaaucaauuaugaagcuggaagaaaggacaggaaucagcugggaucuuggcguggaagaugccucugagucuaagcuacuuacaguuucagucauggacuugucucagauguacucuccugucuucgaguacuuaucaggugacagacaaguggaagaguggccuaaagcaaccugcacaggugacugcccagaaagauguggcugcacaucaucaaccugcuuacacaaagaguggccccacucaaggaauuggagauguaauccuacuuggugcugggguguagggacuggcugcaccuguugugguuuagaugugaaagaccuuuucacagauuacauguucgucaaguggaaaguugaguacauuaagacagaggccauaguauguguagaacuaaccagucaggaaagacaguguagcuugauugaggcgggcacaagauucaauuuagguucugugacuauuacauugucagaaccaaggaacauucaacaaaagcucccuccugaaauaaucacacugcaccccaagauugaggaagguuuuuuugaccuaaugcauguacaaaaagugcuaucggcaagcacaguguguaaguugcagaguugcacacauggugugccaggagaucugcaggucuaccacaucggaaaccuauuaaaaggggacagaguaaacggacaccugauucauaaaauugagcaacacuucaacacauccuggaugucuugggaugguugugaccuagacuacuacuguaacaugggagacuggccuuccugcacauauaccggagucacucagcauaaccaugcuucauuuguaaaccugcucaacauugaaacugauuauacaaaaaccuuucacuuucacucuaaaaggguuacugcacauggagacacaccacagcuagaucugaaggcaaggccaaccuauggugcaggugagaucaccgugcugguggaaguugcugacauggaguuacacacaaagaagauugaaauaucaggcuuaaaauuugcaggccuaacuugcacagguuguuaugcuuguaguucuggcaucucuuguaaaguuagaauucauguagaggaaccagaugaacuuacaguacauguuaaaagugaugacccagauguaguugcagcuagcucaagucucauggcgaggaagcuugaguuuggaacagacaguacauuuaaagcuuucucagccaugccuaaaaccucccuauguuucuacauuguggaaagagaauacuguaagagcugcaguaaagaagauacacaaaaauguguuaacacgaaacucgaacaaccacagagcauuuugaucgaacauaagggaacuauaauuggaaagcaaaacaauacuugcacggcuaaagcgaguugcugguuagagucaguuaagaguuuuuuuuauggucugaagaauaugcucgguggcauauuuggcaauguuuuuauaggcauuuucacauuucuuacccccuuuaucuuguuaauacuuuucuuuauguuuggguggaggauccuguuuugcuucaaguguugcagaagaaccagaggccuauucaaguacagacaccucaaagacgaugaagaaacugguuacagaaagaucauugaaagacugaacaacaaaaagggaaaaaacaggcugcuugauggugaaagacuugcugacagaaagauugcugaacuguucuccacaaaaacacacauuggcuag

SEQ ID NO: 3617 - RNA, 5055 nt, Artificial Sequence
  derived and/or modified CDS sequence (wt) from CCHFV(75024)__AB069671.1__GP
augcauauaucauugaugugugcaguucuuugcuugcagcuguauggucugggggaaacucauggaucaagcaaugaaacugaacacaacaaaacaaacguugugacaacgcccggugacagccagagcccugaaccgcuagugagcacgacccugccugucacgcuggacuccuccacugucacacccacaacaccggcuaguggaccagaaggcucgggggaaguuuacacaucccccccaaucaccacugagggccugucuccgucagaagccacgucagagcuccccgcgacaacuggcauaggcaucucaagugcaagugaugucgauuccagcacacaggcagccggagacaccuccacaccaacaguacgcacaaguccaccuaacagcucuagcacaccacccacaucacaagauacacaccauccuaugaggaauuuacuuucagucacgagccuuaagccagaagaaacaucagcaccgucaaaaucaggcaaagagaguccagcagccagcagcccucacccagucgccagcagaccaccaaccccucccacaacagcucagggacccauugaaaacaacagccauaacaccacuggacagcuugagucugugacacaaucggcaacccuaggcccaauggccucuccaacacagacaguccucucacaaaaugucaccuccauagccauucaagacacacaccccagcccaacaaauaggucuaaaagaaaccuugaaauggagauaaucuuaacuuuaccucaagguuuaaagaaauacuauggcaaggugcucaggcuuuugcaacucaccuuagaggaggacacugaaggccuacuagaaugguguaagagaaaucuuggucuugacugugaugauaccuucuuucaaaagagaauugaagaguucuucauaacuggugagggucauuucaaugaaguuuuacaauuuagaacaccaggcacauugagcaccacagagucaacacaugcugagucaccaacagcugaacccuuuaaguccuauuucgcuaaaggcuuccuuucaauagauucagguuacuucucagccaaauguuacucaagaacaucuaauucagggcuucaguugaucaaugucacucgacauucaacuagaauagcugauacaccugggcccaagauuaccaaccuaaagaccaucagcugcauaaacuuaaaggcaucagucuucaaagaacauagagagguugaaaucaaugugcuucucccucaaguugcaguuaaccucucaaacugucacguuacaaucaaaucacaugucugugacuauucuuuagacauugacgggacagugaggcuuccucacauucaucaugaaggaaccuuuauuccaggaacuuacaagauagugauagacaaaaaaaauaagcugaaugacagaugcacccuauucacuaacuguguaauaaaagggagggaaguucguaaaggccaaucuguuuugaggcaauauaagacagagauuaggauuggcaaggcaucaacugguucuagaagauugcuuucugaagaaucuggugaugacugcauaucaagaacucagcuauugaggacagagacugcagagauccauggugauaacuauggcgguccgggugacaagauuacuauuugcaaugguucgacaauuguagaucaaagacuggguagugagaugggguguuacacuaucaauagggugaagucauucaagcugugcgaaaacagugcaacagggaagagcugugaaauagacaguaucccaguuaagugcaggcaggguuauugccuaaaaaucacucaggaaggaaggggccaugugaaauuauccaggggcucagagguugucuuggaugcaugcgacucaagcugugaaguaaugauaccuaagggcacaggugacauccugguagacuguucaggugggcagcaacauuuuuugaaggacaacuuaauugaucuaggaugucccaguauuccauuacuggguaaaauggcuauuuauauuugcagaaugucgaaucacccuaagacaaccauggcuuuccucuuuugguucaguuuuggcuaugugauaacuuguauacucugcaaggcuauuuucuacuuauuaauaauuguuggaacgcuagggaagagguuuaagcaguacagagaguuaaaaccccagaccuguaccauaugugagacaacuccugcaaaugcaauagaugcugaaaugcaugaccuuaacugcaguuacaacauaugucccuauugugcaucuagacuaaccucagacgggcuugcuaggcaugugacacaaugcccuaagcggaaggagaaaguagaagaaacugaauuguacuugaacuuagagagaauucccuggguuguaagaaagcuguugcagguaucggaguccaccgguguugcauuaaaaagaagcagcuggcugauugugcugcuugugcuguucgcaauuucauuaucaccaguucaaucagcacccaucggucaugggaagacaauugaaacauaccaggccagggaggaauacacaagcaucugccucuuuguacuaggaaguauccuguuuauagucucuugucuaaugaaagggcugguugacaguauuggcaacaucuucuucccugggcuguccauuugcaaaacgugcucuauagguaguaucaauggcuuugaaauugagucucauaagugcuauuguagcuugcuuuguugccccuauuguaggcauuguucugcugauagagaaauucaucagcugcacuugagcaucugcaaaaaaagaaaaacaggaaguaauguuaugcuugcagucugcaagcgcaugugcuucagagcaacuauggaagugagcaauaaggcccuacuuauccguaguaucaucaacaccacuuuuguugugugcauauuaauacuagcagucuguguuguuagcaccucagcaguugagauggaaagccuaccagcugggaccugggaaagagaagaagaccuaacaaauuucugucaucaggaaugccagguuacggagacugagugccucugcccuuaugaagcccuaguacucagaaggcccuuguuccuggacaguauaguuagaggcaugaaaaaucagcuaaacucaacaaguuuagaaacaagcuuaucgauugaggcaccauggggagcaauaaauguucagucaaccuacaaaccaacugugucaacugcaaacauagcacuuaguuggagcucaguugaacacagagguaauaagauuuugguuucaggcagaucagaaucaauuaugaagcuggaagaaaggacaggaaucagcugggaccuuggcguagaagaugccucugaaucuaagcuacuuacagucucugucauggacuugucucagauguacucuccugucuucgaguacuuaucaggugacagacaaguagaagaguggcccaaggcaaccuguacaggagacugcccagaaagauguggcugcacaacaucaaccugcuugcauaaagaauggccccauucaagaaacuggagauguaaucccacuuggugcugggggguggggacuggcugcacuuguuguggauuagaugugaaagaccuuuuuacagauuauaugauugucaaguggaaaguugaauacauuaaaacagaggccauaguguguguggaacucaccagucaggaaaggcaguguagcuugauugaggcaggcacaagguucaauuuagguucugugaccaucacauugucagaaccgaggaacauucaacaaaagcucccuccugaaauaaucacauugcauccuaggauugaagaagguuuuuuugaccugaugcauguacaaaaaguguugucagcuagcacaguguguaaguugcagaguugcacacacggugugccaggugaucuacaggucuaccaugucggaaauuuauuaaaaggagauaaggugaauggacaccuaauucauaaaauugagccacacuuaaacacuuccuggauguccugggauggcugugaucuagacuacuauugcaacaugggagacuggccuucuuguacauauaccggaguuacccaacacaaucaugcuucauuuguaaaccugcucaacauugaaacugacuauacaaaaagcuuccacuuucacucuaaaaggguuacugcacacggagacacaccacaauuagaucugaaggcaagaccaaccuacggcgcaggagaaaucacuguacugguagaaguugcugacauggaguucacaccgaagaagauugaaauaucaggccuaaaauuugcaagccugacuugcacaggcuguuaugcuuguaguucuggcauuuccugcaaaguuaggauucauguggaugaaccagaugaacuuacaguacauguuaagagugaugauccagauguaguagcagcuagcucaagucucauggcaaggaagcuugaguuuggaacagacaguacauuuaaagcuuucucagcuaugcccaaaacuuccuuauguuucuacauugucgaaagggaguacuguaagagcugcaguaaagaagacacacaaaaauguguuaacacaaaacuugagcaaccacagagcauuuugaucgaacauaagggaacuauaauuggaaagcaaaacaauaccugcacagccaaagcaaguugcugguuagagucgguuaaaaguuucuuuuauggucuaaagaacaugcuuaguggcauuuuuggcaaucuuuuuaugggcaucuucuuauuucuugcccccuucaucuuguuaauacuuuucuuuauguuuggauggaggauccuguuuugcuuuaaguguugcagaagaaccaggggccuguucaaguauagacaucucaaagacgaugaagaaacugguuacaggaggaucauugaaagacugaacaacaagaaggggaagaacaagcugcuugauggugaaagacuugccgauagaagaauugccgaacuauucuccacaaaaacacacauuggcuag

SEQ ID NO: 3618 - RNA, 5055 nt, Artificial Sequence
  derived and/or modified CDS sequence (wt) from CCHFV(7803)__AB069672.1__GP
augcauauaucauugaugugugcaguucuuugcuugcagcuauauggucugggggaaacucauggaucaagcaaugaaacugaacacaacaaaacaaacguugugacaacgcccggugacagccagagcccugaaccgcuagugagcacgacccugccugucacgcuggacuccuccacugucacacccacaacaccggccagugaaccagaaggcucgggggaaguuuacacaucccccccaaucaccacugagggccugucuccgucagaagccacgucagagcuccccgugacaacuggcauaggcaucucaagugcaagugaugucgauuccagcacacaggcagccggagacaccuccacaccaacaguacgcacaaguccaccuaacagcccuagcacaccacccacaucacaagauacacaccauccuaugagaaauuuacuuucagucacgagccuuaagucagaagaaacaucagcaccgucaaaaucaggcaaagagaguccagcagccagcagcccucacccagucgccagcagaccaccaacccaucccauaacagcucagggacccacugaaaacaacagccauaacaccacuggacagcuugagucugugacacaaucggcaacccuaggcccaauggccucuccaacacagacaguccucucacaaaaugucaccuccauagccauucaagacacacaccccagcccaacaaauaggucuaaaagaaaccuugaaauggagauaaucuuaacuuuaccucaagguuuaaagaaauacuauggcaaggugcucaggcuuuugcaacucaccuuagaggaggacacugaaggccuacuagaaugguguaagagaaaucuuggucuugacugugaugauaccuucuuucaaaagagaauugaagaguucuucauaacuggugagggucauuucaaugaaguuuuacaauuuagaacgccaggcacauugagcaccacagagucaacacaugcugagucaccaacagcugaacccuuuaaguccuauuucgcuaaaggcuuccuuucaauagauucagguuacuucucagccaaauguuacucaagaacaucugauucagggcuucaguugaucaaugucacucgacauucaacuagaauagcugauacaccugggcccaagauuaccaaccuaaagaccauaagcugcauaaacuuaaaggcaucagucuucaaagaacauagagagguugaaaucaaugugcuucucccucaaguugcaguuaaccucucaaacugucacguuacaaucaaaucacaugucugugacuauucuuuagacauugacgggacagugaggcuaccucacauucaucaugaaggaaccuuuauuccaggaacuuacaagauagugauagacaaaaaaaauaagcugaaugacagaugcacccuauucacuaacuguguaauaaaagggagggaaguucguaaaggccaaucuguuuugaggcaauauaagacagagauuaggauuggcaaggcaucaacugguucuagaagauugcuuucugaagaaucuggugaugacugcauaucaagaacucagcuauugaggacagagacugcagagauccauggugauaacuauggugguccgggugacaagauuacuauuugcaaugguucgacaauuguagaucaaagacuggguagugagaugggguguuacacuaucaauagggugaagucauucaagcugugcgaaaacagugcaacagggaagagcugugaaauagacaguaucccaguuaagugcaggcaggguuauugccuaaaaaucacucaggaaggaaggggccaugugaaauuauccaggggcucagagguuaucuuggaugcaugcgacucaagcugugaaguaaugauaccuaagggcacaggugacauccugguagacuguucaggugggcagcaacauuuuuugaaggacaacuuaauugaucuaggaugucccaguauuccauuauuggguaaaauggcuauuuauauuugcagaaugucgaaucacccuaagacaaccauggcuuuccucuuuugguucaguuuuggcuaugugauaacuuguauacucugcaaggcuauuuucuacuuauuaauaauuguuggaacgcuagggaagagguuuaagcaguacagagaguuaaaaccccagaccuguaccauaugugagacaacuccugcaaaugcaauagaugcugaaaugcaugaccuuaacugcaguuacaacauaugucccuauugugcaucuagacuaaccucagacgggcuugcuaggcaugugacacaaugcccuaagcggaaggagaaaguagaagaaacugaauuguacuugaacuuagagagaauucccuggguuguaagaaagcuguugcagguaucggaguccaccgguguugcauuaaaaagaagcagcuggcugauugugcugcuugugcuguucgcaauuucauuaucaccaguucaaucagcacccaucagucaugggaagacaauugaaacauaccaggccagggaggaauacacaagcaucugccucuuuguacuaggaaguauccuguuuauagucucuugucuaaugaaagggcugguugacaguauuggcaacaucuucuucccugggcuguccauuugcaaaacgugcucuauagguaguaucaauggcuuugaaauugagucucauaagugcuauuguagcuugcuuuguugccccuauuguaggcauuguucugcugauagagaaauucaucagcugcacuugagcaucugcaaaaaaagaaaaacaggaaguaauguuaugcuugcagccugcaagcgcaugugcuucagagcaacuauggaggugagcaauaaggcccuacuuauccguaguaucaucaacaccacuuuuguuguguacauauugauacuagcagucuguguuguuagcaccucagcaguugagauggaaagccuaccagcugggaccugggaaagagaagaagaccuaacaaauuucugucaucaggaaugccagguuacggagacugagugccucugcccuuaugaagcccuaguacucagaaggcccuuguuccuggacaguauaguuagaggcaugaaaaauccgcuaaacucaacaaguuuagaaacaagcuuaucgauugaggcaccauggggagcaauaaauguucagucaaccuacaaaccaacugugucaacugcaaacauagcacuuaguuggagcucaguugaacacagagguaauaagauuuugguuucaggcagaucagaaucaauuaugaagcuggaagaaaggacaggaaucagcugggaccuuggcguagaagaugccucugaaucuaagcuacuuacagucucugucauggacuugucucagauguacucuccugucuucgaguacuuaucaggugacagacaaguagaagaguggcccaaggcaaccuguacaggagacugcccagaaagauguggcugcacaacaucaaccugcuugcauaaagaauggccccauucaagaaacuggagauguaaucccacuuggugcugggggguggggacuggcugcacuuguuguggauuagaugugaaagaccuuuuuacagauuauaugauugucaaguggaaaguugaauacauuaaaaccagaggcauaguguguguggaacucaccagucaggaaaggcaguguagcuugauugaggcgggcacaagguucaauuuagguucugugaccaucacauugucagaaccgaggaacauucaacaaaagcucccuccugaaauaaucacauugcauccuaggauugaagaagguuuuuuugaccugaugcauguacaaaaaguguugucagcuagcacaguguguaaguugcagaguugcacacacggugugccaggugaucuacaggucuaccaugucggaaauuuauuaaaaggagauaaggugaauggacaccuaauucauaaaauugagccacacuuaaacacuuccuggauguccugggauggcugugaccuagacuacuacugcaacaugggagacuggccuucuuguacauauaccggaguuacccaacacaaucaugcuucguuuguaaaccugcucaacauugaaacugacuauacaaaaagcuuccacuuucacucuaaaaggguuacugcacacggagacacaccacaauuagaucugaaggcaagaccaaccuacggcgcaggagaaaucacuguacugguagaaguugcugacauggaguucacaccgaagaagauugaaauaucgggccuaaaauuugcaagccugacuugcacaggcuguuaugcuuguaguucuggcauuuccugcaaaguuaggauucauguggaugaaccagaugaacuuacaguacauguuaagagugaugauccagauguaguagcagcuagcucaagucucauggcaaggaagcuugaguuuggaacagacaguacauuuaaagcuuucucagcuaugcccaaaacuuccuuauguuucuacauugucgaaagggaguacuguaagagcugcaguaaagaagacacacaaaaauguguuaacacaaaacuugagcaaccacagagcauuuugaucgaacauaagggaacuauaauuggaaagcaaaacaauaccugcacagccaaagcaaguugcugguuagagucgguuaaaaguuucuuuuauggucuaaagaacaugcuuaguggcauuuuuggcaauuuuuuuaugggcaucuucuuauuucuugcccccuucaucuuguuaauacuuuucuuuauguuuggauggaggauccuguuuugcuuuaaguguugcagaagaaccaggggccuguucaaguauagacaucucaaagacgaugaagaaacugguuacaggaggaucauugaaagacugaacaauaagaaggggaagaacaagcugcuugauggugaaagacuugccgauagaagaauugccgaacuauucuccacaaaaacacacauuggcuag

SEQ ID NO: 3619 - RNA, 5055 nt, Artificial Sequence
  derived and/or modified CDS sequence (wt) from CCHFV(Hodzha)__AY223476.1__GP
augcauauauuauugaugugugcaguacuuugccugcagcaguauggucugggggagacucauagaccaaacaacggaaccgaacacaacaaaacaaacguuuugacaacgcccggcgacaaacugagcccugaacugccaguaagcacagccuugucuguuacgccagacuccuccacugucacacccacaacaccagucaguggacuggaaggcucgggggacguguacacaucccccccagucaccaccaagggccugucuccgucgaaggccacgucagagcuccccgcgucuucaggcauagacaccucaagugcaagugaugucgauuccagcacacaggcagccagagacaccucaacacuaacaguccgcacaaguccaccuagcagcccuagcacaccaccuacaucacaagauacauaccaucuugugaggaaucuacuuucagucacgagccccuggccagaagaaacaacagcaccgucaaaaucaggcaaagagaguccaguagccaacagcccucacccagucaccagcagaccaucauccccucccauaacaguccaaggacccacugaaaacagcagccacaacaccaccggacagcuugaguccauggcacaaucaacaacccuagucccaauggccucuccaacacagacaguccucucacagagugucaccuccuuagccguucaagacgcacaccccagcccaacaaacaggucuaaaagaaaccuugaaauggugauaaucuuaacuuuaccucaggguuuaaaaaaauacuaugguaaggugcucaggcuuuugcaacucaccuuagaggaggacacugaaggccugcuagaaugguguaagagaaaucuuggucuugauugugaugauacuuucuuucaaaagagaauugaagaauucuucauaacaggugagggucauuucaaugaaguuuuacaauuuaaaacaccaagcacauugagcaccacagagucaacacaugcugugucaccaacagcugaacccuuuaaauccuauuucgccaaaggcuuccuuucaauagauucagguuacuucucagccaaauguuauucaaaaacaucuaauucagggcuucaguugaucaaugucacucgacauucaacuagaauagcugacacaccugggcccaagaucaccaaccuaaaaaccaucagcugcauaaauuugaaggcaucagucuucaaagaacauagagagguugaaaucaaugugcuucucccucaaguugcagucaaccucucaaacugucacguuacuaucaaaucacaugucugugacuauucuuuagacguugaugggacagugaggcuuccucacauccaucauggaggaaccuucauuccaggaacuuacaagauagugauagacaaaaaaaacaagcugaaugacagauguacccuauacaccaacugugugauaaaagggagagaaguucguaaaggccaaucaauuuugaggcaguauaagacagagauuaggauuggcaaggcaucaacugguucuagaagacugcuuucugaagaaucuggugacgacugcauaucaagaacucagcuacugaggacagagacugcagagauccauggugaugauuauggugguccgggcgacaagauuaccauuugcaaugguucaacuauuguagaucaaagacuagguagugaacugggguguuacacuaucaauagagugaagucauucaagcugugcaaaaacagugcaacagggaagagcugugaaauagacagcaccccaguuaaaugcaggcaggguuauugccuaaaaaucacucaggaaggaaggggccaugugaaauuauccaggggcucggagguugucuuggaugcaugcgauucaagcugugaaguaaugauaccuaagggcacaggugacauccuaguagacuguucaggugggcagcaacauuuuuugaaagacaacuuaauugaucuaggaugucccagaauuccauuauuagguaaaauggcuauuuauauuugcagaaugucgaaucacccuaagacaaccauggcuuuccucuuuugguucaguuuuggcuaugugauaaccuguauacucugcaaggccauuuucuacuuauuaauaauuguuggaacacuagggaagagguucaagcaguauagagaguuaaaaccccagaccuguaccauaugugagacaacuccugcaaaugcaauagaugcugaaaugcaugaccuuaacugcaguuacaacauaugucccuauugugcaucuagacuaaccucagaugggcuugcuaggcaugugacacaaugcccuaagcggaaggagaagguagaagaaacugaauuguacuugaacuuagagagaauucccuggauuguaagaaagcuguugcaggugucggaguccacugguguugcauuaaaaagaagcagcuggcugauugugcugcuugugcuguucgcaguuucauuaucaccuguucaaucagcacccauuggucaugggaagacaauugaaacauaccaggccagggaagauuacacaaguauuugccucuuuguacugggaagcaucuuguuuauagucucuugucugaugaaagggcugguugacaguauuggcaacaucuucuucccugggcugaccaucugcaagacaugcucuauagguaguaucaauggcuuugaaauugagucucacaagugcuauuguagcuuacuuuguugccccuacuguaggcacugcucugcugauagagaaauucaucagcugcacuugagcaucugcaaaaaaaggaaaacaggaaguaaugucaugcucgcagucugcaagcgcaugugcuucagagcaacuauggaagugagcaauaaggcccuacuuauccguagcaucaucaacaccacuuuuguugugugcauauugauauuagcagucuguguuguuagcaccucagcgguagagauggaaagccuaccagcugggaccugggaaagagaagaagaccuaacaaauuucugucaucaggaaugccagguuacagagacugagugccucugcccuuaugaagcccuugugcucagaaggccccuguuccuggauaguauaguuaaaggcacgaaaaaucuguuaaacuccacaaguuuagaaacaagcuugucgauugaggcaccauggggggcaauaaauguucagucaaccuacaaaccaacuguaucaacugcaaacauagcacuuaguuggaguucaguugaacacagagguaauaagauuuugguuucaggcagaucagaaucaauuaugaagcuggaagaaagaacaggaaucagcugggaucuuggcguugaagaugccucugaaucuaagcuacuuacugucucugucauggacuugucucagauguacuccccugucuucgaguacuuaucgggugacagacaaguagaagaguggcccaaagcaaccugcacaggugacugcccagaaagauguggcugcacaucaucaaccugcuuacauaaagaauggccccauucacgaaacuggagaugcaaucccacuuggugcugggggguggggacuggcugcaccuguuguggauuagaugugaaagaccuauuuacagauuauauguucgucaaguggaaaguugauuacauuaaaacagaggccauaguguguguagaacucaccagucaggaaaggcaguguagcuugguugaggcgggcacaagguucaauuuagguccuguaaccaucacauugucagaaccgaggaacauacaacaaaagcucccuccugaaauaaucacauugcauccuaggauugaagaagguuuuuuugaccugaugcauguacaaaaagugcugucagcaagcacaguguguaaauugcagaguugcacacauggugugccaggagaucuacaggucuaccacaucggaaauuuauuaaaaggggauaaagugaacggacaccuaauucauaaaauugagccgcacuucaauacuuccuggauguccugggauggcugugaccuagacuacuacugcaacaugggagacuggccuucuugcacauauaccggaguuacccaacacaaucaugcuucauuuguaaaccugcucaacauugaaacugacuauacaaaaagcuuccacuuucacucuaaaaggguuacugcacauggagacacaccacaauuggaucugaaggcaagaccaaccuacggcgcaggagaaaucacuguacugguagaaguugcugauauggaguuacacacaaagaagaucgaaauaacaggccuuaaauuugcaagccugacuugcacagguuguuaugcuuguaguucaggcaucuccugcaaaguuaggauucacguggaugaaccagaugagcuaacaguacauguuaaaagugaugacccagauguaguugcagccagcucaagucucauggcaaggaaacuugaguuuggaacagacaguacauucaaagcuuucucagccaugccuaaaacuuccuuaugcuucuacauugucgaaagggaguacuguaagagcugcaguaaagaagacacacagaaauguguuaacacaaaacuugagcaaccacagagcauuuugaucgaacgcaagggaacuauaaucggaaagcaaaacaauacuugcacagccaaggcaaguugcugguuagagucaguuaaaaguuucuuuuauggucuaaagaacaugcuuaguggcauuuuuggcaauguuuuuguaggcauuuucuuauuucuugcccccuuuaucuuguuaauacuuuucuucauguuuggauggaggauccuguuuugcuucaaguguugcagaagaaccaggggccuguuuaaguauaaacaucucaaagacgaugaagaaacugguuacagaaggaucauugaaagacugaacaacaagaaggggaaaaacaagcugcuugacggugaaagacuugccgauagaaggauugccgaacuauucuccacaaaaacacacauuggcuag

SEQ ID NO: 3620 - RNA, 5055 nt, Artificial Sequence
  derived and/or modified CDS sequence (wt) from CCHFV(Hodzha)__KX013448.1__GP
augcauauauuauugaugugugcaguacuuugccugcagcaguauggucugggggagacucauagaccaaacaacggaaccgaacacaacaaaacaaacguuuugacaacgcccagcgacaaacugagcccugaaccgccaguaagcacagccuugucuguuacgccagacuccuccacugucacacccacaacaccagucaguggacuggaaggcucgggggaaguguacacaucccccccagucaccaccaagggccugucuccgucgaaggccacgucagagcuccccgcgacaacuggcauagacaccucaagugcaagugaugucgauuccagcacacaggcagccagagacaccucaacacuaacaguccgcacaaguccaccuagcagcccuagcacaccaccuacaucacaagauacauaccaucuugugaggaaucuacuuucagucacgagccccaggccagaagaaacaacagcaccgucaaaaucaggcaaagagaguccaguagccaacagcccucacccagucaccagcagaccaucauccccucccauaacaguccaaggacccacugaaaacagcagccacaacaccaccggacagcuugaguccauggcacaaucaacaacccuagucccaauggccucuccaacacagacaguccucucacagagugucaccuccuuagccguucaagaugcacaccccagcccaacaaacaggucuaaaagaaaccuugaaauggagauaaucuuaacuuuaccucaggguuuaaaaaaauacuaugguaaggugcucaggcuuuugcaacucaccuuagaggaggacacugaaggccugcuagaaugguguaagagaaaucuuggucuugauugugaugauacuuucuuucaaaagagaauugaagaauucuucauaacuggugagggucauuucaaugaaguuuuacaauuuaaaacaccaagcacauugagcaccacagagucaacacaugcugugucaccaacagcugaacccuuuaaauccuauuucgccaaaggcuuccuuucaauagauucagguuacuucucagccaaauguuauucaaaaacaucuaauucagggcuucaguugaucaaugucacucgacauucaacuagaauagcugacacaccugggcccaagauuaccaaccuaaaaaccaucagcugcauaaauuugaaggcaucagucuucaaagaacauagagagguugaaaucaaugugcuucucccucaaguugcagucaaccucucaaacugucacguuacuaucaaaucacaugucugugacuauucuuuagacguugaugggacagugaggcuuccucacauccaucauggaggaaccuucauuccaggaacuuacaagauagugauagacaaaaaaaacaagcugaaugacagauguacccuauacaccaacugugugauaaaagggagagaaguucguaaaggccaaucaauuuugaggcaguauaagacagagauuaggauuggcaaggcaucaacugguucuagaagacugcuuucugaagaaucuggugacgacugcauaucaagaacucagcuacugaggacagagacugcagagauccauggugaugauuauggugguccgggcgacaagauuaccauuugcaaugguucaacuauuguagaucaaagacuagguagugaacugggguguuacacuaucaauagagugaagucauucaagcugugcgaaaacagugcaacagggaagagcugugaaauagacagcaccccaguuaaaugcaggcaggguuauugccuaaaaaucacucaggaaggaaggggccaugugaaauuauccaggggcucggagguugucuuggaugcaugcgauucaagcugugaaguaaugauaccuaagggcacaggugacauccuaguagacuguucaggugggcagcaacauuuuuugaaagacaacuuaauugaucuaggaugucccagaauuccauuauuagguaaaauggcuauuuauauuugcagaaugucgaaucacccugagacaaccauggcuuuccucuuuugguucaguuucggcuaugugauaaccuguauacucugcaaggccauuuucuacuuauuaauaauuguuggaacacuagggaagagguucaagcaguauagagaguuaaaaccccagaccuguaccauaugugagacaacuccugcaaaugcaauagaugcugaaaugcaugaccuuaacugcaguuacaacauaugucccuauugugcaucuagacuaaccucagaugggcuugcuaggcaugugacacaaugcccuaagcggaaggagaagguagaagaaacugaauuguacuugaacuuagagagaauucccuggauuguaagaaagcuguugcaggugucggaguccacugguguugcauuaaaaagaagcagcuggcugauugugcugcuugugcuguucgcaguuucauuaucaccuguucaaucagcacccauuggucaugggaagacaauugaaacauaccaggccagggaagaauacacaaguauuugccucuuuguacugggaagcaucuuguuuauagucucuugucugaugaaagggcugguugacaguauuggcaacaucuucuucccugggcugaccaucugcaagacaugcucuauagguaguaucaauggcuuugaaauugagucucacaagugcuauuguagcuuacuuuguugccccuacuguaggcacugcccugcugauagagaaauucaucagcugcacuugagcaucugcaaaaaaaggaaaacaggaaguaaugucaugcucgcagucugcaagcgcaugugcuucagagcaacuauggaagugagcaauaaggcccuacuuauccguagcaucaucaacaccacuuuuguugugugcauauugauauuagcagucuguguuguuagcaccucagcgguagagauggaaagccuaccagcugggaccugggaaagagaagaagaccuaacaaauuucugucaucaggaaugccagguuacagagacugagugccucugcccuuaugaagcccuugugcucagaaggccccuguuccuggauaguauaguuaaaggcaagaaaaaucuguuaaacuccacaaguuuagaaacaagcuugucgauugaggcaccauggggggcaauaaauguucagucaaccuacaaaccaacuguaucaacugcaaacauagcacuuaguuggaguucaguugaacacagagguaauaagauuuugguuucaggcagaucagaaucaauuaugaagcuggaagaaagaacaggaaucagcugggaucuuggcguugaagaugccucugaaucuaagcuacuuacugucucugucauggacuugucucagauguacuccccugucuucgaguacuuaucgggugacagacaaguagaagaguggcccaaggcaaccugcacaggugacugcucagaaagauguggcugcacaucaucaaccugcuuacauaaagaauggccccauucacgaaacuggagaugcaaucccacuuggugcugggggguggggacuggcugcaccuguuguggauuagaugugaaagaccuauuuacagauuauauguucgucaaguggaaaguugauuacauuaaaacagaggccauaguguguguagaacucaccagucaggaaaggcaguguagcuugguugaggcgggcacaagguucaauuuagguccuguaaccaucacauugucagaaccgaggaacauacaacaaaagcucccuccugaaauaaucacauugcauccuaggauugaagaagguuuuuuugaccugaugcauguacaaaaagugcugucagcaagcacaguguguaaauugcagaguugcacacauggugugccaggagaucuacaggucuaccacaucggaaauuuauuaaaaggagauaaagugaacggacaccuaauucauaaaauugagccgcacuucaauacuuccuggauguccugggauggcugugaccuagacuacuacugcaacaugggagacuggccuucuugcacauauaccggaguuacucaacacaaucaugcuucauuuguaaaccugcucaacauugaaacugacuauacaaaaagcuuccacuuucacucuaaaaggguuacugcacauggagacacaccacaauuggaucugaaggcaagaccaaccuacggcgcaggagaaaucacuguacugguagaaguugcugauauggaguuacacacaaagaagaucgaaauaacaggccucaaauuugcaagccugacuugcacagguuguuaugcuuguaguucaggcaucuccugcaaaguuaggauucacguggaugaaccagaugagcuaacaguacauguuaaaagugaugauccagauguaguugcagccagcucaagucucauggcaaggaaacuugaguuuggaacagacaguacauucaaagcuuucucagccaugccuaaaacuuccuuaugcuucuacauugucgaaagggaguacuguaagagcugcaguaaagaagacacacagaaauguguuaacacaaaacuugagcaaccacagagcauuuugaucgaacaaaagggaacuauaaucggaaagcaaaacaauacuugcacagccaaggcaaguugcugguuagagucaguuaaaaguuucuuuuauggucuaaagaacaugcuuaguggcauuuuuggcaauguuuuuguaggcauuuucuuauuucuugcccccuuuaucuuguuaauacuuuucuucauguuuggauggaggauccuguuuugcuucaaguguugcagaagaaccaggggccuguuuaaguauaaacaucucaaagacgaugaagaaacugguuacagaaggaucauugaaagacugaacaacaagaaggggaaaaacaagcugcuugacggugaaagacuugccgauagaaggauugccgaacuauucuccacaaaaacacacauuggcuag

SEQ ID NO: 3621 - RNA, 5055 nt, Artificial Sequence
  derived and/or modified CDS sequence (wt) from CCHFV(Baghdad 12)__AJ538197.2__GP
augcauauaucauugauauaugcaguucuuugcuuacagcuguauggucugggggaaacucauggaucaagcaguggaacugaacacaacaggacaaacguuguggcaacgcccggagguagccagagcccugaaccgcuagugagcacgaccuugcccgucacgcuagacuccuccacugucacacccgcaacgcaagcuagcggaccagaaggcucgggggaaguuuacacaucccccccaaccaccacugaaggccugucuccgucagaugccacgucagagcuccccacaacaacuggcauaggcaucucaaguucaagugaugucaauuccagcacacaggcagccggggacaccuccacaccaacagcacgcacaagucuaccugacagcccuagcacaccacccacaucacaagauacacaccaucccaugagaaauuuacuuucagucacgagccuuaagccagaagaaacaccagcaccgucaaaaucaggcaaagagaguccagcagccagcagcccucacccagucgccagcagaccaccaaccccuucuacaacagcucagggacccaccgaaaacaacagccgcaacaccacuguacagcuuaaauccgugacacaaucggcaacccuaggcccaauggccucuccaacacagacaguccuucuacagagugucaccuccauagccauucaagacacacaccccagcccaacgaauaggucuagaagaaaccuugaaauggagauaaucuuaacuuuaccucaggguuuaaagaaauacuauggcaaggugcucaggcuuuugcaacucacccuagaggaggacacugaaggccugcuagaauggugcaagaggaaucuuggucuugauugugaugauacuuucuuucaaaagagaauugaagaguucuucauaacuggugagggucauuucaaugaaguuuuacaauucagaacaccaggcacauugagcaccacagagucaacacaugcugggucaccaacaguugaacccuuuaaauccuauuuugcuaaaggcuuccuuuuaauagacucagguuacuucucagccaaauguuacucaagaacaucuaauucagggcuucaguugaucaaugucacucggcauucaacuaaaauagcugauacaccugggcccaagauuaccaaccuaaagaccaucagcugcauaaacuuaaaggcaucaaucuucaaagaacauagagagauugaaaucaaugugcuucuuccccaaguugcagucaaccucucaaacugucacguuacaaucaaaucacaugucugugacuauucuuuaaacauugauggaacagugaagcuuccucacauucaucaugaaggaaucuuuauuccaggaacuuacaagauagugauagacaaaaaaaauaagcugaaugacagaugcacccuguucaccaacugugugauaaaagggagagaaguucguaaaggccaaucuguuuugaggcaguauaagacagagauuaggauugguaaggcaucaacuggcucuagaagauugcuuucugaagaaucuggugaugacugcauaucaagaacucggcuauugagaacagagacugcagagauccauggugacagcuauggugguccgggugacaaaauuacuauuugcaacgguucaacuauuguagaucaaagacugggaagugagaugggguguuacacuaucaauagagugaagucauucaagcugugcgaaaacagugcaacaggaaagagcuguaaaauagacaguaucccaguuaagugcagacaggguuauugccuaaaaaucacucaggaaggaaggggccaugugaaauuauccaggggcucagagguugucuuggaugcaugcgacucaagcugugaaguaaugauaccuaaaggcacaggugacaucuuaguagacuguucaggugggcagcaacauuuuuugaaggauaacuugauugaucuaggaugccccaacauuccauuauuagguaaaauggcuauuuauauuugcagaaugucaaaucacccuaagacaaccauggcuuuccucuuuugguucaguuuugguuaugugauaaccuguauacucugcaaggccaucuucuacuuauuaauaauuguugggacacuagggaaaagguuuaagcaguacagagaguuaaaaccccagaccuguacuauaugugagacaacuccuguaaaugcaauagaugcugaaaugcaugaccuuaacugcaguuacaauauaugucccuauugugcaucuagauuaaccucagaugggcuugcuaggcaugugacacaaugcccuaagcggaaggagaaaguggaagaaacugaauuguacuugaacuuagagaggauucccuggguuguaagaaagcuguugcagguaucagaguccacagguguugcauuaaagagaagcagcuggcugauugugcugcuugugcuacuugcaguuucaucaucaccaguucaaucagcacccaucgguuaugggaagacaauugagacauaccaggccagggagggauacacaaguauuugccucuuuguacuaggaaguauccuguuuauagucucuugucuaacaaaagggcugguugacaguauuggcaacaucuucuucccugggcuguccauuugcaaaacgugcucuauagguaguaucaauggcuuugaaguugagucucauaagugcuauuguagcuugcuuuguugucccuacuguaggcauugcucugcugauagagaaauccaucagcugcacuugagcaucugcaaaaaaagaaaaacaggaaguagugucaugcuugcagucugcaagcgcaugugcuucagagcaacuauggaagugagcaauaaggcccuacuuauccguagcauuaucaacaccacuuuuguugucugcauauugacacuagcagucuguguuguuagcaccucagcaguagagauggaaagccuaccagcugggaccugggaaagagaagaagaccuaacaaauuucugucaucaagaaugccaggucacggagacugagugccucugcccuuaugaagcccuaguacucagaaagcccuuguuccuggauaguauagucaaaggcacgaaaaaucugcuaaacucaacaaguuuagaaacaagcuuaucgauugaggcaccauggggagcaauaaauguucagucaaccuauaaaccaacugugucaacugcaaacauagcacuuaguuggaguucaguugaacacagagguaacaagauuuugguuucaggcagaucagaaucaauuaugaagcuagaagagagaacaggaaucaguugggaucuuggcguagaagaugccucugaaucuaagcuacuuacagucucugucauggacuugucucagauguacucuccugucuuugaguacuuaucaggugacagacaaguagaagaauggcccaaggcaaccuguacaggugacugcccagaaagauguggcugcacaacaucaaccugcuugcauaaagaauggccccauucaagaaacuggagauguaaucccacuuggugcuggggagugggaacuggcugcacuuguugcggauuagaugugaaggaccuuuuuacagauuauauguucgucaaauggaaaguugaauacauuaaaacagaugccauaguguguguggaacucacuagucaagaaaggcaaugcagcuugauugaggcagguacaagguuuaacuuagguucugugaccaucacauugucagaaccgaggaacauucagcaaaagcucccuccugaaauaaucacauuacauccuaggauugaagaagguuuuuuugaccugaugcauguacaaaaaguguugucagcuagcacaguguguaaguugcagaguugcacacacggugugccaggugaucuacaggucuaccacaucggaaauuuauuaaaaggggauaaagugaauggacaccuaauucauaaaauugagccacauuuuaacacuucuuggauguccugggauggcugugacuuagacuacuauugcaauaugggagacuggccuucuugcacauauaccggaguuacccaacacaaucaugcuucauuuguaaaccugcucaacauugaaacugauuacacaaaaagcuuccacuuucacucuaaaaggguuacugcacauggagauacaccacaguuagaucugaagguaagaccaaccuacggcgcaggagaaaucacuguacugguagaaguugcugacauggaguugcacacgaagaagauugaaauaucaggccuaaaauuugcaagccugacuugcacaggcuguuaugcuuguagcucuggcauuuccugcaaaguuaggauacauguggaugaaccggaugaacucacaguacacgucaaaagugaugauccagauguaguagcagcuagcucaagucucauggcaaggaagcuugaguuuggaacagacagcacauuuaaagcuuucuccgccaugccaaaaacuuccuuauguuucuacauugucgaaagggaguacuguaaaagcugcaguaaagaagauacacaaaaauguguuaacacaaaacuugagcaaccacagagcauuuugauugaacauaagggaacuauaaucggaaagcaaaacaauaccugcacagccaaaacaaguugcugguuagagucaguuaaaaguuucuuuuauggucuaaagaauaugcuuaguggcauuuuuggcaauuuuuucaugggcaucuucuuauuucuugcccccuuuaucuuguuaauacuuuucuuuauguuuggauggaggauccuguuuugcuuuaaguguugcagaagaaccaggggccuguuuaaguacagacaucucaaagaugaugaagaaacugguuauagaaggaucauugaaagacugaacaacaagaaagggaagaacaagcugcuugauggugaaagacuugccgauagaaggauugccgaacuauucuccacaaaaacacauauuggcuag

SEQ ID NO: 3622 - RNA, 5055 nt, Artificial Sequence
  derived and/or modified CDS sequence (wt) from CCHFV(TADJ/HU8966 )__AY179962.1__GP
augcauauguuauugaugugugcaguacuuugcuugcagcuauauggucuggggggaacucuuagaucaaacaacggaaccgaacacaacaaaacaaauguuuugacaacgcccggcgacaaacugagcccugagccgccaguaagcacagccuugccuguuacgccagacuccuccacugucacacccacaacaccagccaguggacuggaaggcucgggggaaguguacacaucccccccaaucaccaccaagggccugucuccgucggaggcuacgucagagccccccgcgacaacugguaugggcaucucaagugcaaguggugucgauuucagcacacaggcagccagagacaccucaacacuaacaguucucacaaguccaccuaacagcccuaacacaccaccuacaucacaagacacgcaccauccugugaggagucuacuuucagucacgagccccaggccagaagagacaacagcaccgucaaaaucaggcaaagagaguccagcagccaacagcucucacccggucacuagcagaccaucauccccucucauaacaguccgggggcccacugaaaacagcagccacaacaccaccggucagcuugaguccaugacacaaucaacaacccuagucccaauggccucuccaacacagacaguccuuucacaaagcgucaccuccauagccguucaagacgcacaccccagcucaacaaacaggucuaaaagaaaccuugaaauggagauaaucuuaacuuuaccucaggguuuaaaaaaguacuaugguaaggugcucaggcuuuugcaacucaccuuagaggaggacacugagggcuugcuagaaugguguaagagaaaucuuggucuugauugugaugauacuuucuuucaaaagagaauugaagaauucuucauaacuggugagggucauuucaaugaaguucuacaauuuagaacaccaggcacauugagcaccacagagucuacacaugcugggucaccaacagcugaacccuuuaaaucuuauuucgcuaaaggcuuccuuucaauagauucagguuacuucucagccaaauguuauucaagaacaucuaauucagggcuucggcugaucaaugucacucgacauucaacuagaauagcugacacaccugggcccaagaucaccaaccuaaaaaccaucagcugcauaaauuuaagggcaucaaucuucaaagaacauagagagguugaaaucaaugugcuucucccucaaguugcagucaaccucucaaacugucacguugcuaucaagucacaugucugugacuauucuuuagacguugaugggacagugaggcuuccucauauccaucaugggggaaccuucauuccaggaacuuacaagauagugauagacaaaaaaaauaagcugaaugacagauguacccuauuuaccaacuguguaauaaaagggagagaaguucguaaaggccaaucaauuuugaggcaguauaagacagagauuaggauuggcaaggcaucaacugguucuagaagacugcuuucugaagaaucuggugacgacugcauaucaagaacucagcuacugaggacagagacugcagagauccauggugaugauuauggugguccgggugacaagauuaccauuugcaaugguucgacuauuguagaucaaagacuggguagugaacugggguguuacacuaucaauagagugaagucauucaagcugugcgaaaacagugcaacagggaagaacugcgaaauagacagcgucccaguuaaaugcaggcaggguuauugccuaaaaauuacucaggaaggaaggggccaugugaaauuauccaggggcucagagguuguuuuggaugcaugcgauucaagcugugaaguaaugauaccuaagggcacaggugacaucucaguagacuguucaggagggcagcaacauuuuuugaaagacaacuuaauugaucugggaugucccaagauuccauuauuggguaaaauggccauuuauauuugcagaaugucgaaucacccuaaaacaaccauggcuuuccucuuuugguucaguuuuggcuaugugauaacccguauacucugcaaggccauuuucuacuuauuaauaauuguuggaacacuagggaagagguuuaagcaauauagagaguuaaaaccccagaccuguaccauaugugagacaacuccugcaaaugcaauagaugcugaaaugcaugaccuuaacugcaguuacaacauaugucccuauugugcaucuagacugaccucagauggacucgcuaggcaugugacacaaugcccuaagcggaaggagagaguagaagaaacugaauuguacuugaacuuagaaagaauucccuggauuguaagaaagcuguugcagguaucggaguccacugguguugcauuaaaaagaagcagcuggcugauugugcuacuugugcuguucacaguuucauuaucaccaguucaaucagcacccauugguuaugggaauacaauugaaacauaccaggccagggaagaauacacaagcauuugccucuuuguacugggaaguaucuuguuuauagucucuugucugaugaaagggcugguugacaguauuggcaacaucuucuucccugggcugaccaucugcaagacaugcucuauagguaguaucaauggcuuugaaauugagucucacaagugcuauuguagcuuacuuuguugccccuacuguaggcacugcucugcugauagagaaauucaucagcugcacuugagcaucugcaaaaaaagaaaaacaggaaguaaugucaugcuugcagucugcaagcgcaugugcuucagagcaacuauggaagugagcaauaaggcccuacuuauccguagcaucaucaauaccacuuuuguugugugcauauuaauauuagcagucuguauuguuagcaccucagcaguagagauggaaagccuaccagcugggaccugggaaagagaagaagaccuaacaaauuucugucaucaggaaugccagguuacagagacugagugccucugcccuuaugaagcccuugugcucagaaggccccuguuccuggauaguauagucaaaggcaugaaaaauccgcuaaacuccacaaguuuagaaacaagcuugucgauugaggcaccauggggggcaauaaauguucagucaacuuacaagccaacuguuucaacugcaaacauagcacuuaguuggaguucaauugaacacagagguaauaauauuuugguuucaggcagaucagaaucaauuaugaagcuggaagaaagaacaggaauuaguggggaucuuggcguugaagaugccucugaauccaagcuacuuacagucucuguuauggacuugucucagauguacuccccugucuucgaguacuuaucaggugacagacaaguagaagaguggcccaaggcaaccuguacaggugacugcccagaaagauguggcugcacaucaucaaccugcuuacauaaagaauggccccauucacgaaacuggagaugcaaucccacuuggugcugggggguggggacuggcugcaccuguuguggauuagaugugaaagaccuauuuauagauuauauguucgucaaguggaaaguugauuacauuaaaacagaagccauaguguguguagaacucaccagucaggaaaggcaguguagcuugguugaggcgggcacaagguucaauuuagguccugugaccaucacauugucagaaccgaggaacauacaacaaaagcucccuccugaaauaaucacauugcauccuaggauugaagaagguuuuuuugaucuaaugcaugugcaaaaagugcugucagcaagcacaguguguaaauugcagaguugcacacauggugugccaggagaucuacaggucuaccacaucggaaacuuauuaaaaggagauaaagagaacggacaccuaauucauaaaauugagccgcacuucaauacuuccuggauguccugggauggcugugaccuagacuacuacugcaacaugggagacuggccuucuugcacauauaccggaguuacccagcacaaucaugcuucauuuguaaaccugcucaacauugaaacugacuauacaaaaagcuuccacuuucacucuaaaaggguuacugcacacggagacacaccacaauuggaucugaaggcaagaccaacuuacggcgcaggagaaaucacuguacugguagaaguugcugauauggaguuacacacgaagaagauugaaauaacaggccucaaauuugcaagccugacuugcacagguuguuaugcuuguaguucaggcauuuccugcaaaguuaggauucauguggacgagccagaugaacuuacaguacauguuaaaagugaugauccagauguaguugcagcuagcucaagucucauggcaaggaagcuugaguucgggacagacaguacauucaaagcuuucucagccaugccuaaaacuuccuuaugcuucuacauugucgaaagggaguaccguaagagcuguaguaaagaggacacacagaaauguguuaacacaaaacuugagcaaccacagagcauuuugaucgaacacaagggaacuauaaucggaaagcaaaauaauacuugcacagccaaagcaaguugcugguuagagucagucaaaaguuucuuuuauggucuaaagaacaugcuuaguggcauuuuuggcaauguuuuugugggcauuuucuuguuucuugccccuuuuaucuuguuaauacuuuucuuuauguuuggauggaggauccugucuugcuuuaaguguugcagaagaaccaggggccugcuuaagcauagacaucucaaagacgaugaagaaacugguuacagaaggaucauugaaagacugaacaacaagaaggggaaaaacaagcugcuugauggugaaagacuugccgauagacggauugccgaacuauucuccacaaaaacacacauuggcuag

SEQ ID NO: 3623 - RNA, 5055 nt, Artificial Sequence
  derived and/or modified CDS sequence (wt) from CCHFV(K168_40)__KX013457.1__GP
augcacauaucacugaugugugcaguucuuugccugcagcuguauggucuggggggaacccauggguuacacaauggaacugaacacaauaagacaaacgcugugacaacguccaguaacagccagagcucagaaucaccagcaagaacggccccaccugucacgccggacucccccaccgucacacccacaacuccagccagcgcaccagaaggcucaggggaggcccacucaucccccccaaacaacacagagggcccgucucugccggaguccacgucagagccccccgcggcaaccagcacaggcaucccaagugcaagugaugucaacuccagcacacaggcagccagagacaccuccacaccaacaguccgcaccaguccccccaacagccccagcacaccacccacaccacaagaaacacaccauccugugaggaaucuacuuucagucacgagccauaagcccgaagaaacaucagcaccgucagaaucuggcaaagagaguccagcagccaacagcccccacccagucgccagcagaccaccaacccccuccacaacagcccaaggaccuacugaaaacaacaacuacaacaccaccggacagcuugaguccuugacacagucgacaaccuuaggcccaaugaccucucuaacacagacagaccucccacagagugucaccuccauagcuguucaagacacgcacccuagcccaacgaacagguccaaaagaaaccuugaaauggaaauaaucuuaacuuuaccucaggguuuaaaaaaauacuauggcaaggugcucaggcuucugcaacucaccuuagaggaggacacugaaggccugcuagaaugguguaagagaaaccuuggucucgauugugaugacacuuucuuucaaaagagaauugaagaauucuucauaacuggugagggucauuucaaugaaguuuuacaauuuagaacaccaggcacauugagcaccacagagucaacacaugcuggguuaccaacagcugaacccuuuaaaucuuauuucgcuaaaggcuuccuuucaauagacucagguuacuucucagccaaauguuacucaagaacaucuaauucagggcuucagcugauuaaugucacucgacauucaacuagaauagccgacacacccgggcccaagauuaccaaccugaagacuaucagcugcauaaacuuaaaggcaucagucuuuaaagaacauagagagguugaaauuaaugugcuucucccucaaguugcaguuaaccucucaaacugucacguuacaaucaaaucacaugucugugacuauucuuuagacauugacggaacagugaggcuuccucacauucaucaugacggaaccuuuaucccaggaacuuacaagauagugauagacagaaaaaacaagcugaaugacagauguaccuuauucaccaacugugugauaaaaggaagagagguucguaaaggccaaucaguuuugaggcaguauaagacagagauuaggauuggcaaggcaucaacugguucuagaagauugcuuucugaugagucuggugaugacugcauaucaaggacucagcuacugagaacagagacugcagagauccauggugacaauuauggugguccgggugacaagauuaccauuugcaaugguucaacuauuguagaccaaagacugggcagugaacugggguguuacacuaucaauagagugaagucauucaagcugugcgaaaacagugccacagggaagagcugugaaguagacaguaucccaguaaaaugcaggcaggguuauugccuaaaaaucacucaggaaggaaggggccacgugaaauuauccagagguucagagguugucuuggaugcaugcgauucaagcugugaaguaaugauaccuaagggcacaggugacauccuaguggacuguucaggugggcagcaacauuucuugaaggacaacuuaauugaccuaggaugucccaaaauuccauuguugggcaaaauggcuauuuauauuugcagaaugucgaaucaccccaagacaaccauggcuuuccucuuuugguucaguuuuggcuaugugauaacuuguauagucugcaaggccauuuuuuacuuauuaauaauuguuggaacacuagggaagagguuuaagcaguauagagaguuaaaaccccagaccugcaccaucugugagacaacuccuacaaaugcaauagaugcugaaaugcaugaccuuaacugcaguuacaacauaugucccuauugugcaucuagacuaaccucagaugggcuugcuaggcauguaacucauugcccuaagcggaaagagaaaguagaagaaacugaauuguacuugaacuuagagagaauucccuggguuguaagaaagcuguugcagguaucagaguccaccgguguagcauuaaaaagaagcagcuggcugauugugcugcuugugcuguuugcaguuucauuaucaccaguucaaucagcaccuauuggucaugggaagacaauugaaacauaccaggucagggaggaauacacaaguauuugccucuuuguacugggaaguaucuuguucauagucucuugucuaaugaaagggcugguuaacaguguuggcaacaucuucuucccugggcuguccauuugcaagacgugcucuauagguaguauuaauggcuuugaaauugagucucauaagugcuauuguagcuuacuuuguugcccuuacuguaggcacugcucugcugacagggaaauucaucaauugcacuugagcaucugcaagaaaagaaaaacaggaaguaaugucaugcuugcuguuugcaagcgcauguguuucagagcaacuguggaagugagcaacaaggcccuaucuauccguagcaucaucaacaccacuuuuguugugugcauuuuaauacuagcagucuguguuguuagcacuucagcaguagagauggaaagccuaccagcugggaccugggaaagagaagaagaucuaacaaauuucugucaucaggaaugccaggucacggagacugagugccucugcccuuaugaggcucuaguacucagaaggccccuguuucuggacgguauagucaaaggcaugaaaaaccugcuaaacucaacaaguuuggaaacaagcuugucgauugaggcaccauggggggcaauaaauguucagucaaccuacaaaccaacuguaucagcugcaaacauagcacuuaguuggaguucaguugaacacagagguaauaagauuuugguuucaggcagaucagaaucaauuaugaagcuggaagaaaggacaggaaucagcugggaucuuggcguagaagaugccucugaaucuaagcuacucacagucucugucauggacuugucucagauguacucuccugucuucgaguacuugucaggugacagacaaguagaagaguggcccaaggcaaccuguacaggugacugcccagagagauguggcuguacaucaucaaccuguuugcauaaagaauggccccauucaagaaacuggagguguaaucccacuuggugcugggggguagggacuggcugcaccuguugugguuuagaugugaaagaccuuuuuacagacuauauguuugucaaguggaaagucgaauacauuaagacagaggccauaguguguguagaacuuaccagucaggaaaggcaguguagcuuaauugaggcggguacaagguucaauuuaggucccgugaccaucacauugucagaaccgaggaacauccaacaaaaacucccuccugaaauaaucacacugcauccuaggauugaagaagguuuuuuugaccugaugcauguacaaaaggugcugucagcaagcacaguguguaaguugcagaguugcacacauggugugccaggagaucuacaggucuaccacaucggaaauuuacuaaaaggagauaaaguuaacggacaccuaauucauaaaauugaaccacacuucaacacuucuuggaugucuugggauggcugugaccuagacuacuacugcaacaugggagauuggccuucuugcacauauaccgggguuacccagcacaaucaugcuucauuuauaaaccugcucaacauugaaacugacuauacaaaaagcuuccauuuucacucuaaaaggguuacugcacauggagacacaccacaauuagaucugaaggcaaggccaaacuauggcgcaggagagaucaccguacugguagagguugccgauauggaguuacacacaaagaagauugaaauaucaggacuaaaguuugcaagcuugacuuguacagguuguuaugcuuguaguuccgguaucuccuguaaaguuaggauucauguggaugaaccagaugaacuuacaguacauguuaaaagugaugauccagauguaguugcugcuagcucaagucucauggcaaggaagcuugaauuuggaacagacaguacauuuaaggcuuucucagccaugccaaaaaccuccuuauguuucuauauugucgaaagggaauacugcaagagcugcaguaaagaagacacacaaaaauguguuaacacgaagcuugagcauccacagagcauuuugaucgaacauaagggaacuauaaucggaaagcagaacaauaccugcacagcaaagacaaguugcugguuagagucaguuaagaguuucuuuuaugguuuaaagaacaugcuuaguggcauuuucggcaacguuuuuguaggcauuuucuuauuucuugcccccuucaucuugcuaauacuuuucuuuauguuuggguggaggauccuauuuugcuucaagugcuguagaagaaccagaggccuguuuagauauaaacaucucgaagacgaugaagaaacugguuacagaagaaucauugaaagacugaacaacaaaaaaggaaaaaacaagcugcuugauggugaaagacuugcugauagaagaauugccgaacuauucuccacaaaaacacacauuggcuag

SEQ ID NO: 3624 - RNA, 5055 nt, Artificial Sequence
  derived and/or modified CDS sequence (wt) from CCHFV(K128_76)__KX013454.1__GP
augcacauaucguugaugugugcaguucuuugccugcagcuguauggucuggggggaacucaugggucacacaaugaaaccgaacacaacaaaacaaacgccgugacaacguccagugacagccagagcccagaaccaccaacaagaacgacccugcccgucacgccagacucccccaccgucacacccacaacuccagccagcgcaccagaaggcucaggggaaguccacacaucccccccaaacaccacugagggcccgucucugccggaguccacgccagagccccccacggcaaccagcacaggcaucccaagugcaagugaugucaacuccagcacacaggcagccagagacaccuccacaccaacaguccacaccaguccacccaacagccccagcacaccacccacacuacaagaaacacaccauccuaugaggaacuuacuuucagucacgagccauaagccugaagaaacaucagcaccgucagaaucuggcaaagagaguccagcagccaacagcccucacccagucgccgacagaccaucaaccuccuccacaacagcccaaggaccuacugaaaacaacagcuacaacaccaccgaacagcuugaguccuugacacagucgacaacucuaggcccaaugaccucucuaacacagacaguccucucacagagugucaccuccauagccguucaagacacacaccucagcccaacgaacagauccaaaagaaaccuugaaauggaaauaaucuuaacuuuaccucaggguuuaaaaaaauacuauggcaaggugcucaggcuucugcaacucaccuuagaagaagacacugagggccuguuagaaugguguaagagaaaucuugaucuugacugugaugacacuuucuuucaaaagaggauugaagaauucuucauaacuggugaggguuauuucaaugaaguuuuacaauuuagaacaccaggcacauugagcaccacagagucaacacaugcuggguuaccaacggcugaacccuuuaaauccuauuucgcuaaaggcuuccuuucaauagacucagguuacuucucagccaaauguuacucaagaacaucuaauucagggcuucagcugaucaaugucacucgacauucaacuagaauagcugacacaccugggcccaagaucaccaaccuaaagaccaucagcugcauaaacuuaaaggcaucagucuuuaaagaacauagagagguugaaauuaaugugcuucucccucaaguugcagucaaccucucaaacugucacguuacaaucaaaucacaugucugugacuauucuuuagacauugacggaacagugaagcuuccucacauucaccaugacggaaccuuuaucccaggaacuuacaagauagugauagacaggaaaaacaagcugaaugacagauguaccuuguucaccaacugugugauaaaaggaagagaaguucguaaaggccaaucaguuuugaggcaguauaagacagagauuaggauuggcaaggcaucaacugguucuaggagauugcuuucugaugaaucuggugaugacugcauaucaaggacucagcuguugagaacagagacugcagagauccauggugacaauuauggugguccgggugacaagauuaccauuugcaaugguucaacuauuguagaccaaagacuggguagugaacugggguguuacacuaucaauagagugaagucauucaagcugugcgaaaacagugccacagggaagagcugugaaauagacaguaucccaguuaagugcaggcaggguuauugccuaaaaaucacucaagaaggaaggggccaugugaaauuauccaggggcucagagguugucuuggaugcaugcgacucaagcugugaaguaaugauaccuaagggcacaggugacauucuaguagacuguucaggugggcagcaacauuuuuugaaggacaacuugauugaccuaggaugucccaaaauuccauuguugggcaaaauggcuauuuauauuuguagaaugucgaaucaccccaaaacgaccauggcuuuccucuuuugguucaguuuuggcuaugugauaacuuguauagucugcaaagccauuuuuuacuuauuaauaauuguuggaacacuagggaagagguuuaagcaguauagagaguuaaaaccccagaccuguaccaucugugagacaacuccuacaaaugcaauagaugcugaaaugcaugaccuuaacugcaguuacaacauaugucccuauugugcaucuagacuaaccucagaugggcuugcuaggcauguaacucauugcccuaagcggaaggagaaaguagaagaaacugaauuguacuugaacuuagaaagaauuccauggguuguaagaaagcuauugcagguaucagaguccaccgguguagcauuaaaaagaagcagcuggcugauugugcugcuugugcuguuugcaguuucauuaucaccaguucaaucagcacccauuagucaugggaagacaauugaaacauaccaggucagggaggaauacacaaguauuugccucuuuguacugggaagcauuuuguuuauugucucuugucuaaugaaagggcugguuaacaguguuggcaacaucuucuucccugggcuguccauuugcaagacgugcucuauagguaguauuaauggcuuugaaauugagucucauaagugcuauuguagcuuacuuuguugcccuuacuguaggcacugcucugcugauagagaaauucaucaacugcacuugagcaucugcaaaaaaagaaaaacaggaaguaaugucaugcuugcuguuugcaagcgcauguguuucagagcaacaauggaagugagcaacaaggcccuauuuauccguagcaucaucaacaccacuuuuguugugugcauuuugauacuagcagucuguguuguuagcacuucagcaguagagauggaaagccugccagcugggaccugggaaagagaagaagaccuaacaaauuucugucaucaggaaugccagguuacugagacugagugccucugcccuuaugaagcucuaguacucagaaggccccuguuucaggacaguauagucaaaggcaugaaaaaccugcuaaacucaacaaguuuagaaacaagcuugucgauugaggcaccauggggggcaauaaauguucagucaaccuacaaaccagcugugucagcugcaaacauagcacuuaguuggaguucaguugaacacagagguaguaagauuuugguuucaggcagaucagaaucaauuaugaagcuggaagaaaggacaggaaucagcugggaucuuggcguagaagaugccucugaaucuaagcuacuuacagucucugucauggacuugucucagauguacuccccugucuucgaguacuugucaggugacagacaaguagaagaguggcccaaggcaaccuguacaggugacugcccagagagaugugguuguacaucaucaaccuguuugcauaaagaauggccccauucaagaaacuggagguguaaucccacuuggugcugggggguagggacuggcugcaccuguugugguuuagaugugaaagaccuuuuuacagacuauauguucgucaaguggaaaguugaauauauuaagacagaggccauaguguguguagaacuuaccagucaggaaaggcaguguaguuuaauugaggcagguacaagguucaauuuagguccugugaccaucacauugucagaaccgaggaacauccaacaaaagcucccuccugaaauaaucacacugcauccuaggauugaagaagguuuuuuugaccugaugcaugugcaaaaggugcugucagcaagcacaguguguaaguugcagaguugcacacauggugugccaggagaucuacaagucuaccacaucgggaauuuacuaaaaggagauagaguuaacggacaccuaauucauaaaauugagccacacuuuaacacuucuuggauguccugggauggcugugaccuagacuauuacugcaacaugggagacuggccuucuugcacauauaccggaguuacccagcacaaucaugcuucauuugugaaccugcucaacauugaaacugacuauacaaaaagcuuccauuuucacucuaaaaggguuacugcacauggagacacaccacaauuagaucugaaggcaaggccaaacuauggcgcaggagagaucaccguacugguagagguugccgauauggaguuacacacaaagaagauugaaauaucaggccuaaaguuugcaagcuugacuuguacagguuguuaugcuuguaguuccgguaucuccuguaaaguuaggauucauguggaugaaccagaugaacuuacaguacauguuaaaagugaugauccagauguaguugcagcuagcucaagucucauggcaaggaagcuugaauuuggaacagacaguacauuuaaggcuuucucagccaugcccaaaaccuccuuauguuucuacauugucgaaagggaguacugcaagagcugcaguaaagaagacacacaaaaauguguuaacacaaaacuugagcagccacagagcauuuuaaucgaacauaagggaacuauaaucggaaagcaaaacaauaccugcacagcaaagacaaguugcugguuagagucaguuaaaaguuucuuuuaugguuuaaagaacaugcuuaguggcauuuuuggcaauguuuuuguggguauuuucuuauuucuugcccccuucaucuugcuaauacuuuucuuuauguuuggguggaggauccuguuuugcuucaagugcuguagaagaaccagaggccuguucagauauaagcaucucgaaaacgaugaagaaacugguuacagaagaaucauugaaagacugaacaacaaaaaaggaaaaaacaagcugcuugauggugaaagacuugcugauagaagaaucgccgaacuauucuccacaaaaacacacauuggcuag

SEQ ID NO: 3625 - RNA, 5055 nt, Artificial Sequence
  derived and/or modified CDS sequence (wt) from CCHFV(K168_125)__KX013460.1__GP
augcacauaucacugaugugugcaguucuuugccugcagcuguauggucuggggggaacccauggguuacacaauggaacugaacacaauaagacaaacgcugugacaacguccaguaacagccagagcucagaaucaccagcaagaacggccccaccugucacgccggacucccccaccgucacacccacaacuccagccagcgcaccagaaggcucaggggaggcccacucaucccccccaaacaacacagagggcccgucucugccggaguccacgucagagccccccgcggcaaccagcacaggcaucccaagugcaagugaugucaacuccagcacacaggcagccagagacaccuccacaccaacaguccgcaccaguccccccaacagccccagcacaccacccacaccacaagaaacacaccauccugugaggaaucuacuuucagucacgagccauaagcccgaagaaacaucagcaccgucagaaucuggcaaagagaguccagcagccaacagcccccacccagucgccagcagaccaccaacccccuccacaacagcccaaggaccuacugaaaacaacaacuacaacaccaccggacagcuugaguccuugacacagucgacaaccuuaggcccaaugaccucucuaacacagacagaccucccacagagugucaccuccauagcuguucaagacacgcacccuagcccaacgaacagguccaaaagaaaccuugaaauggaaauaaucuuaacuuuaccucaggguuuaaaaaaauacuauggcaaggugcucaggcuucugcaacucaccuuagaggaggacacugaaggccugcuagaaugguguaagagaaaccuuggucucgauugugaugacacuuucuuucaaaagagaauugaagaauucuucauaacuggugagggucauuucaaugaaguuuuacaauuuagaacaccaggcacauugagcaccacagagucaacacaugcuggguuaccaacagcugaacccuuuaaaucuuauuucgcuaaaggcuuccuuucaauagacucagguuacuucucagccaaauguuacucaagaacaucuaauucagggcuucagcugauuaaugucacucgacauucaacuagaauagccgacacacccgggcucaagauuaccaaccugaagacuaucagcugcauaaacuuaaaggcaucagucuuuaaagaacauagagagguugaaauuaaugugcuucucccucaaguugcaguuaaccucucaaacugucacguuacaaucaaaucacaugucugugacuauucuuuagacauugacggaacagugaggcuuccucacauucaucaugacggaaccuuuaucccaggaacuuacaagauagugauagacagaaaaaacaagcugaaugacagauguaccuuauucaccaacugugugauaaaagggagagagguucguaaaggccaaucaguuuugaggcaguauaagacagagauuaggauuggcaaggcaucaacugguucuagaagauugcuuucugaugagucuggugaugacugcauaucaaggacucagcuacugagaacagagacugcagagauccauggugacaauuauggugguccgggugacaagauuaccauuugcaaugguucaacuauuguagaccaaagacugggcagugaacugggguguuacacuaucaauagagugaagucauucaagcugugcgaaaacagugccacagggaagagcugugaaguagacaguaucccaguaaaaugcaggcaggguuauugccuaaaaaucacucaggaaggaaggggccacgugaaauuauccagagguucagagguugucuuggaugcaugcgauucaagcugugaaguaaugauaccuaagggcacaggugacauccuaguggacuguucaggugggcagcaacauuucuugaaggacaacuuaauugaccuaggaugucccaaaguuccauuguugggcaaaauggcuauuuauauuugcagaaugucgaaucaccccaagacaaccauggcuuuccucuuuugguucaguuuuggcuaugugauaacuuguauagucugcaaggccauuuuuuacuuauuaauaauuguuggaacacuagggaagagguuuaagcaguauagagaguuaaaaccccagaccugcaccaucugugagacaacuccuacaaaugcaauagaugcugaaaugcaugaccuuaacugcaguuacaacauaugucccuauugugcaucuagacuaaccucagaugggcuugcuaggcauguaacucauugcccuaagcggaaagagaaaguagaagaaacugaauuguacuugaacuuagagagaauucccuggguuguaagaaagcuguugcagguaucagaguccaccgguguagcauuaaaaagaagcagcuggcugauugugcugcuugugcuguuugcaguuucauuaucaccaguucaaucagcaccuauuggucaugggaagacaauugaaacauaccaggucagggaggaauacacaaguauuugccucuuuguacugggaaguaucuuguucauagucucuugucuaaugaaagggcugguuaacaguguuggcaacaucuucuucccugggcuguccauuugcaagacgugcucuauagguaguauuaauggcuuugaaauugagucucauaagugcuauuguagcuuacuuuguugcccuuacuguaggcacugcucugcugacagggaaauucaucaauugcacuugagcaucugcaagaaaagaaaaacaggaaguaaugucaugcuugcuguuugcaagcgcauguguuucagagcaacuguggaagugagcaacaaggcccuaucuauccguagcaucaucaacaccacuuuuguugugugcauuuuaauacuagcagucuguguuguuagcacuucagcaguagagauggaaagccuaccagcugggaccugggaaagagaagaagaucuaacaaauuucugucaucaggaaugccaggucacggagacugagugccucugcccuuaugaggcucuaguacucagaaggccccuguuucuggacaguauagucaaaggcaagaaaaaccugcuaaacucaacaaguuuggaaacaagcuugucgauugaggcaccauggggggcaauaaauguucagucaaccuacaaaccaacuguaucagcugcaaacauagcacuuaguuggaguucaguugaacacagagguaauaagauuuugguuucaggcagaucagaaucaauuaugaagcuggaagaaaggacaggaaucagcugggaucuuggcguagaagaugccucugaaucuaagcuacucacagucucugucauggacuugucucagauguacucuccugucuucgaguacuugucaggugacagacaaguagaagaguggcccaaggcaaccuguacaggugacugcccagagagauguggcuguacaucaucaaccuguuugcauaaagaauggccccauucaagaaacuggagguguaaucccacuuggugcugggggguagggacuggcugcaccuguugugguuuagaugugaaagaccuuuuuacagacuauauguuugucaaguggaaagucgaauacauuaagacagaggccauaguguguguagaacuuaccagucaggaaaggcaguguagcuuaauugaggcggguacaagguucaauuuaggucccgugaccaucacauugucagaaccgaggaacauccaacaaaaacucccuccugaaauaaucacacugcauccuaggauugaagaagguuuuuuugaccugaugcauguacaaaaggugcugucagcaagcacaguguguaaguugcagaguugcacacauggugugccaggagaucuacaggucuaccacaucggaaauuuacuaaaaggagauaaaguuaacggacaccuaauucauaaaauugaaccacacuucaacacuucuuggaugucuugggauggcugugaccuagacuacuacugcaacaugggagauuggccuucuugcacauauaccgggguuacccagcacaaucaugcuucauuuauaaaccugcucaacauugaaacugacuauacaaaaagcuuccauuuucacucuaaaaggguuacugcacauggagacacaccacaauuagaucugaaggcaaggccaaacuauggcgcaggagagaucaccguacugguagagguugccgauauggaguuacacacaaagaagauugaaauaucaggccuaaaguuugcaagcuugacuuguacagguuguuaugcuuguaguuccgguaucuccuguaaaguuaggauucauguggaugaaccagaugaacuuacaguacauguuaaaagugaugauccagauguaguugcugcuagcucaagucucauggcaaggaagcuugaauuuggaacagacaguacauuuaaggcuuucucagccaugccaaaaaccuccuuauguuucuauauugucgaaagggaauacugcaagagcugcaguaaagaagacacacaaaaauguguuaacacgaagcuugagcauccacagagcauuuugaucgaacauaagggaacuauaaucggaaagcagaacaauaccugcacagcaaagacaaguugcugguuagagucaguuaagaguuucuuuuaugguuuaaagaacaugcuuaguggcauuuucggcaacguuuuuguaggcauuuucuuauuucuugcccccuucaucuugcuaauacuuuucuuuauguuuggguggaggauccuauuuugcuucaagugcuguagaagaaccagaggccuguuuagauauaaacaucucgaagacgaugaagaaacugguuacagaagaaucauugaaagacugaacaacaaaaaaggaaaaaacaagcugcuugauggugaaagacuugcugauagaagaauugccgaacuauucuccacaaaaacacacauuggcuag

SEQ ID NO: 3626 - RNA, 5052 nt, Artificial Sequence
  derived and/or modified CDS sequence (wt) from CCHFV(Kosova Hoti)__EU037902.1__GP
augcauacacuauuagugugcuucauucuuuaccuacagcuguugggucuaggaggagcucauggacagucaaacgcaacugaacacaauggaacaaacaccaccacagcacccggcacaagucaaagccccaagccacccgcgagcacaaccccaucacacgcaccggaaccauccaccaucaaacucaccacaccaacaagcgaaacagaaggcucaggggaaacgaccccacccacaaacaccacccaggacucgcccccgcuagagaccacaccagaacgcucugcaacaaccgccacaagcacgucaggcacagacaacaugaauuccaccacacagaugaccgauaacacccccacaucaacagucagcacaagucuauccaguagccccagcacgccauccacaucacaaggcaugcaccaucccguaaggagucuauugucagucucgagccccaagacagcaacaacaccaacaccaaugagcccuggagagaugagcucggaaaccagcagucagcacucagccaugagcagaacaccaaccccccacacagcaacccaggucuccacugagaacgccaaccgcagcacauccagacagucugaguccucagcacagccggcaacccaaagcccagugacuuccccagcgcaaucaauccuucugaugagugcuacucccacaaccauucagaacauacaucccagcccaacaaacaggucuaagaggaaccuugagauggaaauaauuuuaacucugucucaaggucugaagaaauacuaugguaaaauacugaagcuucugcaccuuaccuuggaagaggacacugaaggcuuguuggaaugguguaagagaaaccuugggucgaacugugaugaugacuucuuucaaaagaggauagaagaauucuucauaacuggugagggcuacuucaacgaaguucuacaguuuaaaacacuaagcacaccaagcuccacggagccgucucaugccaggcuaccaacagcggaacccuucaaaucuuacuucgcuaagggcuuccuuucaauagauucggguuacuucucugccaaauguuauccaagaucauccacuucagggcuucagcugaucaaugucacccaacacccagcuaggauagcagagacaccuggacccaaaacaacgagucugaaaaccaucaacugcaucaaucuaagagcaucugucuucaaagaacacagggaaguugagaucaaugugcuucuuccucaaauugcagucaaccucucaaacugccauguugugaucaauucacaugucugugauuacucuuuagacacugaugggccagugaggcuuccucgcauuuaccaugaagggacuuucaugccaggaacuuauaaaauagugauagacagaaaaaauaagcuaaaugaccgauguacgcuagucaccaacugugugauaaaaggaagagaaguucguaagggccaaucagugcugaggcaguacaaaacagaaauuaagauaggcaaggcaccaacaggcucuaggaaacuacuguccgaagagccaggugaugauugcauaucaaggacucagcuauugaggacagaaacagcagagauccaugacgauaacuauggugguccaggugacaaaauaacuaucugcaaugguucaaccauuguagaucagagacugggcagugaacuaggguguuacaccaucaacagggugaagucauucaagcuaugcgaaaacagcgccacagggaaaaccugugagauagacagcacuccaguuaagugcaggcaagguuuuuguuuaaaaaucacccaaaagggaaggggccacguaaaauuaucuagaggcucagagguugucuuggacgcuugcgacucaaacugugaaguaaugauaccuaaaggcacuggagauauccuaguggacuguucagguggacagcagcauuucuuaaaagacaacuugauugaccuggggugcccucauaucccacuauuggguaagauggccauuuacauuugcagaaugucaaaucauccuaaaacaaccauggcuuuucucuucugguucagcuuugguuaugugaucaccuguauauuuugcaaggcucuuuuuuauucauugauaauuauugggacacuaggaaaaaagaucaagcaauauagggaacugaaaccucaaacuugcaccauaugugaaacagcuccugucaaugcaauagaugcugaaaugcaugaccucaacuguaguuacaauauaugcccuuauugugcaucaagauugaccuccgaugggcuagcuaggcauguaaagcaaugcccuaagcgaaaggagaaagucgaggagacugagcuguaccugaaccuggaaagaauuccuugggucgucagaaagcuauugcaagugucagaguccacugguguggcauugaaacgaagcaguuggcugauugugcugcuuguguuacucacaguuucauugucaccgguucaaucagcaccuguuggucaugguaagacgaucgaaacauaucagaccagagaaggauucacaaguauuugucucuuuauguuaggaagcauccuauucauagucucuugcuuggugaaagggcugguugacagugucagugacagcuucuuccccggccugucugucugcaagacaugcuccauuggcaguauaaauggcuuugaaauugaaucgcauaaaugcuacuguagcuuauuuugcugccccuauuguagacacugcucugcugacagagaaauucaccaauugcacuugaauaucugcaaaaaaagaaaaacggggagcaaugucaugcuagcugucugcaagcgcaugugcuuuagggcaaccauagaagcaagcagaagagcccugcucauccgaaguauuaucaauaccacuuuuguaauaugcauucuaacauuaacaaucuguguuguuaguaccucugcaguagagauggaaaaccuuccagcaggcaccugggagagagaggaagaccugacaaauuuuugucaucaggaaugccagguaaccgagacggaaugccuuuguccauacgaagcucuugugcucaggaaaccucuuuucuuagacaguauagucaaagguaugaaaaauuugcuaaacucaacaagcuuagaaacaagcuuaucaauugaggcaccauggggagcaauaaauguccagucaaccuucaaaccaacagugucgacugcgaacauagcacucaguuggagcucaguggaacacagaggcaacaagaucuuagucacaggcaggucugagucaauuaugaaacuagaggaaaggacaggaaucagcugggaucuaggcguagaagaugccucugaauccaaauuacuuaccgucucuaucauggauuugucacagauguauuccccaguuuuugaguacuugucaggggacagacagguugaagaauggcccaaagcaacuugcacaggugacugcccacaaagguguggcugcacaucaucaaccugcuugcauaaagaauggccucauucaagaaacuggagauguaaucccacuuggugcuggggagugggaacuggcugcaccugcugcgggguggauguaaaagaccuuuuuacagaucacauguuugucaaauggaagguugaauauauaaaaacugaagccauaguguguguugagcucaccagccaagaaagacagugcagucugauugaggcagguacuagauucaacuugggcccugugacuauuacccugucugagccaagaaacauucagcagaagcuccccccugagaucauuacguugcaucccaaaauugaggaaggcuucuuugacuugaugcauguacaaaaaguguuguccgcaaguacaguguguaaacugcagaguugcacacaugguauaccaggagaucuacaaguuuaccacauuggcaauuuguugaaaggggauagagugaacgggcaucuaauucacaaaauugaaccacauuucaacaccucuuggauguccugggaugguugugacuuagacuacuacugcaacaugggggacuggccuucuuguacauacacaggagugacccagcauaaucaugcugcauuuguaaacuugcucaacauugaaacugauuacacaaaaaccuuccacuuccacucuaaaagagucacagcacauggugacacaccacaauuggacuuaaaagcaaggccgaccuacggugcaggagagaucacugugcugguugagguugcugacauggaguugcauaccaagaaaguugagauaucgggcuugaaauuugcaagucuggcuugcacagguugcuaugccuguagcucugguaucuccuguaaagucaggauucauguagaugaaccagaugagcucacagugcauguaaagagcagugauccagaugugguugcagcuggcacaagccucauggcaaggaagcuugaauuugggacagacagcacauucaaggccuuuucagcuaugcccaaaaccucuuuauguuuuuacauuguggagaaagaauacugcaagagcugcagugaagaugauacaaaaaaauguguugacacaaaacuugagcagccacagagcauacuaauugagcacagagggacgauaauuggaaagcagaaugauacuugcacagccaaggcaagcuguuggcuagagucagucaagaguuuuuuuuauggauugaagaauaugcuuggcaguguuuuugguaauuuuuucauagguauuuuguuauuccuugccccuuuuguccuguuggugcuuuucuuuauguuuggauggaaaaucuuguuuugcuuuaaauguugcaggaggaccagaggcuuguuuaaguauagacaccucaaagacgaugaggaaacaggcuacagaaggauuauugaaaggcugaacaacaaaaaagggaaaaauagacugcuugauggugaaagguuggcugauaggaaaauugccgagcuguuuuccacaaaaacacacauuggcuag

SEQ ID NO: 3627 - RNA, 5049 nt, Artificial Sequence
  derived and/or modified CDS sequence (wt) from CCHFV(Oman)__DQ211632.1__GP
augcacacacugcuaguguaugcugucuuuugcuugcagcuauggaguccaggaggaacucguggacugucaaaugaaacucaacacaaugaaacagguaucacaagagcaccugaagggagccaaggacccaguuugccuguaagcacagcaucacccaucaugucagaccccuccaucaccacacccucagcgucgaccaguggacuagaaggcucaggggacacgacucccccagccaucacacaaggcccgaccccaccagagaccacgccggaacccuccacaacaaccggcacaaacgcauucagcacagccauugccaaugucaguacacagacagucaaggacacccccacaccgacaguccaaacaaguccaccuagcacucccgacgcaucuaccauaccacagggcacacaucacaccgcaaggggucugcugucagucaccgucacaaagccagaagaaguaccaacaccaacaggcccagaacaagcaagcauagagaccaauagcccacgccuagcaacuagcaagacaccgucccccucuccaacagcucagguuaccacugaaaacagcaacccuaauaccuccagacagcucgugcucucaacacaaccagcaaccucaagcccagugaccucuccagcacagcugaucuucgugcagagugcuacuaccguagccguucaagaugcacacccaagcccaacaaacagguccaaaagaaaccuugagauggaaguaauuuugacuuuaucucaagguuuaagaaaguacuacggcagaauacugaaacuucuggaccuuaccuuagaagaagacaccgaaggacugcuggagugguguaagagaaaucuuggucuaaccugugacgauaacuucuuucagaagaggauagaagaguucuucuugacuggugagggucacuucaaugaaguuuuacaguucaaaaccccaagcacacugagcucuacagaaucugcuaguguaggguuaccaacaguugagcccuucaaaucuuacuuugcuaaaggcuuucuuucaauagacucagguuacuucucugccaaguguuauccaagggcgucuaacucagggcuucaguuaaucaaugucacucaacauucagcuagaauagcagacacaccuggaccuaagaucacaaaucugaaaaccaucaauugcauaaaccuaaaggcauuggucuuuaaagagcauagagagauugaaaucaauguucuucucccucaagucgcagucaaucucucaaacugccauguccacaucaaaucgcaugucugugauuauucuuuagacaucgacggaacaguuaggcuaccccguauccaccaugaaggaacuuucauaccaggaacuuacaaaauagugauagacaaaaaaaacaaacaaaacgauagaugcaacuugguuaccaauuguguaauaaaaggaagggaagugcguaaaggccagucaguguuaagacaguacagaacagaaaucaggaucggcaaggcaucuucuggcuccagaagacugcuguccgaagagucuggugaagacuguauaucaaggacucagcuauugaggacagaaacugcagaaauccauggugauaacuauggugguccaggugacaaaauaaccaucugcaaugguucaaccauuguagaucaaaggcuggguagugaacugggguguuacacuaucaauagggugaagucauuuaagcuaugcgaaaacagugccacagguaaguccugugaaauagauaacacuccaguaaaaugcaagcaagguuuuugcuugaaaauaacccaagaaggaaggggccacgugaagcuuucaagagacucagaaguuguccuggacgccugcgauucaagcugugaaauaaugauaccaaagggcacuggagacauccugguugacugcucaggugggcagcagcacuucuuaaaagacaaccugauugaucugggaugccccaacaucccauuauuaggcaaaauggcaaucuacauuuguagaaugucaaaucauccuaaaacaacuauggcuuuucuuuuuugguuuagcuuugguuaugugauaaccugcauacuuuguaaagucauuuuuuaucuauugauaguuguuggaacuuuagggaaaaaguuuaaacaguauagagaguuaaaaccucagaccugcacaauaugugaaacaacuccugucaaugcaauagaugcugagaugcacgaucucaauuguaguuacaauauauguccuuauugugcaucuagguuaacuucagauggucuugccagacauguaaugcaguguccuaagcggaaggaaaaaauagaagaaaccgaauuauaccugaacuuagaaagaaucccuuggguugucagaaaacuacugcaggugucagaauccacugguguagcacuaaagaggagcaguuggcugauugugcuacuugugcuucucacaguuucauugucaccaguacaaucagcaccuaucggucaugggaagaccauagaaacguaucaaacuagagaaggguacacaaguauuugucuuuuugugcuaggaagcauuuuguuuauaguuucucaccuaaugaaggggcugguugacaguguugguaacaguuuuuuuccuggguuaucuaucugcaagacaugcucuauuggcaguauaaauggcuuugaaauugaaucucacaaauguuucuguagccuauuuuguugccccuacuguagacacugcucugccgauaaagaaauccauaaguugcauuugagcaucugcaaaaaaagaaaagcugggaguaaugucauguuggccgucuguaagcgcauguguuuuagggcaacuauggaagugagcaacaaggcucuacucauccgaagugucaucaacacuacuuuuguuguaugcauacuaauauuagcaguuuguguuguuagcaccucugcaguagagauggaaagccugccagcuggcacuugggagagagaggaagaccuaacaaacuucugccaucaagaaugccaggucacugaaacugaaugucucugucccuaugaagcucuuguacucagaaagcccuuauuuuuagacaguauugcuaagggcaugaagaaccugcugaauucaacaagcuuagaaacaagcuuaucaauugaggcaccauggggagcaauaaacguucaaucuacuuucaaaccuacugugucaacugcaaacauagcacuuaguuggagcucaguggaacacagagguaauaagaucuugguuucaggcagaucagagucaaucaugaagcuagaagaaagaacaggaaucagcugggauuugggaguagaagaugccucugaguccaaauuacuuacuguuuccgucauggacuuaucacagauguacucuccugucuuugaguaccuaucaggugacagacaaguagaggaauggccaaaggcaaccuguacaggcgauugcccggaaagauguggcugcacaucaucaaccugccuacacaaggaauggccucacucaagaaacuggagaugcaaccccacuugguguuggggagucggcaccggaugcaccuguuguggacuagauguaaaggaccuuuuuacagauuacauguuuguuaaauggaaggucgaauauauaaaaacagaggcuauaguguguguugagcuuacuagccaagaaagacaauguagcuugauugaggcaggcacaagauucaacuuagguccugugacuaucacauuaucagagccaagaaacauucagcaaaagcucccuccagaaauugucacauuacauccuagaauugaagaagguuuuuuugacuuaaugcauguacagaagguacuaucagcaagcacagugugcaagcuacagaguugcacacauggcguaccaggagacuuacaggucuaccacaucggaaacuuacuaaaaggagacaaagugaacgggcaucugauacauaaaguugaaccacauuucaacaccuccuggaugucuugggacggcugugaccuagauuacuacugcaauaugggggauuggcccucuugcacguauacuggaguuacccaacauaaucaugcugcauuuguaaaccuacuuaacauugaaacugauuacacaaagaacuuccacuuucacucuaagagagucacugcacauggggacacuccacaauuagauuuaaaagccagaccaaauuauggugcaggugaggucacugugcugguggaaguugcugacauggaguuacacacaaagaaaauugagauaucagguuugaaguuugcaagccuaacuugcacagguuguuaugcuuguagcucuggcaucucauguaagguuaggauccauguagaugaaccagaugagcuuacaguacaugugaagagugaagacccagacauaguugcugcuagcucaagucucauggcaagaaagcuugaauucgggacggauaguacauucaaagccuucucagccaugccuaaaaccuccuugugcuuuuacauuguugagagagaauacuguaaaagcugcaguaaagaagacacacaaaaguguguuaacgcaaagcuugagcgaccacagagcauuuuaauugagcacaaaggaacgauaauuggaaagcagaacgacacuugcacagcuaaagcaagcugcuggcuagagucagucaagaguuucuuuuauggacuaaagaacaugcuuaguggcauuuuuggcaauguuuucauagggauuuucuuauuccuugcuccuuuuauccuguuaauacuuuucuuuauguuuggguggagaauccuauucugcuuuaagugcugcaggagaacuagaggccuauuuaaguacagacaccucaaagaugaugaagaaaccgguuauaggaaaaucauugagagacuaaacaacaaaaaagguaaaaacaagcugcuugacggugaaagauuagcugauagaaagaucgcugagcuguucucuacaaaaacacacauuggcuga

SEQ ID NO: 3628 - RNA, 5049 nt, Artificial Sequence
  derived and/or modified CDS sequence (wt) from CCHFV(Oman_812956)__KY362518.1__GP
augcacacacugcuaguguaugcugucuuuugcuugcagcuauggaguccaggaggaacucguggacugucaaaugaaacucaacacaaugaaacagguaucacaagagcaccugaagggagccaaggacccaguuugccuguaagcacagcaucacccaucaugucagaccccuccaucaccacacucucagcgucgaccaguggacuagaaggcucaggggacacgacucccccagccaucacacaaggcccgacccuaccagagaccacgccggaacccuccacaacaaccggcacaaacgcauucagcacagccauugccaaugucaguacacagacagucaaggacacccccacaccgacaguacaaacaaguccaccuagcacucccgacgcaucuaccauaccacagggcacacaucacaccgcaaggggucugcugucagucaccgucacaaagccagaagaaguaccaacaccaacaggcccagaacaagcaagcauagagaccaauagcccacgccuagcaacuagcaagacaccgucccccucuccaacagcucagguuaccacugaaaacagcaacccuaauaccuccagacagcucgugcucucaacacaaccagcaaccucaagcccagugaccucuccagcacagcugaacuucgugcagagugcuacuaccauagccguucaagaugcacacccaagcccaacaaacagguccaagagaaaccuugagauggaaguaauuuugacuuuaucucaagguuuaagaaaguacuacggcagaauacugaaacuucuggaccuuaccuuagaagaagacaccgaaggacugcuggagugguguaagagaaaucuuggucuaaccugugacgauaacuucuuucagaagaggauagaagaguucuucuugacuggugagggucacuucaaugaaguuuuacaguucaaaaccccaagcacacugagcccuacagaaucugcuaguguaggguuaccaacaguugagcccuucaaaucuuacuuugcuaaaggcuuucuuucaauagacucagguuacuucucugccaaguguuauccaagggcgucuaacucagggcuucaguuaaucaaugucacucaacauucagcuagaauagcagacacaccuggaccuaagaucacaaaucugaaaaccaucaauugcauaaaccuaaaggcauuggucuuuaaagagcauagagagauugaaaucaauguucuucucccucaagucgcagucaaucucucaaacugccauguccacaucaaaucgcaugucugugauuauucuuuagacaucgacggaacagucaggcuaccccguauccaccaugaaggaacuuucauaccaggaacuuacaaaauagugauagacaaaaaaaacaaacaaaacgauagaugcaacuugguuaccaauuguguaauaaaaggaagggaagugcguaaaggccagucaguguuaagacaguacagaacagaaaucaggaucggcaaggcaucuucuggcuccagaagacugcuguccgaagagucuggugaagacuguauaucaaggacucagcuguugaggacagaaacugcagaaauccauggugauaacuauggugguccaggugacaaaauaaccaucugcaaugguucaaccauuguagaucaaaggcuggguagugaacugggguguuacacuaucaauagggugaagucauuuaagcuaugcgaaaacagugccacagguaaguccugugaaauagauaacacuccaguaaaaugcaagcaagguuuuugcuugaaaauaacccaagaaggaaggggccacgugaagcuuucaagagacucagaaguuguccuggacgccugcgauucaagcugugaaauaaugauaccaaagggcacuggagacauccugguugacugcucaggugggcagcagcacuucuuaaaagacaaccugauugaucugggaugccccaacaucccauuauuaggcaaaauggcaaucuacauuuguagaaugucaaaucauccuaaaacaacuauggcuuuucuuuuuugguuuagcuuugguuaugugauaaccugcauacuuuguaaagucauuuuuuaucuauugauaguuguuggaacuuuagggaaaaaguuuaaacaguauagagaguuaaaaccucagaccugcacaauaugugaaacaacuccugucaaugcaauagaugcugagaugcacgaucucaauuguaguuacaauauauguccuuauugugcaucuagguuaacuucagauggucuugccagacauguaaugcaguguccuaagcggaaggaaaaaauagaagaaaccgaauuauaccugaacuuagaaagaaucccuuggguugucagaaaacuacugcagguaucagaauccacugguguagcacuaaagaggagcaguuggcugauugugcuacuugugcuucucacaguuucauugucaccaguacaaucagcaccuaucggucaugggaagaccauagaaacguaucaaacuagagaaggguacacaaguauuugucuuuuugugcuaggaagcauuuuguuuauaguuucucaccuaaugaaggggcugguugacaguguugguaacaguuuuuucccuggguuaucuaucugcaagacaugcucuauuggcaguauaaauggcuuugaaauugaaucucacaaauguuacuguagccuauuuuguugccccuacuguagacacugcucugccgauaaagaaauccauaaguugcauuugagcaucugcaaaaaaagaaaagcugggaguaaugucauguuggccgucuguaagcgcauguguuuuagggcaacuauggaagugagcaacaaggcucuacucauccgaagugucaucaacacuacuuuuguuguaugcauacuaauauuagcaguuuguguuguuagcaccuccgcaguagagauggaaagccugccagcuggcacuugggagagagaggaagaccuaacaaacuucugccaucaagaaugccaggucacugaaacugaaugucucugucccuaugaagcucuuguacucagaaagcccuuauuuuuugacaguauugcuaaggguaugaagaaccugcugaauucaacaagcuuagaaacaagcuuaucaauugaggcaccauggggagcaauaaacguccaaucuacuuucaaaccuacugugucaacugcaaacauagcacuuaguuggagcucaguggaacacagagguaauaagaucuugguuucaggcagaucagagucaaucaugaagcuagaagaaagaacaggaaucagcugggauuugggaguagaagaugccucugaguccaaauuacuuacuguuuccgucauggacuuaucacagauguacucuccugucuuugaguaccuaucaggugacagacaaguagaggaauggccaaaggcaaccuguacaggcgauugcccggaaagauguggcugcacaucaucaaccugccuacacaaggaauggccucacucaagaaacuggagaugcaaccccacuugguguuggggagucggcaccggaugcaccuguuguggacuagauguaaaggaccuuuuuacagauuacauguuuguuaaauggaaggucgaauauauaaaaacagaggcuauaguguguguugagcuuacuagccaagaaagacaauguagcuugauugaggcaggcacaagauucaacuuagguccugugacuaucacauuaucagagccaagaaacauucagcaaaagcucccuccagaaauugucacauuacauccuagaauugaagaagguuuuuuugacuuaaugcauguacagaagguacuaucagcaagcacagugugcaagcuacagaguugcacacauggcguaccaggagacuuacaggucuaccacaucggaaacuuacuaaaaggagacaaagugaaugggcaucugauacauaaaguugaaccacauuucaacaccuccuggaugucuugggacggcugugaccuagauuacuacugcaauaugggggauuggcccucuugcacguauacuggaguuacccaacauaaucaugcugcauuuguaaaccuacuuaacauugaaacugauuacacaaagaacuuccacuuucacucuaagagagucacugcacauggggacacuccacaauuagauuuaaaagccagaccaaauuauggugcaggugaaaucacugugcugguggaaguugcugacauggaguuacacacaaagaaaauugagauaucagguuugaaguuugcaagccuaaccugcacagguuguuaugcuuguagcucuggcaucucauguaagguuaggauccauguagaugaaccagaugagcuuacaguacaugugaagagugaagacccagacauaguugcugcuagcucaagucucauggcaagaaagcuugaauucgggacggauaguacauucaaagccuucucagccaugccuaaaaccuccuugugcuuuuacauuguugagagagaauacuguaaaagcugcaguaaagaagacacacaaaaguguguuaacgcaaagcuugagcgaccacagagcauuuuaauugagcacaaaggaacgauaauuggaaagcagaacgacacuugcacagcuaaagcaagcugcuggcuagagucagucaagaguuucuuuuauggacuaaagaacaugcuuaguggcauuuuuggcaauguuuucauagggauuuucuuauuccuugcuccuuuuauccuguuaauacuuuucuuuauguuuggguggagaauccuauucugcuuuaagugcugcaggagaacuagaggccuauuuaaguacagacaccucaaagaugaugaagaaaccgguuauaggaaaaucauugagagacuaaacaacaaaaaagguaaaaacaagcugcuugacggugaaagauuagcugauagaaagaucgcugagcuguucucuacaaaaacacacauuggcuga

SEQ ID NO: 3629 - RNA, 5049 nt, Artificial Sequence
  derived and/or modified CDS sequence (wt) from CCHFV(Oman-199809166)__KR864901.1__GP
augcacacacugcuaguguaugcugucuuuugcuugcagcuauggaguccaggaggaacucguggacugucaaaugaaacucaacacaaugaaacagguaucacaagagcaccugaagggagccaaggacccaguuugccuguaagcacagcaucacccaucaugucagaccccuccaucaccacacucucagcgucgaccaguggacuagaaggcucaggggacacgacucccccagccaucacacaaggcccgacccuaccagagaccacgccggaacccuccacaacaaccggcacaaacgcauucagcacagccauugccaaugucaguacacagacagucaaggacacccccacaccgacaguacaaacaaguccaccuagcacucccgacgcaucuaccauaccacagggcacacaucacaccgcaaggggucugcugucagucaccgucacaaagccagaagaaguaccaacaccaacaggcccagaacaagcaagcauagagaccaauagcucacgccuagcaacuagcaagacaccgucccccucuccaacagcucagguuaccacugaaaacagcaacccuaauaccuccagacagcucgugcucucaacacaaccagcaaccucaagcccagugaccucuccagcacagcugaacuucgugcagagugcuacuaccauagccguucaagaugcacacccaagcccaacaaacagguccaagagaaaccuugagauggaaguaauuuugacuuuaucucaagguuuaagaaaguacuacggcagaauacugaaacuucuggaccuuaccuuagaagaagacaccgaaggacugcuggagugguguaagagaaaucuuggucuaaccugugacgauaacuucuuucagaagaggauagaagaguucuucuugacuggugagggucacuucaaugaaguuuuacaguucaaaaccccaagcacacugagcccuacagaaucugcuaguguaggguuaccaacaguugagcccuucaaaucuuacuuugcuaaaggcuuucuuucaauagacucagguuacuucucugccaaguguuauccaagggcgucuaacucagggcuucaguuaaucaaugucacucaacauucagcuagaauagcagacacaccuggaccuaagaucacaaaucugaaaaccaucaauugcauaaaccuaaaggcauuggucuuuaaagagcauagagagauugaaaucaauguucuucucccucaagucgcagucaaucucucaaacugccauguccacaucaaaucgcaugucugugauuauucuuuagacaucgacggaacagucaggcuaccccguauccaccaugaaggaacuuucauaccaggaacuuacaaaauagugauagacaaaaaaaacaaacaaaacgauagaugcaacuugguuaccaauuguguaauaaaaggaagggaagugcguaaaggccagucaguguuaagacaguacagaacagaaaucaggaucggcaaggcaucuucuggcuccagaagacugcuguccgaagagucuggugaagacuguauaucaaggacucagcuguugaggacagaaacugcagaaauccauggugauaacuauggugguccaggugacaaaauaaccaucugcaaugguucaaccauuguagaucaaaggcuggguagugaacugggguguuacacuaucaauagggugaagucauuuaagcuaugcgaaaacagugccacagguaaguccugugaaauagauaacacuccaguaaaaugcaagcaagguuuuugcuugaaaauaacccaagaaggaaggggccacgugaagcuuucaagagacucagaaguuguccuggacgccugcgauucaagcugugaaauaaugauaccaaagggcacuggagacauccugguugacugcucaggugggcagcagcacuucuuaaaagacaaccugauugaucugggaugccccaacaucccauuauuaggcaaaauggcaaucuacauuuguagaaugucaaaucauccuaaaacaacuauggcuuuucuuuuuugguuuagcuuugguuaugugauaaccugcauacuuuguaaagucauuuuuuaucuauugauaguuguuggaacuuuagggaaaaaguuuaaacaguauagagaguuaaaaccucagaccugcacaauaugugaaacaacuccugucaaugcaauagaugcugagaugcacgaucucaauuguaguuacaauauauguccuuauugugcaucuagguuaacuucagauggucuugccagacauguaaugcaguguccuaagcggaaggaaaaaauagaagaaaccgaauuauaccugaacuuagaaagaaucccuuggguugucagaaaacuacugcagguaucagaauccacugguguagcacuaaagaggagcaguuggcugauugugcuacuugugcuucucacaguuucauugucaccaguacaaucagcaccuaucggucaugggaagaccauagaaacguaucaaacuagagaaggguacacaaguauuugucuuuuugugcuaggaagcauuuuguuuauaguuucucaccuaaugaaggggcugguugacaguguugguaacaguuuuuucccuggguuaucuaucugcaagacaugcucuauuggcaguauaaauggcuuugaaauugaaucucacaaauguuacuguagccuauuuuguugccccuacuguagacacugcucugccgauaaagaaauccauaaguugcauuugagcaucugcaaaaaaagaaaagcugggaguaaugucauguuggccgucuguaagcgcauguguuuuagggcaacuauggaagugagcaacaaggcucuacucauccgaagugucaucaacacuacuuuuguuguaugcauacuaauauuagcaguuuguguuguuagcaccuccgcaguagagauggaaagccugccagcuggcacuugggagagagaggaagaccuaacaaacuucugccaucaagaaugccaggucacugaaacugaaugucucugucccuaugaagcucuuguacucagaaagcccuuauuuuuagacaguauugcuaaggguaugaagaaccugcugaauucaacaagcuuagaaacaagcuuaucaauugaggcaccauggggagcaauaaacguccaaucuacuuucaaaccuacugugucaacugcaaacauagcacuuaguuggagcucaguggaacacagagguaauaagaucuugguuucaggcagaucagagucaaucaugaagcuagaagaaagaacaggaaucagcugggauuugggaguagaagaugccucugaguccaaauuacuuacuguuuccgucauggacuuaucacagauguacucuccugucuuugaguaccuaucaggugacagacaaguagaggaauggccaaaggcaaccuguacaggcgauugcccggaaagauguggcugcacaucaucaaccugccuacacaaggaauggccucacucaagaaacuggagaugcaaccccacuugguguuggggagucggcaccggaugcaccuguuguggacuagauguaaaggaccuuuuuacagauuacauguuuguuaaauggaaggucgaauauauaaaaacagaggcuauaguguguguugagcuuacuagccaagaaagacaauguagcuugauugaggcaggcacaagauucaacuuagguccugugacuaucacauuaucagagccaagaaacauucagcaaaagcucccuccagaaauugucacauuacauccuagaauugaagaagguuuuuuugacuuaaugcauguacagaagguacuaucagcaagcacagugugcaagcuacagaguugcacacauggcguaccaggagacuuacaggucuaccacaucggaaacuuacuaaaaggagacaaagugaaugggcaucugauacauaaaguugaaccacauuucaacaccuccuggaugucuugggacggcugugaccuagauuacuacugcaauaugggggauuggcccucuugcacguauacuggaguuacccaacauaaucaugcugcauuuguaaaccuacuuaacauugaaacugauuacacaaagaacuuccacuuucacucuaagagagucacugcacauggggacacuccacaauuagauuuaaaagccagaccaaauuauggugcaggugaaaucacugugcugguggaaguugcugacauggaguuacacacaaagaaaauugagauaucagguuugaaguuugcaagccuaaccugcacagguuguuaugcuuguagcucuggcaucucauguaagguuaggauccauguagaugaaccagaugagcuuacaguacaugugaagagugaagacccagacauaguugcugcuagcucaagucucauggcaagaaagcuugaauucgggacggauaguacauucaaagccuucucagccaugccuaaaaccuccuugugcuuuuacauuguugagagagaauacuguaaaagcugcaguaaagaagacacacaaaaguguguuaacgcaaagcuugagcgaccacagagcauuuuaauugagcacaaaggaacgauaauuggaaagcagaacgacacuugcacagcuaaagcaagcugcuggcuagagucagucaagaguuucuuuuauggacuaaagaacaugcuuaguggcauuuuuggcaauguuuucauagggauuuucuuauuccuugcuccuuuuauccuguuaauacuuuucuuuauguuuggguggagaauccuauucugcuuuaagugcugcaggagaacuagaggccuauuuaaguacagacaccucaaagaugaugaagaaaccgguuauaggaaaaucauugagagacuaaacaacaaaaaagguaaaaacaagcugcuugacggugaaagauuagcugauagaaagaucgcugagcuguucucuacaaaaacacacauuggcuga

SEQ ID NO: 3630 - RNA, 5055 nt, Artificial Sequence
  derived and/or modified CDS sequence (wt) from CCHFV(BA66019)__AF350448.1__GP
auguauacacuguuagugugugcuguucucuguccacagcuguggagucuggaagggacccauguuccacacaacgagacuaaacacaauggaaccggcaucacagcagcaccuggagagagucaaggccccaugucgccugcgagcacagcagugccccucacaccggaacccccaaacaccaaaccugcagcaucagccagcgaacuggaaagcucgggggaagggcacaccucccuuuuagccaccacacaaggucugacuucgccggaggccacgccggagcucccaacaacaaccgacacaggcguaucaagcacaagcgucgucgacauuggcacacagauggccaaagacacucccacaucgacagcccacacaagccugcccagcaaucccagugcaccauccacagcacaaggcacacaucacacuauaagaggucugcugucaguuaccagcaccaagccagaagaagcaucaacaccaacagacccaggaaaggcgggugcagagaccggcagcccaagaccagccaucagcagaaaaccaacccucucaccaacagcugaagcucccacugaaaucaacaacucuagcacccccaaacaacccgagcccucaauacaaccagcaaccccaagccuagugaucucuccagcacagccagccuucccacagagugcuacuuccacagcugcucaagauauauacucuagcccaacaaacagaucuaaaagaaaccuuaagauggaaauaauuuugacuuugucucaaggucuaaagaaguacuacgguaagauacaaaaaacucugggucucaccuuagaagaagacacugaaggucugcuggagugguguaagagaaaucuuggucugaccugugaugauaauuucuuccaaaagagaauagaagaguuuuuuuugaccggugaaggcuacuucaaugaaguuuuacaguuuaaaacaccaagcacaccaggcuccacagaaccgacucaugccgaggcaccaacaguuaaacccuuuaaaucuuacuuugcuagaggcuuccuuacaauaaacucagguuacuucucugccaagugcuauucauggacuucuaacucaggacuucaguugaucaacgucacccagcauccagccagaauagcagacacaccuggacccaagaucacuaaucugaagaccaucaauuguauaaacuuaaaagcaucagucuuuaaagagcauagagagaucgaaaucaaugugcuucucccacaagucgcggucaaccucucaaacugccacguucugaucaaaucacaugucugugacuacucuuuagacaucgaugggacaauaagacuaccucguaucuaccaugaaggaacauuuauaccaggaaccuauaaaauaguaauagacaaaagagauaagcaaaacgacagaugcaccuuggucaccaauuguguaauaaaaggaagggagguucguaaaggccagucagcauuaaggcaauacaggacagaaaucagaauaggcaaggcaucugcuggcucuagaagauugcuguccgaagagucuggugacgacugcauaucuagaacucagcuauugaggacagagacugcagagguccauggugacaacuauggugguccaggugacaaaauaacuaucuguaaugguucaaccauuguggaucaaagacuuggcagugaacugggguguuauacuaucaauagagugaagucauucaagcuaugcgaaaauaguggcacgggaaaauccuguaagauagauaaacacccaguuaagugcaggcaggguuuuugcuuaaaaauuacucaggaaggaaggggccaugugaagcuaucgagaggcucagaaguugucuuagaugccugcgacucaagcugugaaauaaugauaccgaagggcacaggagacauccuaguagacuguucaggugggcaacaacauuucuuaaaagauaacuugguugaucuaggaugcccuaacauuccacuauuagguaaaauggcuaucuacauuugcaggaugucaaaucacccuaaaacaacuauggcuuuucucuuuugguuuaguuucggcuauguaauaacauguauauuuuguaaaaucauuuuuuacuuguugauagucguggggacauuggggaaaaaguucaaacaguaccgggagcugaaaccucagacuuguacuauaugugaaacaacuccuaccaaugcaauagaugcugaaaugcacgaucuuaaaugcaguuacaauauaugcccuuauugugcaucuagauuaaccucggacgggcuugccaggcaugugacacaaugcccuaagcgaaaagagaaaguagaagagacugaacuguacuugaacuuggaaagaauuccuuggauugucagaaaacuacugcaagugucagagucuaccgguguggcacugaaaaggagcaguuggcugauuguguuacuugugcuacuuacaguuucauugucaccgguucaaucagcacccauuggacauggaaagacaauugaggcauaucagaccagagagggguacacaaguguuugccuguuuaugcugggaggcaucuuguuuguggucuccugccugaugaaagggcuaguugacagugucagcaacagcuuuuucccuggguuaucuauuugcaaaaccuguucuaucggcaguguaaauggcuuugaaauugaaucccauaaauguuacuguagcuuacuuuguugccuuuauuguagacauugcucugcugauagggaaauccaccaauugcacuugagcaucugcaaaaaaagaagggcaggaggcaaugucaugcuggcugucugcaagcgcaugugccucagagccacuauggagguaagcaauaagguccuauucauccgaaguauuaucaacaccacuuuuguuauaugcauacugguauuggcagucuguaucguuagcaccuccgcaguagagauggaaagccuaccagccggcacuugggaaagggaggaagaccugacuaacuucugccaccaggaaugccaagucacagagacugaaugucucuguccuuacgaggcucuuguacucaggaaaccccuauucucagacaguauagucaagggcaugaaaaaccugcuaaauucaacuagcuuggaaacaagcuuaucaauugaagcaccauggggagcaauaaacguccagucaaccuuuaaacccaccguuucaacugcaaacauagcacuuagcuggaguucaguagaacacagagguaacaaaauuuuggucucaggcagaucagaaucaauuaugaagcuagaagaaaggacaggaaucagcugggaucugggcguagaagaugccucugaaucuaaguugcuuacuguuucugucauggauuugucacagauguauucuccugucuuugaguacuuaucaggugacagacagguagaggaguggcccaaagcaaccugcacaggugauugcccagauagguguggcugcacaucaucaaccuguuuacacaaagaauggccccauucaagaaauuggagaugcaaccccacuugguguuggggagucggcacuggaugcaccugcuguggacuagaugugaaagaucuuuuuacagauuauauguuugucaaguggaaaguugaauacauaaagaccgaggccauagugugcguugagcucaauagccaagaaaggcagugcagcuugauugaggcaggcacaagauucaacuuggguccugugaccaucacguugucagaaccaagaaacauucagcagaagcuuccuccugaaauaaucacauugcauccuagaauugaggaagguuucuucgaucugaugcauguucaaaaggugcugucugcaaguacaguaugcaagcuacaaagcugcacacauggugugccaggagacuuacagaucuaccacauuggcaacuuguuaaaaggggauaggguaaaugggcaucugauucacaaaauugagccacacuucaacacuucuuggauguccugggauggcugugaccuagauuacuacuguaacaugggggauuggcccucuugcacauauacuggagugacccaacauaaccaugcugcuuuuguaaacuuacuuaacaucgaaacugauuacacaaagaacuuccauuuucauucuaaaaggguuacugcccauggagacaccccacaacuggaucuuaaagcuagaccaacuuacggugcgggugaaaucacuguucugguggagguugcugacauggaguuacacacaaaaaagauugcgauaucaggucugaaauuugcaaguuugacuugcacagguugcuaugcuuguagcucuggcaucuccuguaaagucaggauucauguggaugaaccagaugagcuuacaguacaugugaaaagugaagauccggacauuguugcagccagcucaagccucauggcaaggaagcuugaauuugggacagacagcacauucaaggccuucucagccaugcccaaaaccuccuugugcuucuacauuguagagagagaauacugugagagcugcagcaaagaagacacacagaaauguguuaacacaaagcuugagcaaccacaaagcauuuuaauugagcacaaaggaacgauaaucggaaagcaaaaugacacuugcacagccaaagcaagcugcugguuagagucaguaaagaguuuuuuuuauggauugaagaacaugcuuagcggcaucuucggcaacguuuuuauaggcauuuucuuauuccuugcuccuuuuauucuguuaauacucuucuuuauguuuggguggagaauccuguuuugcuuuaaguguugcagaaggaccagaggcuuauucaaguacagauaucucaaggacgacgaagagucugguuacagaagaaucauugaaagauuaaacaacaaaaaaggaaaaaacaaguuacuugacggugaaagacuagcugacaggaggaucgcugaguuguucucuaccaaaacacacauugguuaa

SEQ ID NO: 3631 - RNA, 5055 nt, Artificial Sequence
  derived and/or modified CDS sequence (wt) from CCHFV(SPU 18/88)__KJ682810.1__GP
auguacacaccacuauugugugcuauucuuuguuugcagcuguggagcuuagaaggaauuuauggauuguccaacaaaacccaacacaaugacacuaguaccauaaaggugcccgaagagagucaaaaaaccagucuacccgcgaacacagcaucgcccaucacgucagaccccuccuccgccacauccacagcauuagccaguggaccagaaggcucaggggacacgagcaccucuccaucagucaccacacaaggcccgacccuacuagaaaccacgccagagccccacacaacaauugacaucgaugaaucaagcacagccaucgcugacaucagcacacagacagucaaggacauccccacaccaacaacccacaccaguuugcccagcacucccagcgcgccaacuauaccgcaagaagcacaucacacugcaagaggccuacugucagucaccagcacaaaaccaggagaaacaucaacaccaacaagcccaggggaagcaagcacagaggccagcagcccacagccaacuaucagcgaaacaccauccccccccccaacaacccaagcacccaccgaaaucaacaaccccaacacauccagacagcccaugcccucaacacaaccagcagcucccaacucagugaccccuccaguacagccaaccuucucucagagugacguuuccacgguugcucaagauauacaccccagcccaacaaacagaucuaaaagaaaucuugaaauggaaauaauuuugacuuuaucucaagguuugaagaaguacuacggcaagguacuaaaacuucuggaucuuacuuuagaagaagacacugaaggccuguuagagugguguaagagaaaccuuggucugaccugcgaugacaacuucuuucagaagagaauagaagaguuuuuuuuaacuggugaaggucacuucaaugaaguguugcaguucaaaacaccaagcacacugagcccuacggaaccagcucguguugagucaccgacaguagaacccuuuaaaucuuacuuugcuaaaggcuuccucucaauggacucagguuacuucuccgccaaguguuacccaaagucauccaauucaggacuucagcugaucaacgucacccaacauucaauuagaauaacagacacaccugggccuaagaucacuagucugaaaaccaucaauugcauaaacuugaaggcauuagucuucaaagagcauagggagauugaaaucaauguucuccucccucaagucgcggucaaucucucaaacugccaugugcugaucaaaucucaugcuugugauuacucuuuagacaucgacgggccgguaagacugccccguauccaccaugaaggaacuuuuauaccaggaacuuacaaaauaguuauagacaaaaaaaacaagcagaacgacagaugcacuuuggucacuaacugugugauaaaaggaagggaaauucgcaaaggccagucaguguuaaggcaauacagaacagaaauuaagauuggcaaagcaucuucugguucuagaagacuauugucugaagagucuaaugaugacuguuuaucaaggacucagcuauugaggacagaaaaugcggaaauucacagugacaacuauggugguccaggugacaagauaacuaucugcaacgguucaacuauuguagaucagagacugggcagugaacuaggauguuacacuaucaauagagugaaaucauuuaagcucugugaaaacagugcuacagguaaaucuugugaaauagauagcaccccagucagauguaggcaggguuuuugcuugaaaauuacucaggagggaaggggccacgugaagcuaucaagaggcucagaaguugucuuggacgccugugauucaagcugugaaauaaugauaccaaagggcacuggggacauccuaguugacuguucaggugggcagcaacauuuccuaaaagauaaccugguugaucuaggaugccccaacaucccacuguuaggcaaaauggccaucuacauuuguagaaugucaaaucaucccaagacaacuauggguuuccuuuuuugguuuagcuuugguuaugugauaaccuguauacuuuguaaaguaaucuucuaucuauuaauaguuguagggacauuagggaaaaaguucaaacaguacagagaguuaaaaccucagaccuguaccauaugugaaacgaauccuguuaaugcaauagaugcugagaugcacgaccucaacuguaguuacaauauauguccuuauugugcaucuaggcugaccucagauggucuugccagacauguaaugcaaugccccaaacggaaggaaaaaauagaagaaaccgaauuauauuuaaacuuagaaagaauccccuggguuguuaggaaauuacugcaggugucagaauccaccgguguagcacuaaagaggaguaguuggcugguuauacuacuugugcuacucacaguuucauugucaccaguacaaucagcaccuaucagccauggagagacagucgaaguauaucaaaccagagaaggguacacaaguauuugccuuuuuguacuagggagcauccuguuuuugguauccugccugaugaagggguugguugacagugucggcaauaguuuuuccccuggcuuguccauuuguaagacauguucuauuggcaguauaaacggcuuugaaauugaaucucacaaauguuacuguagucuguuuugcugccccuacuguaggcacugcucugccgauauagaaauacauaaguugcacuuaagcaucugcaagaaaagaaaaacugggaguaaugucauguuagccgucuguaagcgcaugugcuuuagggcaacuguggaaguaagcaauaaagcuuuacuuauccgaaacaucaucaacaccacuuuuguugugugcauacugauauuagcaguuuguguugucagcaccucugcaguggagauggaaaaccugccagcaggcacuugggaaaaagaggaagaccugacaaauuucugucaucaggaaugccagguaacugagacugaaugccucuguccuuaugaagcucuugugcuaaggaaacccuuguuuuuggacaguauuguuaaaggcaagaagaacuugcuaaauucaacaagccuagaaacaagcuuaucaauugaggcaccauggggggcaauaaauguccagucaacuuucaaaccaacugugucagcugcaaacauagcgcuuaguuggagcucaguagaacauagaggcaauaaaauuuugguuucaggcagaucagagucaaucaugaaauuagaggaaaggacaggaauuagcugggaucuggguguggaagacgccucugaguccaaauugcucacugucucuguuauggacuugucacaaauguauucuccugucuuugaguaccuaucaggugauagacaaguggaggaauggcccaaggcaaccugcacaggagauugcccagagagaugcggcugcacgucaucaaccugccuacacaaggaauggccccauucaagaaacuggagaugcaacccuacuugguguuggggagucggcacuggaugcaccuguugugggcuggaugugaaagaccucuuuacagauuacauguuugucaaguggaaaguugacuacauuaaaacagaagcuauaguguguguugagcuuacuagccaggaaagacaauguagcuuaauugaggcaggcacaagauucaacuuggguccugugaccaucacauugucagagccaagaaacauucagcaaaagcucccuccagaaauagucacauugcauccuaggauugaagaaggcuucuuugacuuaaugcauauacaaaaagugcuaucagcaaguacaguaugcaagcuacagaguugcacacauggcgugccaggagaccuacagaucuaccacauuggaaacuuguuaaaaggagacaaggugaacgggcaccugauucacaaaauugaaccacacuucaacacuuccuggaugucuugggacggcugugaccuagacuacuacuguaauaugggggauuggccaucuugcucauauacuggcguaacccaacacaaucaugcugcauuuguaaacaugcucaacaucgaaacugauuauacaaaaaacuuccacuuucacucuaagagaguuacagcacauggagacacaccacaauuagauuuaaaagcuagaccaacuuauggugcaggugaaaucacugugcugguagagguugcagacauggaguugcauacaaagaaaauugagauaucagguuugaaguuugcaagcuuaacuugcacaggcuguuaugcuuguaguucugguaucuccuguaagguuaggauccauguagaugaaccagaugagcuuacaguacaugugaagagcgaggacccagacauaguugcugcuaguucaagucucauggcuaggaagcuugaauuugggacagauagcacauuuaaagccuuuucagccaugcccaaaaccuccuugugcuuuuacauuguggagagggaauacugcaaaagcuguaguaaagaagacacacaaaaaugugucaacacaaagcuugaacaaccacaaagcauuuuaaucgagcacaaagggacgauaauugggaagcagaacgacacuuguacaggcaaagcagguugcugguuagagucaaucaagaguuuuuuuuauggacuaaagaauaugcuuaguggcauuuuuggcaauguuuucauagggauuuucuuauuccuagcuccuuuuaucaugcuaauacuuuucuucauguuuggauggaggauccuguucugcuuuaaguguugcagaagaacuagaggccuauuuaaguauagacaccucaaagacgaugaagaaaucgguuacaggaaaaucauugagaggcuaaaaaacaaaaaagggaaaaacaaacugcuugauggugaaagacuagcugauaggaagaucgcugagcuguucucuacaaaaacacacauuggcuaa

SEQ ID NO: 3632 - RNA, 5055 nt, Artificial Sequence
  derived and/or modified CDS sequence (wt) from CCHFV(66019)__AB069669.1__GP
auguauacacuguuagugugugcuguucucuguccacagcuguggagucuggaagggacccauguuccacacaacgagacuaaacacaauggaacuggcaucacagcagcaccuggagagagucaaggccccaugucgccugcgagcacagcagugccccucacaccggaacccccaaacaccaaaccugcagcaucagccagcgaacuggaaagcucgggggaagggcacaccucccuuuuagccaccacacaaggucugacuucgccggaggccacgccggagcucccaacaacaaccgacacaggcguaucaagcacaagcgucgucgacauuggcacacagauggccaaagacacucccacaucgacagcccacacaagccugcccagcaaucccagugcaccauccacagcacaaggcacacaucacacuauaagaggucugcugucaguuaccagcaccaagccagaagaagcaucaacaccaacagacccaggaaaggcgggugcagagaccggcagcccaagaccagccaucagcagaaaaccaacccucucaccaacagcugaagcucccacugaaaucaacaacucuagcacccccaaacaacccgagcccucaauacaaccagcaaccccaagccuagugaucucuccagcacagccagccuucccacagagugcuacuuccacagcugcucaagauauauacucuagcccaacaaacagaucuaaaagaaaccuuaagauggaaauaauuuugacuuugucucaaggucuaaagaaguacuacgguaagauacaaaaaacucugggucucaccuuagaagaagacacugaaggucugcuggagugguguaagagaaaucuuggucugaccugugaugauaauuucuuccaaaagagaauagaagaguuuuuuuugaccggugaaggcuacuucaaugaaguuuuacaguuuaaaacaccaagcacaccaggcuccacagaaccgacucauaccgaggcaccaacaguuaaacccuuuaaaucuuacuuugcuagaggcuuccuuacaauagacucagguuacuucucugccaagugcuauucaaggacuucuaacucaggacuucaguugaucaacgucacccagcauccagccagaauagcagacacaccuggacccaagaucacuaaucugaagaccaucaauuguauaaacuuaaaagcaucagucuuuaaagagcauagagagaucgaaaucaaugugcuucucccacaagucgcggucaaccucucaaacugccacguucugaucaaaucacaugucugugacuacucuuuagacaucgaugggacaauaagacuaccucguaucuaccaugaaggaacauuuauaccaggaaccuauaaaauaguaauagacaaaagagauaagcaaaacgacagaugcaccuuggucaccaauuguguaauaaaaggaagggagguucguagaggccagucagcauuaaggcaauacaggacagaaaucagaauaggcaaggcaucugcuggcucuagaagauugcuguccgaagagucuggugacgacugcauaucuagaacucagcuauugaggacagagacugcagagguccauggugacaacuauggugguccaggugacaaaauaacuaucuguaaugguucaaccauuguggaucaaagacuuggcagugaacugggguguuauacuaucaauagagugaagucauucaagcuaugcgaaaauaguggcacgggaaaauccuguaagauagauaacaccccaguuaagugcaggcaggguuuuugcuuaaaaauuacucaggaaggaaggggccaugugaagcuaucgagaggcucagaaguugucuuagaugccugcgacucaagcugugaaauaaugauaccgaagggcacaggagacauccuaguagacuguucaggugggcaacaacauuucuuaaaagauaacuugguugaucuaggaugcccuaacauuccacuauuagguaaaauggcuaucuacauuugcaggaugucaaaucacccuaaaacaacuauggcuuuucucuuuugguuuaguuucggcuauguaauaacauguauauuuuguaaaaucauuuuuuacuuguugauagucguggggacauuggggaaaaaguucaaacaguaccgggagcugaaaccucagacuuguacuauaugugaaacaacuccuaccaaugcaauagaugcugaaaugcacgaucuuaaaugcaguuacaauauaugcccuuauugugcaucuagauuaaccucggacgggcuugccaggcaugugacacaaugcccuaagcgaaaagagaaaguagaagagacugaacuguacuugaacuuggaaagaauuccuuggauugucagaaaacuacugcaagugucagagucuaccgguguggcacugaaaaggagcaguuggcuaauuguguuacuugugcuacuuacaguuucauugucaccgguucaaucagcacccauuggacauggaaagacaauugaggcauaucagaccagagagggguacacaaguguuugccuguuuaugcugggaggcaucuuguuuguggucuccugccugaugaaagggcuaguugacagugucagcaacagcuuuuucccuggguuaucuauuugcaaaaccuguucuaucggcaguguaaauggcuuugaaauugaaucccauaaauguuacuguagcuuacuuuguugccuuuauuguagacauugcucugcugauagggaaauccaccaauugcacuugagcaucugcaaaaaaagaagggcaggaggcaaugucaugcuggcugucugcaagcgcaugugccucagagcaacuauggagguaagcaauaagguccuauucauccgaaguauuaucaacaccacuuuuguuauaugcauacugguauuggcagucuguaucguuagcaccuccgcaguagagauggaaagccuaccagccggcacuugggaaagggaggaagaccugacaaacuucugccaccaggaaugccaagucacagagacugaaugucucuguccuuacgaggcucuuguacucaggaaaccccuauucucagacaguauagucaagggcaugaaaaaccugcuaaauucaacuagcuuggaaacaagcuuaucaauugaagcaccauggggagcaauaaacguccagucaaccuuuaaacccaccguuucaacugcaaacauagcacuuagcuggaguucaguagaacacagagguaacaaaauuuuggucucaggcagaucagaaucaauuaugaagcuagaagaaaggacaggaaucagcugggaucugggcguagaagaugccucugagucuaaguugcuuacuguuucugucauggauuugucacagauguauucuccugucuuugaguacuuaucaggugacagacagguagaggaguggcccaaagcaaccugcacagguaauugcccagauagguguggcugcacaucaucaaccugcuuacacaaggaauggccccauucaaggaauuggagaugcaaccccacuugguguuggggagucggcacuggaugcaccugcuguggacuagaugugaaagaucuuuuuacagauuauauguuugucaaguggaaaguugaauacauaaagaccgaggccauagugugcguugagcucaauagccaagaaaggcagugcagcuugauugaggcaggcacaagauucaacuuggguccugugaccaucacguugucagaaccaagaaacauucagcagaagcuuccuucugaaauaaucacauugcauccuagaauugaggaaggcuucuucgaucugaugcauguucaaaaggugcugucugcaaguacaguaugcaagcuacaaagcugcacacauggugugccaggagacuuacagaucuaccacauuggcaacuuguuaaaaggggauaggguaaaugggcaucugauucacaaaauugagccacacuucaacacuucuuggauguccugggauggcugugaccuagauuacuacuguaacaugggggauuggcccucuugcacauauacuggagugacccaacauaaccaugcugcuuuuguaaacuuacuuaacaucgaaacugauuacacaaagaacuuccauuuucauucuaagagaguuacugcacauggagacacaccacagcuggauuugaaagcuagaccaacuuacggugcgggugaaaucacuguacuaguggagguugcugacauggaguuacacacaaaaaagauugcgauaucaggucugaaauuugcaaguuugacuugcacagguugcuaugcuuguagcucuggcaucuccuguaaagucaggauucauguggaugaaccagaugagcuuacaguacaugugaaaagugaagauccggacauuguugcagccagcucaagccucauggcaaggaagcuugaauuugggacagacagcacauucaaggccuucucagccaugcccaaaaccuccuugugcuucuacauuguagagagagaauacugugagagcugcagcaaagaagacacacagaaauguguuaacacaaagcuugagcaaccacaaagcauuuuaauugagcacaaaggaacaauaaucggaaagcaaaaugacacuugcacagccaaagcaagcugcugguuagagucaguaaagaguuuuuuuuauggauugaagaacaugcuuagcggcaucuucggcaacguuuuuauaggcauuuucuuauuccuugcuccuuuuauucuguuaauacucuucuuuauguuuggguggagaauccuguuuugcuuuaaguguugcagaaggaccagaggcuuauucaaguacagauaucucaaggacgacgaagagucugguuacagaagaaucauugaaagauuaaacaacaaaaaaggaaaaaacaaguuacuugacggugaaagacuagcugacaggaggaucgcugaguuguucucuaccaaaacacacauugguuaa

SEQ ID NO: 3633 - RNA, 5052 nt, Artificial Sequence
  derived and/or modified CDS sequence (wt) from CCHFV(Gaib)__KX013445.1__GP
auguauauaccauuaguguaugcuguuaucuaccuacagcuguaugguuugggaggagcacaugggcugcucaacaagacugaacaaaaugaaacaggcauuacagcgacgcacggaaggguucagggcccuccaucugcaagcauaacauugccugucacaccggauccucuuuccgccacaucagcagcaucaaccagcggaccagaggguucaggggaggugccuacaucaccuucaacuaucacacaaggccugaccucaucugaaaacacgccgcagcuccccacagcaaccgacacagguauaucaagcacaagcaucauugaugucaguacacagacagcuggagacaccuccacaccaacagcccacacgaguuugccuaacagcccuagugcgccguucacaucacaagacacacgucauacuguaaggggucuacugacagugaccagcaccaagucggaugaagcaucaacacuaacagacccaaaagaagcaagcacagaggccagaagccccaguccauccaucagcagaacaccaaccccauccccaacaguccaagccuccacugaaaacaauacccccaguacccccagacaacccgagcccaccacacggccagcucucccaaguccaacgaccucaccaacacagccaagccucucacagagcgccaccuccgcagccauucaggacaugcaucccagcccaacaaacagguccagaaggaaucuugagauggaaauaauuuugacuuuaucucaaggccugaagaaguauuacgguaagauacuaaaacuucuggaucucacccuagaagaagauacugagggccugcuagaguggugcaagagaaaucuugaucugaccugugaugaaaauuucuuucuaaagagaauagaagaguuuuuuuuguccggugagggucacuuuaaugaaguuuugcaguuuaaagcaccaagcacaaugagcuccacagaaccgacucaugcagggccaccgacaguugaaccuuucaaaucuuacuuugcuaagggcuuccuuucaauagauucagguuauuuuucugccaaauguuauccaaggacuucuaauucaggucuucaguugaucaaugucacccagcacacagcuagaauagcagacacaccuggacccaagaucaccaauguaaagaccaucaauuguauaaacuugaaggcaucagucuuuaagaagcauagggagguugaaaucaaugugcuucucccucagauugcggucaaccucucaaacugccacguccugaucaaaucacaugucugugacuauucuuuaaacuucgaugggauggugagacuaccccgcauccaccaugaaggaacuuuuauaccuggaacuuacaaaauagugauagauaggaaaaacaagcaaaaugacagaugcaccuuggucaccaacuguguaauaaaaggaagggaaguccguaagggccagucagcacugaggcaauacaggacagagaucaaaauuggcgaggcaucuauuggaucuagaagacugcuguccgaagaauccagugaugacugcauaucaagaacucagcuauuaaggacagagacugcagaaauccauaaugauaauuauggagggccaggugacaaaauaacuauuuguaaugguucaacuauuguagaucaaaggcuaggcagugaacugggauguuacacuaucaauagaguaaagucauuuaagcuaugcgaaaacagugcuacagggaaauccugugaaauagauagcaucccuguaaagugcaggcaaggguuuuguuuaaaaauuacucaggagggaagaggccaugugaaguugucaagagguucagaaguugucuuagaugccugugauucaagcugugaaauaaugauaccaaaaggcaccggagacauccuaguggacuguucaggugggcaacaacauuuuuuaaaggauaacuugauugacuuagggugucccaauaucccacuguuaggcaaaauggcuaucuacauuuguagaaugucuaaucaucccaaaacaaccauggccuuucucuuuugguuuaguuuugguuaugugauaaccuguauauuuugcaaagccaucuuuuauuuguugauaaucguggggacacuuggaaaaaaguucaaacaguauagagaguuaaaaccucagaccuguaccauaugugaaacaacuccugucaacgcaauagacgcugaaaugcaugaucuuaacugcaguuacaauauaugcccuuauugugcaucuagauuaaccucagauggacuugccagacacguugugcacugcccuaagcggaaggagaaaauagaagagacugaacuguacuuaaacuuagaaagaguuccuuggguuguuagaaaacuacuucaggugucugaaucaacugguguggcacugaagaggagcaguuggcuaauugugcuacuugugcuacuuacagucucauugucaccaguucaaucagcacccaucggucauggaaagacgauugagacuuaucaaacuagagaaggguacacaagcauuugucuauuuguacuagguggcaucuuguuuaucgucucuugccuaaugaaggggcugguugacagugucggcaauaauuuuuucccuggguuaacuaucugcaaaacauguuccaucagcaguauaaacggcuuugaaauugaaucccacaaaugcuacuguaguuuacuuugcugcccuuauuguagacacugcucugcugacagagagauacaucaguugcaccuaaguaucugcaaaaaaagaaaaacagggaguaaugucauguuagccgucugcaagcgcaugugcuuaaggguaacuacagaaguaagcaacagggcucuauucauccgaagcaucaucaacaccacauuuguuauaugcauacuuauacuagcagucugcguuaucagcaccuccgcaguagagauggaaaaccugccagcaggcaccugggagagagaagaagaccuaacaaacuucugucaccaagaaugucaaguaacggagacugaaugucuauguccuuacgaagcucuugugcucaggaaaccccuguucucagacagcauaguuaagggcaugaaaaaccugcugaacucaacaaguuuagagacaaguuuaucaauugaggcaccauggggagcgauaaauguccaaucaaccuuuaaaccuacuguaucaacugcaaauauagcacucaguuggagcucaauagagcacagaggcaacaagauucuggucucaggcagaucagagucaaucaugaagcuagaagagaggacaggaaucagcugggaccuaggcguggaagaugcuuccgagucuagguuacuuacuguuucuguuauggauuugucacaaauguacucucccguuuuugaauaccugucaggugacagacagguggaggaauggccuaaagcaaccugcacaggcgacuguccugaaagauguggaugcacaucgucaaccugcuuacacaaagaauggccucauucaagaaauuggagaugcaaucccacuuggugcuggggaguugguaccgggugcaccugcuguggacuagauguaaaagaccuuuuuacagacuauauguuugucaaauggaaagucgaguacauaaagacagaggcuauaguguguguugaacuuacaagccaagaaaggcaaugcaguuugauugaggcaggcacaagauucaacuuagguccagugaccaucacauugucagaaccgagaaacauucagcaaaagcuuccuccugaaauaaucacauugcacccuagaauugaagaaggcuucuuugaccuaaugcacgugcagaaagugcugucugcuaguacgguguguaaacuacagaguugcacacacggugugccgggggaucuacaggucuaccacauuggcaauuuguuaaaaggggauaaggugaacggacaucugauucacaagauugaaccacacuucaacacuucuuggauguccugggaugguugugaccuggacuacuacugcaauaugggggauuggccuuccugcacguauacuggaguaacccaacauaaccacgccgcauuugugaaccugcucaacauugaaacugauuauaccaaaaacuuccacuuccacucuaagagaguuacugcacauggagacacaccgcaauuggauuugaaggcuagaccaaccuauggugcaggcgagaucacugugcugguagaaguugcugacauggagcuacacacaaaaaagauugagauaucaggccugaaauuugcgagucuaacuugcacagguugcuaugcuugcagcucuggcaucuccuguaaaguuaggauccauguagaugaaccagaugagcuuacagugcaugugaaaagugaagauccagacauaguugcagcuagcucaagucucauggcaaggaagcuugaauuugguacagacaguaccuuuaaagccuuuucagcuaugcccaaaaccucuuuaugcuuuuacauuguagagagagaauauugcaagagcugcaguagagaagacacacaaaaaugugucagcacaaaacuugagcaaccacagagcauuuuaauugaacacaaaggaacgauaaucggaaaacagaauaacaccugcacaacuaaaacaaccuguugguuggaaucaguaaagaguuucuuuuauggacuaaagaacaugcuuagcaguauuuuuggcaauguuuucgugggcauuuucucauuccuugccccuuucaucuuacugauacuuuucuucauguuuggguggagaauccuauuuugcuuuaaguguugcagaaggacuagaggcuuauuuaaguacagacaucucaaagacgaugaagagaccgguuauaggaggaucauugaaagauuaaacaacaaaaaaggaaagagcaaguugcuugauggugaaagguuggcugauaggaagauugcugagcuguucuccacaaaaacacacauuggauga

SEQ ID NO: 3634 - RNA, 5055 nt, Artificial Sequence
  derived and/or modified CDS sequence (wt) from CCHFV(SPU415/85)__DQ211635.1__GP
auguacacaccacuagugugugcuguuaucugccuacagcuguggaaucuaggagguacucuuguguucaucaacaggacccaacacaaugaaacaggcaccguggcaacacccgaaggaacccugagaccuaggcugccugugagcacagcacugcccaccaagucggaccgcccuucugucggacccgcagcaucguccaguggacuagagggcucaggggaaccgaauaccucccccucaaucaccacaaaaggccugaccccgccagagaccacgccagcacuccccacagcaaccgacacagaugcaucaagcacaggggucgucgaugucagcacgcagaugaccaaggacaucccuaugucgacggccuacacgaauccacccagcaccccuagcgcaccaucuacaccacaaggcacacaucacacugcaaggggccuacugucagucgcuaguacgaagucagaagaaguaucaaugucaacaagcccagcaaaaacaagcacagagaccagcagcccacccccagccaccagcgagacaccaacccccucuccaacaacucagguccccaccggaaacaauaacccuaacaccuccagacaaccuacgcccucagcacagccagcaaugucaaacccagcaacuucuccagcacagccaaaccuuucacagagugccccccccacugcugaucaaggcguacaccccagcccaacaaacagauccaagaggaaccuugaaauagaaauaauuuuaacuuuaucucaaggucugagaaaguacuauggcaagauacugaagcuucuggaccuuaccuuagaagaggacacugaaggccugcuagaaugguguaaaagaaaucuuggucuaaccugugaugauaacuucuuucagaagagaauagaagaguuuuuuuugacuggugaggguuacuucaaugaagucuuacaguucaagguaccaagcacacugagcuccacagagccgacucauaccaggccaccaacaguugaacccuucaaauccuacuucgcuaaaggcuuccuuucaaugaacucaggcuacuucucugccaaauguuauccaaggacaucuaacucgggacuucaguugaucaaugucaccaaacauucagcuaaaauagcagacacaccuggacccaagauuacuaauuugaagaccaucaauugcauaaacuuaagggcaucagucuucaaagaacauagagagguugagaucaauguacuucucccucaaguugcagucaaccucucaaacugccacgcacaaauuaaaucgcaugucugugacuacucuuuagccacugaugggauggugagauuaccucauauccaccaugaagggacuuucauaccaggaacuuacaaaauagugauagacaaaaaaaacaagcaaaacgauagguguaccuuggucacaaauuguguuauaaagggaagggaaguucguaagggccagucugcauuaagacaauacaagacagaaauuaggauuggcaaggcaucuucugguuccagaagacugcuguccgaggagucugauggugacuguauaucaagaacucaacuauugaggacagagacuacagaaauccacagugacaacuaugguggcccaggugacaaaauaacuaucugcaaugguucaacuauuguagaucaaagacuaggcagugaacugggguguuauacuaucaauagggugaagucauuuaagcuuugcgaaaacagugccacaggaaaaucuugugaaauagauagcaccccaguuaagugcagacaagguuuuugcuugaaaaucacucaagaagggaggggccacgugaagcugucgagaggcucggaaauugucuuggacgcuugcgauucaaacugugaaauaaugauaccaaagggcaccggagacaucuuaguugacuguucagguggacaacaacauuucuuaaaagauaauuugauugaucuuggaugucccaauaucccauuauuaggcaaaauggccaucuacauuugcagaauguccaaucauccuaaaacaaccauggccuuucucuuuugguuuagcuuugguuaugugauaaccuguauacuuuguaaggugaucuuuuaccuauugauaguugcagggacaguaggaaaaaaguucaaacaguauagagaguugagaccucagaccugcaccauaugugaaacaauuccugucaaugcaauagaugcugaaaugcaugaccucaacugcaguuacaauauauguccguauugcgcaucuagauuaaccucagauggucuugccagacauguaaugcaaugcccuaagcggaaggaaaaaguagaggaaacugaauuauacuuaaaccuagaaaggauucccuggguuguuaggaaauuauugcaaguuucagagucuaccgguguggcauugaagaggagcaguuggcugacagugcugcuuguguugcuuauagucucauugucaccggugcagucagcaccuauuggucauggaaagacaauugaaacauaucaggccagagaaggguacacaagcuucugccuuuuuauacuaggaagcaucuuguuuguagucucuugccuaguaaagggucuaauugacagugucgguaacagcuuuuucccuggauuguccauuugcaagacaugcucgauuggcaguauaaaugguuuugagauugaaucccacaaauguuacuguagucuauuuuguugcccuuauuguagacacugcucugccgauagagaaauccauaaguugcacuugagcaucugcaaaaaaagaaaaacugggagcaaugucauguuggccgucugcaagcgcaugugcuuuagagcaaccauagaaguuagcaauagggcucuacuuauccggaauaucaucaauacuacuuuuguuguguguauacugacacuagcaguuuguguugucagcaccucugcaguggagauggaaagucuaccagccggcacuugggagaaagaggaagaccuaacaaacuucugucaucaggaaugccaagucacugagacugaaugccucuguccuuacgaagcccuuguacucagaaaacccuuauuuuuagacaguauuguuaaaggcaugaagaacuugcuaaacucaacaagcuuggaaacaagcuuaucaauugaggcaccauggggugcaauaaauguccaaucaaccuucaaacccacugugucagcugcaaacauagcacuuagcuggagcucaguggaacacagaggcaacaagauuuugguuucaggcaggucagaaucaaucaugaagcuggaggaaaggacaggaaucagcugggaucugggaguagaagacgccucugaguccaaauugcucaccgucucugucauggacuugucacaaauguauucccccgucuuugaguaccugucaggugauagacagguagaagaguggcccaaggcgaccuguacaggcgauugcccagaaagauguggcugcacaucaucaaccuguuugcacaaggaauggccccauucaaggaacuggagaugcaaccccacuugguguuggggggucggcacuggaugcaccuguugugggcuagauguaaaagaccucuuuacagauuacauguuugucaaguggaaaguugaauacauaaaaacagaggccauagugugugucgaacuuacuagccaagaaaggcaauguagcuugauugaagcaggcacaagauucaauuuagguccugugacuaucacauuaucggagccaagaaacauucagcaaaagcucccuccagaaauaauuacauugcauccuagaauugaagaaggcuuuuuugacuuaaugcaugugcaaagagugcugucagcaagcacagugugcaagcuacagaguugcacacauggugugccaggagaccuacaggucuaccacaucggaaacuuguuaaaaggagacaagguaaacgggcaucugauucacaagauugaaccacauuucaacacuuccuggaugucuugggauggcugugaccuagauuacuacugcaauaugggggauuggccuucuugcacauacacuggaguaacccaacauaaccaugcugcauuuguaaauuugcucaauaucgaaaccgauuauacaaaaaacuuucauuuucacuccaagagaguuacugcacauggagacacaccacaauuagacuugaaggccagaccaacuuauggugcaggggagguuacuguacuaguggagguugcugacauggagcugcacacaaagaaaauugagauaucaggcuugaaguuugcaagucuaacuugcacaggcugcuaugcuuguagcucugguaucuccuguaaggucaagauccauguagaugaaccagaugagcuuacaguacaugugaagagugaagacccagacauaguugcugcaggcucaagucucauggcaaggaagcuugaauuuggggcagauaguacauucaaagccuuuucagccaugcccaaaaccuccuugugcuuuuauauuguggagagagaauacuguaagagcugcaguagagaggacacacgaaaauguguuaacacuaagcuugaucgaccacagagcauuuugaucgaacauaaaggaacgauuauuggaaagcaaaacaacacaugcacagcuaaagcaagcugcuggcuagagucagucaaaaguuuuuucuacggauugaagaauaugcuuaguggcauuuucgguaauguuuucauagggauuuucuuauucauugcuccuuuuguccuguuaauacuuuucuuuauguuuggguggaggauccuguucugcuuuaagugcugcagaagaaccagaggccuauuuaaguacagacaccucaaggacgaugaagaaaccgguuacaggaaaaucauugagaggcuaaauaacaaaaagggaaaaaacaaacuacuugauggggaaaggcuagcugauaggaaaaucgccgaguuauucuccacaaaaucacauaucggcuaa

SEQ ID NO: 3635 - RNA, 5055 nt, Artificial Sequence
  derived and/or modified CDS sequence (wt) from CCHFV(SPU 431/85)__KJ682812.1__GP
auguacacaccacuagugugugcuguuaucugccuacagcuguggaaucuaggagguacucuuguguccaccaacaggacccaacacaaugaaacaggcaccguggcaacacccgaaggaacccugagaccuaggcugccugugagcacagcacugcccaccaagucggaccgcccuucugucggacccgcagcaucguccaguggacuagagggcucaggggaaccgaauaccucccccucaaucaccacaaaaggccugaccccgccagagaccacgccagcacuccccacagcaaccgacacagaugcaucaagcacaggggucgucgaugucagcacgcagaugaccaaggacaucccuaugucgacggccuacacgaauccacccagcaccccuagcgcaccaucuacaccacaaggcacacaucacacugcaaggggccuacugucagucgcuaguacgaagucagaagaaguaucaaugucaacaagcccagcaaaaacaagcacagagaccagcagcccacccccagccaccagcgagacaccaacccccucuccaacaacucagguccccaccggaaacaauaacccuaacaccuccagacaaccuacgcccucagcacagccagcaaugucaaacccagcaacuucuccagcacagccaaaccuuucacagagugccccccccacugcugaucaaggcguacaccccagcccaacaaacagauccaagaggaaccuugaaauagaaauaauuuuaacuuuaucucaaggucugagaaaguacuauggcaagauacugaagcuucuggaccuuaccuuagaagaggacacugaaggccugcuagaaugguguaaaagaaaucuuggucuaaccugugaugauaacuucuuucagaagagaauagaagaguuuuuuuugacuggugaggguuacuucaaugaagucuuacaguucaagguaccaagcacacugagcuccacagagccgacucauaccaggccaccaacaguugaacccuucaaauccuacuucgcuaaaggcuuccuuucaaugaacucaggcuacuucucugccaaauguuauccaaggacaucuaacucgggacuucaguugaucaaugucaccaaacauucagcuaaaauagcagacacaccuggacccaagauuacuaauuugaagaccaucaauugcauaaacuuaagggcaucagucuucaaagaacauagagagguugagaucaauguacuucucccucaaguugcagucaaccucucaaacugccacgcacaaauuaaaucgcaugucugugacuacucuuuagccacugaugggauggugagauuaccucauauccaccaugaagggacuuucauaccaggaacuuacaaaauagugauagacaaaaaaaacaagcaaaacgauagguguaccuuggucacaaauuguguuauaaagggaagggaaguucguaagggccagucugcauuaagacaauacaagacagaaauuaggauuggcaaggcaucuucugguuccagaagacugcuguccgaggagucugauggugacuguauaucaagaacucaacuauugaggacagagacuacagaaauccacagugacaacuaugguggcccaggugacaaaauaacuaucugcaaugguucaacuauuguagaucaaagacuaggcagugaacugggguguuauacuaucaauagggugaagucauuuaagcuuugcgaaaacagugccacaggaaaaucuugugaaauagauagcaccccaguuaagugcagacaagguuuuugcuugaaaaucacucaagaagggaggggccacgugaagcugucgagaggcucggaaauugucuuggacgcuugcgauucaaacugugaaauaaugauaccaaagggcaccggagacaucuuaguugacuguucagguggacaacaacauuucuuaaaagauaauuugauugaucuuggaugucccaauaucccauuauuaggcaaaauggccaucuacauuugcagaauguccaaucauccuaaaacaaccauggccuuucucuuuugguuuagcuuugguuaugugauaaccuguauacuuuguaaggugaucuuuuaccuauugauaguugcagggacaguaggaaaaaaguucaaacaguauagagaguugagaccucagaccugcaccauaugugaaacaauuccugucaaugcaauagaugcugaaaugcaugaccucaacugcaguuacaauauauguccguauugcgcaucuagauuaaccucagauggucuugccagacauguaaugcaaugcccuaagcggaaggaaaaaguagaggaaacugaauuauacuuaaaccuagaaaggauucccuggguuguuaggaaauuauugcaaguuucagagucuaccgguguggcauugaagaggagcaguuggcugacagugcugcuuguguugcuuauagucucauugucaccggugcagucagcaccuauuggucauggaaagacaauugaaacauaucaggccagagaaggguacacaagcuucugccuuuuuauacuaggaagcaucuuguuuguagucucuugccuaguaaagggucuaauugacagugucgguaacagcuuuuucccuggauuguccauuugcaagacaugcucgauuggcaguauaaaugguuuugagauugaaucccacaaauguuacuguagucuauuuuguugcccuuauuguagacacugcccugccgauagagaaauccauaaguugcacuugagcaucugcaaaaaaagaaaaacugggagcaaugucauguuggccgucugcaagcgcaugugcuuuagagcaaccauagaaguuagcaauagggcucuacuuauccggaauaucaucaauacuacuuuuguuguguguauacugacacuagcaguuuguguugucagcaccucugcaguggagauggaaagucuaccagccggcacuugggagaaagaggaagaccuaacaaacuucugucaucaggaaugccaagucacugagacugaaugccucuguccuuacgaagcccuuguacucagaaaacccuuauuuuuagacaguauuguuaaaggcaggaagaacuugcuaaacucaacaagcuuggaaacaagcuuaucaauugaggcaccauggggugcaauaaauguccaaucaaccuucaaacccacugugucagcugcaaacauagcacuuagcuggagcucaguggaacacagaggcaacaagauuuugguuucaggcaggucagaaucaaucaugaagcuggaggaaaggacaggaaucagcugggaucugggaguagaagacgccucugaguccaaauugcucaccgucucugucauggacuugucacaaauguauucccccgucuuugaguaccugucaggugauagacagguagaagaguggcccaaggcgaccuguacaggcgauugcccagaaagauguggcugcacaucaucaaccuguuugcacaaggaauggccccauucaaggaacuggagaugcaaccccacuugguguuggggggucggcacuggaugcaccuguugugggcuagauguaaaagaccucuuuacagauuacauguuugucaaguggaaaguugaauacauaaaaacagaggccauagugugugucgaacuuacuagccaagaaaggcaauguagcuugauugaagcaggcacaagauucaauuuagguccugugacuaucacauuaucggagccaagaaacauucagcaaaagcucccuccagaaauaauuacauugcauccuagaauugaagaaggcuuuuuugacuuaaugcaugugcaaagagugcugucagcaagcacagugugcaagcuacagaguugcacacauggugugccaggagaccuacaggucuaccacaucggaaacuuguuaaaaggagacaagguaaacgggcaucugauucacaagauugaaccacauuucaacacuuccuggaugucuugggauggcugugaccuagauuacuacugcaauaugggggauuggccuucuugcacauacacuggaguaacccaacauaaccaugcugcauuuguaaauuugcucaauaucgaaaccgauuauacaaaaaacuuucauuuucacuccaagagaguuacugcacauggagacacaccacaauuagacuugaaggccagaccaacuuauggugcaggggagguuacuguacuaguggagguugcugacauggagcugcacacaaagaaaauugagauaucaggcuugaaguuugcaagucuaacuugcacaggcugcuaugcuuguagcucugguaucuccuguaaggucaagauccauguagaugaaccagaugagcuuacaguacaugugaagagugaagacccagacauaguugcugcaggcucaagucucauggcaaggaagcuugaauuuggggcagauaguacauucaaagccuuuucagccaugcccaaaaccuccuugugcuuuuauauuguggagagagaauacuguaagagcugcaguagagaggacacacgaaaauguguuaacacuaagcuugaucgaccacagagcauuuugaucgaacauaaaggaacgauuauuggaaagcaaaacaacacaugcacagcuaaagcaagcugcuggcuagagucagucaaaaguuuuuucuacggauugaagaauaugcuuaguggcauuuucgguaauguuuucauagggauuuucuuauucauugcuccuuuuguccuguuaauacuuuucuuuauguuuggguggaggauccuguucugcuuuaagugcugcagaagaaccagaggccuauuuaaguacagacaccucaaggacgaugaagaaaccgguuacaggaaaaucauugagaggcuaaauaacaaaaagggaaaaaacaaacuacuugauggggaaaggcuagcugauaggaaaaucgccgaguuauucuccacaaaaucacauaucggcuaa

SEQ ID NO: 3636 - RNA, 5055 nt, Artificial Sequence
  derived and/or modified CDS sequence (wt) from CCHFV(8402)__AB069674.1__GP
auguacacaccacuuuugugugcuguucuuugcuuacagcuguggaguuuagaagggucucauggacuguccaacaaaacccaacacaguaauacaagcaccacaaaggcgccugaaguaagccaggaacuuggauugccugugagcacaguaucgacuaucacgucagacccuccuuccaucacauccgcaguaucagucaguggaucagaaggcucaggagacacgaacaccucucccucggucaccacacaaggcccgacuuugccagaaaccacgcuggaaccccuaacaacaaccgacacagaugcaucaagcacugucgucgucgaugucagcacacagacggucaaggacaccccuauaucaacaaccuacacaaguuugcccaguacucccagcgagccaacuacaccacaggguacacaucauacugcaaggggucuacugucagucaccagcacaaagccagaagaagcaucaacacaagcaaauccaggaaaaauaagcauggagaccaauggcccgcgccuagccaucagcgagacaccauccuucucuccaacaacucaggcuccuaccgaaaacagcaaccccaucacauccaaacagcuuaugcucucagcacaaccaguaaccccaaacccaaugaccucuccaguacagccagcccucucucagagugacacguccacggccauccaagauguacacccaagcccaacaggcagaucuaaaagaaaccuugagauggaaauaauuuugacuuuaucucaagguuugaagaaguacuacggcaagauacuaaaacuucuggaccuuacuuuggaagaagacacugaaggccugcuagagugguguaagagaaaucuugguuuggucugugaugacaacuucuuucagaagaggauagaagaguuuuuuuugacugggaagggucacuucaaugaagucuuacaguucaaaacaccaagcacacuaagccccacgggaccagcccgaacugggucaccaacaguggaaccuuuuaaaucuuacuucgcuaaaggguuccuuucaauggacucaggcuacuucucugccaaguguuauccaagagcauccaauucaggacuucagcugaucaaugucacccaacauucaacuagaauaacagacacaccuggacccaagaucacuaaucugaagaccaucaauugcauaaacuuaaaggcaucagucuuuaaagagcauagagagauugaaaucaauguucuucucccucaagucgcaguuaaccucucaagcugccacguguugaucaaaucgcaugucugugacuacucuuuggacauugacgggccaguaagacuaccccgcauccaccaugaaggaacuuucauaccaggaacuuacaaaauaguuauagacaaaaaaaacaaacaaaaugauagaugcacuuuggucaccaacuguguaauaaaaggaagggaaauucguaagggccagucaguguuaagacaauacaggacagaaaucaagauuggcaaggcaucuucugguuccagaagacuauuguccgaagagucuggugaugacugcauaucaagaacucagcuauugaggacagagacugcggaaauucacaaugauaacuauggugguccaggugacaagauaaccaucugcaaugguucaacuguuguggaucagagauugggcagugaacugggguguuacacuaucaauagaguaaagucauuuaagcuuugcgagaacagugccacaggcaaauccugugaaauagauagcaccccagucaaaugcaggcaggguuucuguuugaaaauuacucaggagggaaggggccacgugaagcuaucgagagguucagaaguuguccuggacgccugcgauucaagcugugaaauaaugauaccaaagggcaccggagacauccuaguugacuguucagguggacagcaacauuucuuaaaagauaacuugauugaucuaggaugcccaaacaucccacuauuaggcaagauggcuaucuacauuuguagaaugucaaaucauccuaaaacgacuauggcuuuucuuuuuugguuuagcuuugguuauguggugaccuguauacucuguaaggucaucuucuaucuauuaauaguuguggggacguuggggaaaaaguucaaacaguauagagaguugaaaccucagaccuguaccauaugcgaaacaacuccuguuaaugcaauagaugcugaaaugcacgaccucaacugcaguuacaauauauguccuuacugugcaucuagguuaaccucagauggucuugccagacauguaaugcagugcccuaagcggaaggaaaaaauagaagaaaccgaauuauacuuaaacuuggaaagaauccccuggguuguuaggaaauuacugcaggugucagaauccaccgguguggcacuaaagaggaguaguuggcugguugugcuacuuguguuacuuacaguuucauugucaccaguacaaucagcaccuaucggccauggaaagacaguugaaacauaucaaaccagagaaggauacacaaguauuugccucuuuguacuaggaagcaucuuauuuauagucucuugccuaaugaagggguugguugacaguguugguaacaguuuuuucccugguuuguccauuuguaagacauguucuauuggcaguguaaauggcuuugagauugaaucucacaaauguuacuguagccuauuuuguugucccuacuguagacacugcucugccgauagagaaauacauagguugcacuugagcaucugcaagaaaaggaagacugggaguaaugucaugcuggccgucuguaagcgcaugugcuuuagggcaacuguggaaguaagcaacaaggcucuacucauccgaaacaucaucaacaccacuuuuguucugugcauacugauauuagcaguuuguguugucagcaccuccgcaguggagauggaaagccugccagcuggcacuugggagagagaggaagaucugacaaauuucugucaucaagaaugccaagucacugagacugaaugccucugucccuacgaagcucuugugcucaggaaacccuuguuuucagacagcauugucaaaggcaugaagaacuugcuaaauucaacaagcuuagaaacaagcuuaucaauugaggcaccauggggagcaauaaauguccaaucaaccuucaaaccuacugugucagcugcgaauauagcucuuaguuggagcucaguggaacacagggguaauaagauuuugguuucagguagaucagagucaaucaugaagcuagaggaaaggacaggaaucagcugggaucuagggguagaagaugcuucugagucuaaauugcuuacugucucuguuauggacuugucacagauguacucuccugucuuugaguaccuaucaggugacagacaaguggaggaauggcccaaggcaaccugcacaggagauugcccagaaagauguggcugcacaucaucaaccugccuacacaaagaauggccccauucaagaaacuggagaugcaaccccaccugguguuggggagucggcacuggauguaccugcugugggcuggauguaaaagaccuuuuuacagauuacauguuuaucaaguggaaaguugaguacauuaaaacagaagcuauaguguguguugagcuuacuagccaagagagacaauguaccuugauugaggcaggcacaagauucaacuuagguccugugaccaucacauugucagagccaagaaacauucagcaaaagcucccuccagagauaguuacauugcaccccagaauugaagaagguuucuuugauuuaaugcauguacaaaaggugcuaucagcaaguacaguguguaagcuacagaguugcacacauggugugccaggggaccuacaggucuaucacauaggaaacuuguuaaaaggagacaaggugaaugggcaccugauucacaaaauugaaccacacuucaacacuuccuggaugucuugggacggcugugaccuagacuacuacuguaauaugggggauuggccaucuugcacauauacuggaguaacccagcacaaucaugcugcauuuguaaacaugcucaacaucgaaacugauuauacaaaaaacuuccacuuucacucuaagagaguuacugcacauggagacacaccacaauuagauuugaaagcuagaccaacuuauggugcaggugaaaucacugugcugguggaaguugcugacauggaguuacacacaaagaaaauugagauaucagguuugaaguuugcaagcuuaacuugcacaggcuguuaugcuuguagcucugguaucuccuguaagguuagaauccauguagaugagccagaugagcuuacaguacaugugaagagugaagacccagacauaguugcugcuagcucaagucucauggcuagaaaacuugaauuugggacagauaguacauucaaagccuuuucagccaugcccaaaaccuccuuaugcuuuuacauuguggagagagaauauuguaaaagcugcagcaaagaagauacacaaaaaugugucaacacaaagcuugagcaaccacagagcauuuuaaucgagcacaaaggaacgauaauugguaagcagagcaacaccugcacagcuaaagcaagcuguuggcuagagucagucaagagcuucuuuuaugggcuaaagaacaugcuuaguggcauuuuuggcaauguuuucauagggguuuucuuauucuuugcuccuuuuauccuuuugauacuuuucuuuauguuuggauggagaauccuguucugcuuuaaauguugcagaagaacuagaggccuuuuuaaguacagacaccucaaggacgaugaagaaaccgguuacaggaaaaucauugagagacugaacaacaaaaaagggaaaaacaaacugcuugauggugaaagauuagcugauaggaagauugcugagcuguucuccacaaagacacacauuggcuaa

SEQ ID NO: 3637 - RNA, 5055 nt, Artificial Sequence
  derived and/or modified CDS sequence (wt) from CCHFV(SPU 383/87)__KJ682806.1__GP
auguacacaccacuauugugugcuauucuuuguuugcagcuguggagcuuagaaggaauuuauggauuguccaacagaacccaacacaaugacacuaguaccauaaaggugcccgaagagagucaaaaaaccagucugcccgcgaacacagcaucgcccaucacgucagacccccccuccaccacauccacagcaucagccaguggaccagaaggcucaggggacacgagcaccucucccccagucaccacacaaggcccgaccccaccagaaaccacgccagagccccacacaacaauugacaucgauaaaucaagcacagccaucgcugacaucagcacacagacagucaaggacauccccacaccaacaacccacaccaguuugcccagcacucucagcgcgccaacuauaccgcaagaagcacaucacacugcaaggggccuacugucaauuaccagcacaaaaccaggagaagcaucaacaccaauaagcccaggggaagcaagcacagaggccagcagcccacaaccaaccaucagcgagacaccauccccccccccaacagcccaagcucccaccgaaaucaacagccccaacacauccagacagcccaugcccucaacacaaccagcagcucccaacucagugacccauccagcacagccaacucccucucagagcgacguccccacggcugcucaagauauacaccccaauccaauaaacagaucuaaaagaaaucuugaaauggaaauaauucugacuuugucucaagguuugaagaaguacuacggcaagguacuaaaacuucuggaucuuacuuuagaagaagacacugaaggccuguuagagucguguaagagaaaccuuggucugaccugcgaugacaacuucuuucagaagagaauagaagaguuuuuuuuaacuggugaaggucacuucaaugaagugcugcaguucaaaacaccaagcacacuaagcccuacggaaccugcucguguugagucaccgacaguagaacccuuuaaaucuuacuuugcuaaaggcuuccucucaauggacucagguuauuucucugccaaguguuacucaaagucauccaauucaggacuucagcugaucaacgucacccaacauuuaauuagaauaacagacacaccugggccuaagaucacuaaucugaaaaccaucaauugcauaaacuugaaggcauuagucuucaaagagcauagggagauugaaaucaauguucuccucccucaagucgcggucaaccucucaaacugccaugugcugaucaaaucucauguuugugacuacucuuuagacaucgacgggccgguaagacugccccguauccaccaugaaggaacuuucauaccaggaacuuacaaaauaguuauagauaaaaacaacaagcagaacgacagaugcacuuuggucacuaacugugugauaaaaggaagggaaauucgcaaaggccagucaguguuaaggcaauacagaacagaaauuaagauuggcaaggcaucuucugguucuagaagacuauugucugaagagucuaaugaugacuguuuaucaaggacucagcuauugaggacagagaaugcggaaauucacagugacaacuauggugguccaggugacaagauaacuaucugcaacgguucaacuauuguagaucagagauugggcagugaacuaggguguuacacuaucaauagagugaaaucauuuaagcucugcgaaaacagugcuacagguaaaucuugugaaauagauagcaccccagucagauguaggcaggguuucugcuugaaaauuacucaggagggaaggggccacgugaagcuaucaagaggcucagaaguugucuuggacgccugcgacucaagcugugaaauaaugauaccaaagggcacuggggacauccuaguugacuguucaggugggcagcaacauuuccuaaaagauaaccugguugauuuaggaugccccaacaucccacuguuaggcaaaauggcaaucuacauuuguagaaugucaaaucaucccaagacaacuauggcuuuccuuuuuugguuuagcuuugguuaugugauaaccuguauacuuuguaaaguaaucuucuaucuauuaguaguuguagggacauuagggaaaaaguucaaacaguacagagaguuaaaaccucagaccuguaccauaugugaaacgaauccuguuaaugcaauagaugcugagaugcacgaccucaacugcaguuacaauauauguccuuauugugcaucuagguuaaccucagauggucuugccagacauguaauacaaugccccaaacggaaggaaaaaauagaagaaaccgaauuauauuuaaacuuggaaagaaucccuuggguuguuaggaaauuacugcaggugucagaauccaccgguguagcacuaaagaggaguaguuggcugguuauacuacuugugcuacucacaguuucauugucaccaguacaaucagcaccuaucagccauggagagacagucgaaguauaucaaaccagagaaggguacacaaguauuugccuuuuuguacuaggaagcauccuguuuuugguauccugccugaugaagggguugguugacagugucggcaauagcuuuuucccuggcuuguccauuuguaagacauguucuauuggcaguauaaacggcuuugaaauugaaucucacaaauguuacuguagccuauuuugcugccccuacuguagacacugcucugccgauauagaaauacauagguugcacuugagcaucugcaagaaaaggaaaacugggaguaaugucauguuagccgucuguaagcgcaugugcuuuagggcaacuguggaaguaagcaauaaagcuuuacuuauccgaaacaucaucaacaccacuuuuguugugugcauacugauauuagcaguuuguguugucagcaccucugcaguggagauggaaaaccugccagcaggcacuugggaaaaagaggaagaccugacaaauuucugucaucaggaaugccagguuacugagacugaaugccucuguccuuaugaagcucuugugcucaggaaacccuuguuuuuggacaguauuguuaagggcaugaagaacuugcuaaauucaacaagccuagaaacaagcuuaucaauugaggcaccauggggggcaauaaauguccagucaacuuucaaaccaacugugucagcugcaaacauagcgcuuaguuggagcucaguagaacauagaggcaauaaaauuuugguuucaggcagaucagagucaaucaugaaauuagaggaaaggacaggaauuagcugggaucuggguguggaagacgccucugaguccaaauugcucacugucucuguaauggacuugucacaaauguauucuccugucuuugaguaccuaucaggugauagacaaguggaggaauggcccaaggcaaccugcacaggagauugcccagaaagaugcggcugcacgucaucaaccugccuacacaaggaauggccccauucaagaaacuggagaugcaacccuacuugguguuggggagucggcacuggaugcaccuguugugggcuggaugugaaagaccucuuuacagauuacauguuugucaaguggaaaguugacuacauuaaaacagaagcuauaguguguguugagcuuacuagccaggaaagacaauguagcuuaauugaggcaggcacaagauucaacuuggguccugugacuaucacauugucagagccaagaaacauucagcagaagcucccuccagaaauagucacauugcauccuaggauugaagaaggcuucuuugacuuaaugcauauacaaaaagugcuaucagcaaguacaguauguaagcuacagaguugcacacauggcgugccaggagaccuacagaucuaccacauuggaaacuuguuaaaaggagacaaggugaacgggcaccugauucacaaaauugaaccacacuucaacaccuccuggaugucuugggacggcugugaccuagacuacuacuguaauaugggggauuggccaucuugcucauauacuggcguaacccaacacaaucaugcugcauuuguaaacaugcucaacaucgaaacugauuauacaaaaaacuuccacuuucacucuaagagaguuacagcacauggagacacaccacaauuagauuuaaaagcuagaccaacuuauggugcaggugaaaucacugugcugguagagguugcugacauggaguugcauacaaagaaaauugagauaucagguuugaaguuugcaagcuuaacuugcacaggcuguuaugcuuguaguucugguaucuccuguaagguuaggauccauguagaugaaccagaugagcuuacaguacaugugaagagcgaggauccagacauaguugcugcuaguucaagucucauggcuaggaagcuugaauuugggacagauagcacauuuaaagccuuuucagccaugcccaaaaccuccuugugcuuuuacauuguggagagggaauacugcaaaagcuguaguaaagaagacacacaaaaaugugucaacacaaagcuugaacaaccacaaagcauuuuaaucgagcacaaagggacgauauuuggaaagcagaacgacacuuguacagccaaagcaaguugcugguuagagucaguuaagaguuuuuuuuauggacuaaagaauaugcuuaguggcauuuuuggcaauguuuucauagggguuuucuuauuccucgcuccuuuuaucaugcuaauacuuuucuucauguuuggauggaggauccuguucugcuuuaaguguugcagaagaacuagaggcuuauuuaaguauagacaccucaaagacgaugaagaaaucgguuacaggaaaaucauugagaggcuaaacaacaaaaaagggaaaaacaaacugcuugacggugaaagacuagcugauaggaagauugcugagcuguucucuacaaaaacacacauuggcuaa

SEQ ID NO: 3638 - RNA, 5055 nt, Artificial Sequence
  derived and/or modified CDS sequence (wt) from CCHFV(SPU 497/88)__KJ682808.1__GP
auguacacaccacuauugugugccauucuuuguuugcagcuguggagcuuagaaggaauuuauggauuguccaacaaaacccaacacaaugacacuaguaccauaaaggugcccgaagagagucaaaaaaccagucugcccgcgaacauagcaucgcccaccacgucagacccccccuccgccacauccacagcaucagccaguggaccagaaggcucaggggacacgagcaccucucccucagucaccacacaaggcccgaccccacuagaaaucacgccagagccccacacaacaauugacaucgauaaaucaagcacauccaucgcugacaucagcacacggacagucaaggacauccccacaccaacaacccacaccaguuugcccagcacucccagcgcgccaacuauaccgcaagaaguacaucacacugcaaggggccuacugucagucaccagcacaaaaccagaagaagcaucaacacuaacaagcccaggggaagcaagcacagaggccagcagcccacaaccaaccaucagcgagacaccauccccucccccaacaacccaagcucccaccgaaaucaacaaccccaacacauccagacagcccaugcccucaacacaaccagcagcucccaacucagugaccccuccaguacagccaaccuucucucagagugacguuuccacggcugcucaagauauacaccccagcccaacaaacagaucuaaaagaaaucuugaaauggaaauaauuuugacuuuaucucaagguuugaagaaguacuacggcaagguacuuaaacuucuggaucuuacuuuagaagaagacacugaaggccuguuagagugguguaagagaaaccuuggccuaaccugcgaugacaacuucuuucagaagagaauagaagaguuuuuuuuaacuggugaaggucacuucaaugaaguguugcaguucaaaacaccaagcacacuaagcccuacggaaccagcucguguugagucgccgacaguagaacccuuuaaaucuuacuuugcuaaaggcuuccucucaauggacucagguuacuucuccgccaaguguuacccaaagucauccaauucaggacuucagcugaucaaugucacccaacauuuaauuaggauaacagacacaccugggccuaagaucacuaaucugaaaaccaucaauugcauaaacuugaaggcauuagucuucaaagagcauagggagauugaaaucaauguucuccucccucaagucgcggucaaccucucaaacugccaugugcugaucaaaucucauguuugugacuacucuuuagacaucgacgggccgguaagacugccccguauccaccaugaaggaaccuuuauaccaggaacuuacaaaauaguuauagauaaaaaaaccaagcaaaacgacagaugcacuuuggucaccaacugugugauaaaaggaagggaaauccgcaaaggccagucaguguuaaggcaauacagaacagaaauuaaaauuggcaaagcaucuucugguucuagaagacuauugucugaagagucuaacgaugacuguuuaucaaggacucagcuauugaggacagagaaugcggaaauucacagugacaacuauggugguccaggugacaagauaacuaucugcaacgguucaacuauuguagaucagagacugggcagugaacuaggguguuacaccaucaauagagugaaaucauuuaagcucugcgaaaacagugcuacagguaaaucuugugaaauagauagcaccccagucagauguaggcaggguuuuugcuugaaaauuacucaggagggaaagggccacgugaagcuaucaagaggcucagagguuguccuggacgccugugauucaagcugugaaauaaugauaccaaagggcacaggggacauccuaguugacuguucaggugggcagcaacauuuccuaaaagauaaccugguugaucuaggaugccccaacaucccacuguuaggcaaaauggccaucuacauuuguagaaugucaaaucaucccaagacaacuaugguuuuccuuuuuugguuuagcuuuggcuaugugauaaccuguauacuuuguaaaguaaucuucuaucuauuaauaguuguagggacguuaggaaaaaaguucaaacaguacagagaguuaaaaccucagaccuguaccauaugugaaacaaacccuguuaaugcaauagaugcugagaugcacgaccucaacugcaguuacaauauauguccuuauugugcaucuagguuaaccucagauggucuugccagacauguaaugcaaugccccaaacggaaggaaaaaauagaagaaaccgaauuauauuuaaacuuagaaagaaucccuuggguuguuaggaaauuacugcaggugucagaauccaccgguguagcacuaaagaggaguaguuggcugguuauacuacuugugcuacucacaguuucauugucaccaguacaaucagcaccuaucagccauggagagacagucgaaguauaucaaaccagagaaggguacacaaguauuugccuuuuuguacuaggaggcauccuguuuuugguauccugccugaugaagggguugguugacagugucggcaauaguuuuuucccuggcuuguccauuuguaagacaugcucuauuggcaguauaaacggcuuugaaauugaaucucacaaauguuacuguagccuauuuugcugccccuacuguagacacugcucugccgauauagaaauacacaaguugcacuugagcaucugcaagaaaaggaaaacuuggaguaaugucauguuagccgucuguaagcgcaugugcuuuagggcaacuguggaaguaagcaauaaagcuuuacuuauccgaaacaucaucaacaccacuuucguugugugcauacugauauuagcaauuuguguugucagcaccucugcaguggagauggaaaaccugccagcaggcacuugggaaaaggaggaagaccugacaaauuucugucaucaggaaugccaggucacugagacugaaugccucuguccuuaugaagcucuuguacucaggaaacccuuguuuuuggacaguauuguuaaaggcaugaggaacuugcuaaauucaacaagccuagaaacaagcuuaucaauugaggcaccauggggggcaauaaauguccagucaacuuucaaaccaacugugucagcugcaaacauagcgcuuaguuggagcucaguagaacauagaggcaauaaaauuuugguuucaggcagaucagagucaaucaugaaauuagaggaaaggacaggaauuagcugggaucuggguguggaagacgccucugaguccaaacugcucacugucucuguuauggacuugucacaaauguauucuccugucuuugaauaccuaucaggugauagacaaguggaggaauggcccaaggcaaccugcacaggagauugcccagaaagaugcggcugcacgucaucaaccugccuacacaaggaauggccccauucaagaaacuggagaugcaacccuacuugguguuggggagucggcacuggaugcaccuguuguggguuggaugugaaagaccucuuuacagauuacauguuugucaaguggaaaguugacuacauuaaaacagaagcuauaguguguguugagcuuacuagccaggaaagacaauguagcuuaauugaggcaggcacaagauucaacuuggguccugugaccaucacauugucagaaccaaggaacauucagcaaaagcucccuccagaaauagucacauugcauccuaggauugaagaaggcuucuuugacuuaaugcauauacaaaaaguacuaucagcaaguacaguauguaagcuacagaguugcacacauggcgugccaggagaccuacagaucuaccacauuggaaacuuguuaaaaggagacaaggugaacgggcaccugauucacaaaauugaaccacacuucaacaccuccuggaugucuugggacggcugugaccuagacuacuacuguaacaugggggauuggccaucuugcucauauacuggcguaacccaacacaaucaugcugcauuuguaaacaugcucaacaucgaaacugauuauacaaaaaacuuccacuuucacucuaagagaguuacagcacauggagacacaccacaauuagauuuaaaagcuagaccaacuuauggugcaggugaaaucacugugcugguagagguugcugacauggaguugcauacaaagaaaauugagauaucagguuugaaguuugcaagcuuaacuugcacaggcuguuaugcuuguaguucugguaucuccuguaagguuaggauccauguagaugaaccagaugagcuuacaguacaugugaagagcgaggauccagacauaguugcugcuaguucaagucucauggcuaggaagcuugaauuugggacagauagcacauuuaaagccuuuucagccaugcccaaaaccuccuugugcuuuuacauuguggagagggaauacugcaaaagcuguaguaaagaagacacacaaaaaugugucaacacaaagcuugaacaaccacaaagcauuuuaaucgagcacaaagggacgauaauuggaaaacagaacgacacuuguacagccagagcaaguugcugguuagagucaaucaagaguuuuuuuuauggacugaagaauaugcuuaguggcauuuuuggcaauguuuucauagggauuuucuuauucuucgcuccuuuuaucaugcuaauacuuuucuuuauguuuggauggaggauccuguucugcuuuaaguguugcagaagaacuagaggcuuguuuaaguauagacaccucaaagacgaugaagaagucgguuacaggaaaaucauugagaggcuaaacaacaaaaaagggaaaaacaaacugcuugacggugaaagacuagcugauaggaagaucgcugagcuguucucuacaaaaacacacauuggcuaa

SEQ ID NO: 3639 - RNA, 5055 nt, Artificial Sequence
  derived and/or modified CDS sequence (wt) from CCHFV(88166)__AB069675.1__GP
auguacacaccacuuuugugugcuguucuuugcuuacagcuguggaguuuagaagggucucauggacuguccaacaaaacccaacacaguaauacaagcaccacaaaggcgccugaaguaagccaggaacuuggauugccugugagcacaguaucgacuaucacgucagacccuccuuccaucacauccgcaguaucagucaguggaucagaaggcucaggagacacgaacaccucucccucggucaccacacaaggcccgacuuugccagaaaccacgcuggaaccccuaacaacaaccgacacagaugcaucaagcacugucgucgucgaugucagcacacagacggucaaggacaccccuauaucaacaaccuacacaaguuugcccaguacucccagcgagccaacuacaccacaggguacacaucauacugcaaggggucuacugucagucaccagcacaaagccagaagaagcaucaacacaagcaaauccaggaaaaauaagcauggagaccaauagcccgcgccuagccaucagcgagacaccauccuucucuccaacaacucaggcuccuaccgaaaacagcaaccccaucacauccaaacagcuuaugcucucagcacaaccaguaaccccaaacccaaugaccucuccaguacagccagcucucucucagagugacacguccacggccauccaagauauacacccaagcccaacaggcagaucuaaaagaaaccuugagauggaaauaauuuugacuuuaucucaagguuugaagaaguacuacggcaagauacuaaaacuucuggaccuuacuuuggaagaagacacugaaggccugcuagagugguguaagagaaaucuugguuuggucugugaugacaacuucuuucagaagaggauagaagaguuuuuuuugacugggaagggucacuucaaugaagucuuacaguucaaaacaccaagcacacuaagccccacgggaccagcccgaacugggucaccaacaguggaaccuuuuaaaucuuacuucgcuaaaggguuccuuucaauggacucaggcuacuucucugccaaguguuauccaagagcauccaauucaggacuucagcugaucaaugucacccaacauucaacuagaauaacagacacaccuggacccaagaucacuaaucugaagaccaucaauugcauaaacuuaaaggcaucagucuuuaaagagcauagagagauugaaaucaauguucuucucccucaagucgcaguuaaccucucaagcugccacguguugaucaaaucgcaugucugugacuacucuuuggacauugacgggccaguaagacuaccccgcauccaccaugaaggaacuuucauaccaggaacuuacaaaauaguuauagacaaaaaaaacaaacaaaaugauagaugcacuuuggucaccaacuguguaauaaaaggaagggaaauucguaagggccagucaguguuaagacaauacaggacagaaaucaagauuggcaaggcaucuucugguuccagaagacuauuguccgaagagucuggugaugacugcauaucaagaacucagcuauugaggacagagacugcggaaauucacagugauaacuauggugguccaggugacaagauaaccaucugcaaugguucaacuguuguggaucagagauugggcagugaacuaggguguuacacuaucaauagaguaaagucauuuaagcuuugcgagaacagugccacaggcaaauccugugaaauagauagcaccccagucaaaugcaggcaggguuucuguuugaaaauuacucaggagggaaggggccacgugaagcuaucgagagguucagaaguuguccuggacgccugcgauucaagcugugaaauaaugauaccaaagggcacuggagacauccuaguugacuguucagguggacagcaacauuucuuaaaagauaacuugauugaucuaggaugcccaaacaucccacuauuaggcaagauggcuaucuacauuuguagaaugucaaaucauccuaaaacgacuauggguuuucuuuuuugguuuagcuuugguuauguggugaccuguauacucuguaaggucaucuucuaucuauuaauaguuguggggacguuggggaaaaaguucaaacaguauagagaguugaaaccucagaccuguaccauaugcgaaacaacuccuguuaaugcaauagaugcugaaaugcacgaccucaacugcaguuacaauauauguccuuacugugcaucuagguuaaccucagauggccuugccagacauguaaugcagugcccuaagcggaaggaaaaaauagaagaaaccgaauuauacuuaaacuuggaaagaauccccuggguuguuaggaaauuacugcaggugucagaauccaccgguguggcacuaaagaggaguaguuggcugguugugcuacuuguguuacuuacaguuucauugucaccaguacaaucagcaccuaucggccauggaaagacaguugaaacauaucaaaccagagaaggauacacaaguauuugccucuuuguacuaggaagcaucuuauuuauagucucuugccuaaugaagggguugguugacaguguugguaacaguuuuuuuccugguuuguccauuuguaagacauguucuauuggcaguguaaauggcuuugagauugaaucucacaaauguuacuguagccuauuuuguugucccuacuguagacacugcucugccgauagagaaauacauagguugcacuugagcaucugcaagaaaaggaagacuuggaguaaugucaugcuggccgucuguaagcgcaugugcuuuagggcaacuguggaaguaagcaacaaggcucuacuuauccgaaacaucaucaacaccacuuuuguucugugcauacugauauuagcaguuuguguugucagcaccuccgcaguggagauggaaagccugccagcuggcacuugggagagagaagaagaucugacaaauuucugucaucaagaaugccaagucacugagacugaaugccucugucccuacgaagcucuugugcucaggaaacccuuguuuucagacagcauugucaaaggcaugaagaacuugcuaaauucaacaagcuuagaaacaagcuuaucaauugaggcaccauggggagcaauaaauguccaaucaaccuucaaaccuaccaugucagcugcgaauauagcucuuaguuggagcucaguggaacacagggguaauaagauuuugguuucagguagaucagagucaaucaugaagcuagaggaaaggacaggaaucagcuggaaucuagggguagaagaugcuucugagucuaaauugcuuacugucucuguuauggacuugucacagauguacucuccugucuuugaguaccuaucaggugacagacaaguggaggaauggcccaaggcaaccugcacaggagauugcccagaaagauguggcugcacaucaucaaccugccuacacaaagaauggccccauucaagaaacuggagaugcaaccccaccugguguuggggagucggcacuggauguaccugcugugggcuggauguaaaagaccuuuuuacagauuacauguuuaucaaguggaaaguugaguacauuaaaacagaagcuauaguguguguugagcuuacuagccaagagagacaauguaccuugauugaggcaggcacaagauucaacuuagguccugugaccaucacauugucagagccaagaaacauucagcaaaagcucccuccagagauaguuacauugcaccccagaauugaagaagguuucuuugauuuaaugcauguacaaaaggugcuaucagcaaguacaguguguaagcuacagaguugcacacauggugugccaggggaccuacaggucuaucacauaggaaacuuguuaaaaggagacaaggugaaugggcaccugauucacaaaauugaaccacacuucaacacuuccuggaugucuugggacggcugugaccuagacuacuacuguaauaugggggauuggccaucuugcacauauacuggaguaacccagcacaaucaugcugcauuuguaaacaugcucaacaucgaaacugauuauacaaaaaacuuccacuuucacucuaagagaguuacugcacauggagacacaccacaauuagauuugaaagcuagaccaacuuauggugcaggugaaaucacugugcugguggaaguugcugacauggaguuacacacaaagaaaauugagauaucagguuugaaguuugcaagcuuaacuugcacaggcuguuaugcuuguagcucugguaucuccuguaagguuagaauccauguagaugagccagaugagcuuacaguacaugugaagagugaagacccagacuuaguugcugcuagcucaagucucauggcuagaaaacuugaauuugggacagauaguacauucaaagccuuuucagccaugcccaaaaccuccuuaugcuuuuacauuguggagagagaauauuguaaaagcugcagcaaagaagauacacaaaaaugugucaacacaaagcuugagcaaccacagagcauuuuaaucgagcacaaaggaacgauaauugguaagcagaacaacacaugcacagcuaaagcaagcuguuggcuagagucagucaagagcuucuuuuaugggcuaaagaacaugcuuaguggcauuuuuggcaauguuuucauagggguuuucuuauucuuugcuccuuuuauccuuuugauacuuuucuuuauguuuggauggagaauccuguucugcuuuaaauguugcagaagaacuagaggccuuuuuaaguacagacaccucaaggacgaugaagaaaccgguuacaggaaaaucauugagagacugaacaacaaaaaagggaaaaacaaacugcuugauggugaaagauuagcugauaggaagauugcugagcuguucuccacaaagacacacauuggcuaa

SEQ ID NO: 3640 - RNA, 5055 nt, Artificial Sequence
  derived and/or modified CDS sequence (wt) from CCHFV(strain BA88166)__AF338470.1__GP
auguacacaccacuuuugugugcuguucuuugcuuacagcuguggaguuuagaagggucucauggacuguccaacaaaacccaacacaguaauacaagcaccacaaaggcgccugaaguaagccaggaacuuggauugccugugagcacaguaucgacuaucacgucagacccuccuuccaucacauccgcaguaucagucaguggaucagaaggcucaggagacacgaacaccucucccucggucaccacacaaggcccgacuuugccagaaaccacgcuggaaccccuaacaacaaccgacacagaugcaucaagcacugucgucgucgaugucagcacacagacggucaaggacaccccuauaucaacaaccuacacaaguuugcccaguacucccagcgagccaacuacaccacaggguacacaucauacugcaaggggucuacugucagucaccagcacaaagccagaagaagcaucaacacaagcaaauccaggaaaaauaagcauggagaccaauagcccgcgccuagccaucagcgagacaccauccuucucuccaacaacucaggcuccuaccgaaaacagcaaccccaucacauccaaacagcuuaugcucucagcacaaccaguaaccccaaacccaaugaccucuccaguacagccagcucucucucagagugacacguccacggccauccaagauauacacccaagcccaacaggcagaucuaaaagaaaccuugagauggaaauaauuuugacuuuaucucaagguuugaagaaguacuacggcaagauacuaaaacuucuggaccuuacuuuggaagaagacacugaaggccugcuagagugguguaagagaaaucuugguuuggucugugaugacaacuucuuucagaagaggauagaagaguuuuuuuugacugggaagggucacuucaaugaagucuuacaguucaaaacaccaagcacacuaagccccacgggaccagcccgaacugggucaccaacaguggaaccuuuuaaaucuuacuucgcuaaaggguuccuuucaauggacucaggcuacuucucugccaaguguuauccaagagcauccaauucaggacuucagcugaucaaugucacccaacauucaacuagaauaacagacacaccuggacccaagaucacuaaucugaagaccaucaauugcauaaacuuaaaggcaucagucuuuaaagagcauagagagauugaaaucaauguucuucucccucaagucgcaguuaaccucucaagcugccacguguugaucaaaucgcaugucugugacuacucuuuggacauugacgggccaguaagacuaccccgcauccaccaugaaggaacuuucauaccaggaacuuacaaaauaguuauagacaaaaaaaacaaacaaaaugauagaugcacuuuggucaccaacuguguaauaaaaggaagggaaauucguaagggccagucaguguuaagacaauacaggacagaaaucaagauuggcaaggcaucuucugguuccagaagacuauuguccgaagagucuggugaugacugcauaucaagaacucagcuauugaggacagagacugcggaaauucacagugauaacuauggugguccaggugacaagauaaccaucugcaaugguucaacuguuguggaucagagauugggcagugaacuaggguguuacacuaucaauagaguaaagucauuuaagcuuugcgagaacagugccacaggcaaauccugugaaauagauagcaccccagucaaaugcaggcaggguuucuguuugaaaauuacucaggagggaaggggccacgugaagcuaucgagagguucagaaguuguccuggacgccugcgauucaagcugugaaauaaugauaccaaagggcacuggagacauccuaguugacuguucagguggacagcaacauuucuuaaaagauaacuugauugaucuaggaugcccaaacaucccacuauuaggcaagauggcuaucuacauuuguagaaugucaaaucauccuaaaacgacuauggguuuucuuuuuugguuuagcuuugguuauguggugaccuguauacucuguaagggcaucuucuaucuauuaauaguuguggggacguuggggaaaaaguucaaacaguauagagaguugaaaccucagaccuguaccauaugcgaaacaacuccuguuaaugcaauagaugcugaaaugcacgaccucaacugcaguuacaauauauguccuuacugugcaucuagguuaaccucagauggccuugccagacauguaaugcagugcccuaagcggaaggaaaaaauagaagaaaccgaauuauacuuaaacuuggaaagaauccccuggguuguuaggaaauuacugcaggugucagaauccaccgguguggcacuaaagaggaguaguuggcugguugugcuacuuguguuacuuacaguuucauugucaccaguacaaucagcaccuaucggccauggaaagacaguugaaacauaucaaaccagagaaggauacacaaguauuugccucuuuguacuaggaagcaucuuauuuauagucucuugccuaaugaagggguugguugacaguguugguaacaguuuuuuuccugguuuguccauuuguaagacauguucuauuggcaguguaaauggcuuugagauugaaucucacaaauguuacuguagccuauuuuguugucccuacuguagacacugcucugccgauagagaaauacauagguugcacuugagcaucugcaagaaaaggaagacuuggaguaaugucaugcuggccgucuguaagcgcaugugcuuuagggcaacuguggaaguaagcaacaaggcucuacuuauccgaaacaucaucaacaccacuuuuguucugugcauacugauauuagcaguuuguguugucagcaccuccgcaguggagauggaaagccugccagcuggcacuugggagagagaggaagaucugacaaauuucugucaucaagaaugccaagucacugagacugaaugccucugucccuacgaagcucuugugcucaggaaacccuuguauuuagacagcauugucaaaggcaugaagaacuugcuaaauucaacaagcuuagaaacaagcuuaucaauugaggcaccauggggagcaauaaauguccaaucaaccuucaaaccuaccaugucagcugcgaauauagcucuuaguuggagcucaguggaacacagggguaauaagauuuugguuucagguagaucagagucaaucaugaagcuagaggaaaggacaggaaucagcuggaaucuagggguagaagaugcuucugagucuaaauugcuuacugucucuguuauggacuugucacagauguacucuccugucuuugaguaccuaucaggugacagacaaguggaggaauggcccaaggcaaccugcacaggagauugcccagaaagauguggcugcacaucaucaaccugccuacacaaagaauggccccauucaagaaacuggagaugcaaccccaccugguguuggggagucggcacuggauguaccugcugugggcuggauguaaaagaccuuuuuacagauuacauguuuaucaaguggaaaguugaguacauuaaaacagaagcuauaguguguguugagcuuacuagccaagagagacaauguaccuugauugaggcaggcacaagauucaacuuagguccugugaucaucacauugucagagccaagaaacauucagcaaaagcucccuccagagauaguuacauugcaccccagaauugaagaagguuucuuugauuuaaugcauguacaaaaggugcuaucagcaaguacaguguguaagcuacagaguugcacacauggugugccaggggaccuacaggucuaucacauaggaaacuuguuaaaaggagacaaggugaaugggcaccugauucacaaaauugaaccacacuucaacacuuccuggaugucuugggacggcugugaccuagacuacuacuguaauaugggggauuggccaucuugcacauauacuggaguaacccagcacaaucaugcugcauuuguaaacaugcucaacaucgaaacugauuauacaaaaaacuuccacuuucacucuaagagaguuacugcacauggagacacaccacaauuagauuugaaagcuagaccaacuuauggugcaggugaaaucacugugcugguggaaguugcugacauggaguuacacacaaagaaaauugagauaucagguuugaaguuugcaagcuuaacuugcacaggcuguuaugcuuguagcucugguaucuccuguaagguuagaauccauguagaugagccagaugagcuuacaguacaugugaagagugaagacccagacauaguugcugcuagcucaagucucauggcuagaaaacuugaauuugggacagauaguacauucaaagccuuuucagccaugcccaaaaccuccuuaugcuuuuacauuguggagagagaauauuguaaaagcugcagcaaagaagauacacaaaaaugugucaacacaaagcuugagcaaccacagagcauuuuaaucgagcacaaaggaacgauaauugguaagcagaacaacacaugcacagcuaaagcaagcuguuggcuagagucagucaagagcuucuuuuaugggcuaaagaacaugcuuaguggcauuuuuggcaauguuuucauagggguuuucuuauucuuugcuccuuuuauccuuuugauacuuuucuuuauguuuggauggagaauccuguucugcuuuaaauguugcagaagaacuagaggccuuuuuaaguacagacaccucaaggacgaugaagaaaccgguuacaggaaaaucauugagagacugaacaacaaaaaagggaaaaacaaacugcuugauggugaaagauuagcugauaggaagauugcugagcuguucuccacaaagacacacauuggcuaa

SEQ ID NO: 3641 - RNA, 5055 nt, Artificial Sequence
  derived and/or modified CDS sequence (wt) from CCHFV(SPU 130/89)__KJ682807.1__GP
auguacacaccacuauugugugcuauucuuuguuugcagcuguggagcuuagaaggaauuuauggauuguccaacaaaacccaacacaaugacaauaguaccacaaaggcgcccgaagagagucacaaaaccagucugcccgcgaacacagcaucgcccaucacgucagauccccccuccaccacauccacaacaucagccagugguccagaaggcucaggggacacgagcaccucucccccagucaccacacaaggcccggccucaccagaaaccacgccagagccccacacaacaauugacaucgauaaaucaagcacagccaucgcugacaucagcacacagacagucaaggacauccccacaccaacaacccacaccaguuugcccagcacucucagcgcgccaacuauaccgcaagaagcacaucacacugcaaggggccuacugucagucaccagacacaaaccaggagaagcaucaaaaccaacaagcccaggggaagcaagcacagaggccagcagcucacaaccaaccaucagcgagacaccauccccccccccaacaacccaagcucccaccgaaaucaacaaccccaacacauccagacagcccaugcccucaacacaaccagcagcucccagcucagugacccauccagcacagccaaccccaucucagagcgacguccccacggcugcucaagauauacaccccagcccaacaaacagaucuaaaagaaaucuugaaauggaaauaauauugacuuuaucucaagguuugaagaaguacuacggcaagguacuaaaacuucuggaucuuacuuuagaagaagacacugaaggccuguuagagugguguaagagaaaccuuggucugaccugcgaugacaacuucuuucagaagagaauagaagaguuuuuuuuaacuggugaaggucacuucaaugaaguguugcaguucaaaacaccaagcacgcuaagcccuacggaaccugcucguguugagucaccgacaguagaacccuuuaaaucuuacuuugcuaaaggcuuccucucaauggacucagguuacuucuccgccaaguguuacccaaagucauccaauucaggacuucagcugaucaacgucacccaacauuuaauuagaauaacagacacaccugggccuaagaucacuaaucugaaaaccaucaauugcauaaaccugaaggcauuagucuucaaagagcauagggagauugaaaucaauguucuccucccucaagucgcggucaaccucucaaacugccaugugcugaucaaaucucauguuugugacuacucuuuagacaucgacgggccgguaagacugcccaguauccaccaugaaggaacuuuuauaccaggaacuuacaaaauaguuauagauaaaaaaaacaagcagaacgacagaugcacuuuggucacuaacuguguaauaaaaggaagggaaauucgcaaaggccagucaguguugaggcaauacagaacagaaauuaagauuggcaaggcaucuucugguucuagaagacuauugucugaagagccuaauuaugacuguuuaucaaggacucagcuauugaggacagagaaugcggaaauucacagugacaacuauggugguccaggugacaagauaacuaucugcaacgguucaacuauuguagaucagagauugggcagugaacuaggguguuacacuaucaauagggugaaaucauuuaagcucugcgaaaacagugcuacagguaaaucuugugaaauagauagcaccccagucagauguaggcaggguuuuugcuugaaaauuacucaggagggaaggggccacgugaagcuaucaagaggcucagaaguugucuuggacgccugugacucaagcugugaaauaaugauaccaaagggcacuggggacauccuaguugacuguucaggugggcagcaacauuuccuaaaagauaaccugguugauuuaggaugccccaacaucccacuguuaggcaaaauggccaucuacauuuguagaaugucaaaucaucccaagacaaccauggcuuuccuuuuuugguuuagcuuugguuaugugauaaccugcauacuuuguaaaguaaucuucuaucuauuaauaguuguagggacauuaggaaaaaaguucaaacaguacagagaguuaaaaccucagaccuguaccauaugugaaacgaauccuguuaaugcaauagaugcugagaugcaugaccucaacugcaguuacaauauauguccuuauugugcaucuagguuaaccucagauggucuugccagacauguaaugcaaugccccaaacggaaggaaaaaauagaagaaaccgaauuauauuugaacuuagaaagaaucccuuggguuguuaggaaauuacugcaggugucagaauccaccgguguagcacuaaagaggaguaguuggcugguuguacuacuugugcuacucacaguuucauugucaccaguacaaucagcaccuaucagccauggagagacagucgaaguauaucaaaccagagaaggguacacaaguauuugccuuuuuguacuaggaagcauccuguuucugguguccugccugaugaagggguugguugacagugucggcaauaguuuuuucccuggcuuguccauuuguaagacauguucuauuggcaguauaaacggcuuugaaauugaaucucacaaauguuacuguagccuauuuugcugccccuacuguagacacugcucugccgauauagaaauacauaaguugcacuugagcaucugcaagaaaaggaaaacugggaguaaugucauguuagccgucuguaagcgcaugugcuuuagggcaacuguggaaguaagcaauaaagcuuuacuuauccgaaacaucaucaacaccacuuuuguugugugcauacugauauuagcaguuuguguugucagcaccucugcaguggagauggaaaaccugccagcaggcacuugggaaaaagaggaagaccugacaaauuucugucaucaggaaugccaggucacugagacugaaugccucugcccuuaugaagcucuugugcucaggaaacccuugucuuuggacaguauuguuaaaggcaugaagaacuugcuaaauucaacaagccuagaaacaagcuuaucaauugaggcaccauggggggcaauaaauguccagucaacuuucaaaccaacugugucagcugcaaacauagcgcuuaguuggagcucaguagaacauagaggcaauaaaauuuugguuucaggcagaucagagucaaucaugaaauuagaggaaaggacaggaauuagcugggaucuggguguggaagacgccucugaguccaaauugcucacugucucuguaauggacuugucacaaauguauucuccugucuuugaguaccuaucaggugauagacaaguggaggaauggcccaaggcaaccuguacaggagauugcccagaaagaugcggcugcacgucaucaaccugccuacacaaagaauggccccauucaagaaacuggagaugcaacccuacuugguguuggggagucggcacuggaugcaccuguugugggcuggaugugaaagaccucuuuacagauuacauguuugucaaguggaaaguugacuacauuaaaacagaagcuauaguguguguugagcuuacuagccaggaaagacaauguagcuuaauugaggcaggcacaagauucaacuuggguccugugaccaucacauugucagagccaagaaacauucagcagaagcucccuccagaaauagucacauugcauccuaggauugaagaaggcuucuuugacuuaaugcauauacaaaaagugcuaucagcaaguacaguauguaagcuacagaguugcacacauggcgugccaggagaccuacagaucuaccacauuggaaacuuguuaaaaggagacaaggugaacgggcaccugauucacaaaauugaaccacacuucaacaccuccuggaugucuugggacggcugugaccuagacuacuacuguaauaugggggauuggccaucuugcucauacacuggcguaacccaacacaaccaugcugcauuuguaaacaugcucaacaucgaaacugauuauacaaaaaacuuccacuuucacucuaagagaguuacagcacauggggacacaccacaauuagauuuaaaagcuagaccaacuuauggugcaggugaaaucacugugcugguagagguugcugacauggaguugcauacaaagaaaguugagauaucagguuugaaguuugcaagcuuaacuugcacaggcuguuaugcuuguaguucugguaucuccuguaaggucaggauccauguagaugaaccagaugagcuuacaguacaugugaagagcgaggauccagacauaguugcugcuaguucaagucucauggcuaggaagcuugaauuugggacagauagcacauuuaaagccuuuucagccaugcccaaaaccuccuugugcuuuuacauuguggagagggaacacugcaaaagcuguaguaaagaagacacacaaagaugugucaacacaaagcuugaacaaccacaaagcauuuuaaucgagcacaaagggacgauaauuggaaagcagaacgacacuuguacagccaaagcaaguugcugguuagagucaauuaagaguuuuuuuuauggacuaaagaauaugcuuaguggcauuuuuggcaauguuuucauagggguuuucuuauuccucgcuccuuuuaucauacuaauacuuuucuucauguuuggauggaggauccuguucugcuuuaaguguugcagaagaacuagaggcuuacuuaaguauagacaccucaaagacgaugaggaaaucgguuacaggaaaaucauugagaggcuaaacaacaaaaaagggaaaaacaaacugcuugacggugaaagacuagcugauaggaagaucgcugagcuguucucuacaaaaacacacauuggcuaa

SEQ ID NO: 3642 - RNA, 5052 nt, Artificial Sequence
  derived and/or modified CDS sequence (wt) from CCHFV(4701-ST-2009)__KR814872.1__GP
augcauacacuauuagugugcuucauucuuuaccuacagcuaucggguuuaggaggagcucauggacagucaaacgcaacugaacacaauggaacaaacaccaccacagcacccggcacaagucaaagucccaagccacccgcgagcaccacucuaccacacacaccagaauccuccaccgucaaacucaccacaccaacaagcgaaacagaaggcucaggggaaacgaccccacccccaaacaccacccagggccugccccuaacagggaccacaccagaacgcuccgcaacaaccgccacaagcacgucaagcacagacaacaugaauuccaccacacaggugaccgacaacacccccacaucaacagucagcauaaguccauccagcagcuccagcaugccauccacaccacaaggcacacaucaucccguaaggagucuauugucagucucgagcccuaagacaguaacaacaccgacaccaaugagcccuggagagaugagcccggaaaccagcagucagcacucagccaugagcagaguaccaacccucuacacagcaacccaggucuccacugagaacaccgaucgcagcacaccuagacaaucugaguccucaguacagccggcaacccaaagcccaauaacuuccccagcgcaaacaauccuucugaugagugcugcuccuaaagcuauucaggacaugcaucccagcccaacaaacagguccaagaggaaccuugagguggaaauaauuuuaacucugucucaaggucuaaagaaauauuacgguaaaauacugaagcuucugcaccuuaccuuggaagaggauacugaaggccuguuagaaugguguaagagaaaccuugggucaaauugugaugaugacuucuuucaaaagagaauagaagaauucuucauaacuggugagggcuacuucaaugaaguccuacaauuuaaaacacuaagcacacuaagccccacggagccgucucaugucaggcuaccaacagcggagcccuucaaaucuuacuucgcuaagggcuuccuuucaauagauucggguuacuucucugccaaauguuauccaagaucauccacuucagggcuucagcugaucaaugucacccaacacccagcuaggauagcagaaacaccuggacccaaaacaacgagucugaaaaccaucaacuguaucaaccuaagagcaucagucuucaaagaacacagagaaguugagaucaaugugcuucuuccucagauugcagucaaccucucaaacugccauguugugaucaacucacaugucugugauuacucuuuagacacugacgggccagugaggcuuccucgcauucaccaugaagguacuuucauaccaggaacuuauaaaauagugauagacaggaaaaauaagcuaaaugaccgaugcucgcuagucacuaacugugugauaaaaggaagagagguucguaagggccaaucagugcugaggcaguacaaaacagaaauuaagauaggcaaggcaucaacaggcucuaggaaacuacuguccgaagagccaggugacgacugcauaucaagaacucagcuauugaagacagaaacagcagagauccaugacgacaacuauggugguccaggugacaaaauaacuaucugcaaugguucaaccguuguagaucagagacugggcagugaacuaggguguuauaccaucaacagggugaagucauucaagcuaugcgaaaacagugccacagggaaaaccugugagauagacagcacuccgguuaagugcaggcaaggguuuuguuugaaaaucacccaagagggaaggggccacguaaaauuauccaggggcucagagguuguuuuggaugcuugcgacucaagcugugaaauaaugauaccuaaaggcacuggagauauccuaguagacuguucagguggacagcaacauuucuuaaaagacaacuugauugaccuagggugcccucauaucccgcuauuggguaaaauggccauuuacauuugcagaaugucaaaucaucccaggacaaccauggcuuuccucuucugguucaguuuuggcuauguaaucaccuguauauuuugcaaggcucuuuuuuauucauugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuggcuaggcaugugacacaaugcccuaagcgaaaagagaaaguugaggagacugaacuguauuugaaccuggaaagaauuccuuggauagucagaaagcuauugcaagugucagaguccacugguguggcauugaaacgaagcaguuggcugauugugcugcuuguguuacucacagucucauugucaccgguccaaucagcaccuguuggucaugguaagacaaucgaaacauaucagaccagagagggauucacaaguaucugucucuuuauguuaggaagcauccuauucauaguuucuugccugguaaaggggcugguugacagugucagugacagcuucuuccccggccugucugucuguaagacaugcucuauuggcaguauaaauggcuuugaaauugaaucgcauaaaugcuacuguaguuuauuuugcugccccuacuguaggcacugcucugcugacagagaaauucaccaguugcacuugaguaucugcaaaaaaagaaaaacggggagcaaugucaugcuggcugucugcaagcgcaugugcuuuaaggcaaccauagaagcaagcagaagagcccugcucauccgaagcauuaucaauaccacuuuuguaaugugcauucuaacauuagcaaucuguguuguuagcaccucugcaguagagauggaagaccuuccggcaggcacuugggagagagaggaagaccuaacaaauuucugccaucaggaaugccaggugaccgagacggaaugccucuguccauacgaagcucuugugcucaggaaaccccuuuucuuagacaguauaguuaaagguaugaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggauuugucacaaauguauuccccuguuuuugaguacuuaucaggagauagacagguugaagaauggcccaaggcaaccuguacaggugauugcccagaaagguguggcugcacaucaucaaccugcuugcauaaagaauggccucauucaagaaacuggagauguaaucccacuuggugcuggggaguaggaaccggcugcacaugcugcggaguggauguaaaagaccuuuuuacagaccacauguuuaucaaauggaagguugaauauauaaaaaccgaagccauaguauguguugagcucaccagccaagaaagacagugcagucugauugaggcagguacuagauucaacuuggguccugugacuaucacccugucugagccaagaaacauucagcagaagcuucccccugagaucauuacgcugcauccuaaaauugaagaaggcuucuuugacuugaugcaugugcaaaaaguguuaucugcaaguacaguguguaaacugcagaguugcacacaugguauaccaggagaucuacaaauuuaccacauuggcaacuuguugaaaggggauagaguaaacggccaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaauauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaaaaaaguugagauaucaggcuugaaauuugcaagucugacuuguacggguugcuaugcuuguagcucuggcaucuccuguaaagucagaauucauguagaugaaccagaugagcucacagugcauguaaagagcagugauccagaugugguugcagcuagcacaagccuuauggcaaggaagcuugaauuugggacagauagcacauucaaggcauuuucagcuaugcccaaaaccucuuuaugcuuuuacauuguggagagggaauacugcaagagcugcagugaagaugauacaaaaaaauguguugacacaaaacuugagcagccacagagcauacuaauugagcacaaagggacgauaauuggaaagcagaaugauacuugcacagccaaggcaaguuguuggcuagagucagucaagaguuuuuuuuauggauugaagaauaugcuuggcaguguuuuuggugguuuuuucguaggcauuuuguuauuccuugccccuuucgucuuguugguacuuuucuuuauguuuggauggaaaaucuuguuuugcuuuaaguguugcaggaggaccagaggcuuguuuaaguauagacaccucaaagaugacgaggaaacaggcuacagaaggauuauugaaagacugaacagcaaaaaaggaaaaaacagacugcuugauggugagagguuggcugauaggaaaauugcugagcuguucucuacaaaaacacacauuggcuaa

SEQ ID NO: 3643 - RNA, 5052 nt, Artificial Sequence
  derived and/or modified CDS sequence (wt) from CCHFV(36-ST-2014)__KR814857.1__GP
augcauacacuauuagugugcuucauucuuuaccuacagcugucggguuuaggaggagcucauggacagucaaacgcaacugaacacaauggaacaaacaccaccacaguacccggcacaagucaaagccccaagccacccgcgagcaccacucuaccacacacaccagaauccuccaccgucaaacucaccacaccaacaagcgaaacagaaggcucaggggaaacgaccccacccccaaacaccacccagggccugcccccaccagggaccacaccagaacgccccgcaacaaccgccacaagcaugucaagcacagacaacaugaauuccaccacacaggugaccgacaacacccccacaucaacagucagcauaaguccauccagcagccccagcaugccauccacaucacaaggcauacauuaucccguaaggagucuauugucagucucgagcccuaagacaguaacaacaccgacaccaaugagcccuggagagaugagcccggaaaccagcagucaacacucagccaugagcagaauaccaacccucuacacagcaacccaggucuccacugagaacaccaaccgcagcacaccuagacaauccgaguccucagcacagccggcaacccaaagcccaacaacuuccccaacgcaaacaauccuucugaugagugcugcuccuaaagcuauucaggacaugcaucccagcccaacaaacagguccaagaggaaccuugagguggaaauaauuuuaacucugucucaaggucuaaagaaguauuacgguaaaauacugaagcuucugcaccuuaccuuggaagaggauacugaaggccuguuagaaugguguaagagaaaccuugggucaaauugugaugaugacuucuuucaaaagagaauagaagaauucuucauaacuggugagggcuacuucaaugaaguccuacaauuuaaaacacuaagcacacuaagccccacggagccgucucaugucaggcuaccaacagcggagcccuucaaaucuuacuucgcuaagggcuuccuuucaauagauucggguuacuucucugccaaauguuauccaagaucauccacuucagggcuucagcugaucaaugucacccaacacccagcuaggauagcagaaacaccuggacccaaaacaacgagucuaaaaaccaucaacuguaucaaccuaagagcaucagucuucaaagaacacagagaaguugagaucaaugugcuucuuccucagauugcagucaaccucucaaacugccauguugugaucaacucacaugucugugauuacucuuuagacacugacgggccagugaggcuuccucgcauucaccaugaagguacuuucauaccaggaacuuauaaaauagugauagacaaaaaaaauaagcuaaaugaccgaugcucgcuagucacuaacugugugauaaagggaagagagguucguaaaggccaaucagugcugaggcaguacaaaacagaaauuaagauaggcaaggcaucaacaggcucuaggaaacuacuguccgaagagccaggugacgacugcauaucaagaacucagcuauugaagacagaaacagcagagauccaugacgacaacuauggugguccaggugacaaaauaacuaucugcaaugguucaaccauuguagaucagagacugggcagugaacuaggguguuauaccaucaacaggguaaagucauucaagcuaugcgaaaacagugccacagggaaaaccugugagauagacagcacuccggucaagugcaggcaagguuuuuguuugaaaaucacccaagaggggaggggccacguaaaauuauccaggggcucagagguuguuuuggaugcuugcgacucgagcugugaaauaaugauaccuaaaggcacuggagauauccuaguagacuguucagguggacagcaacauuucuuaaaagacaacuugauugaccuagggugcccucauaucccgcuauuggguaagauggccauuuacauuugcagaaugucaaaucaucccaggacaaccauggcuuuccucuucugguucaguuuuggcuauguaaucaccuguauauuuugcaaagcucuuuuuuauucauugauaauuauugggacacuaggaaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuagcuaggcaugugacacaaugcccuaagcgaaaggagaaaguugaggagacugaacuguauuugaaccuggaaagaauuccauggauagucagaaagcuguugcaagugucagaguccacugguguggcauugaaacgaagcagcuggcugauugugcugcuuguguuacucacagucucauugucaccgguucaaucagcaccuguuggucaugguaagacaauugaaacauaucagaccagagaaggauucacaaauaucugucucuuuauguuaggaagcauccuauucauaguuucuugccugguaaaggggcugguugacagugucagugacagcuuuuuccccggccugucugucuguaagacaugcucuauuggcaguauaaauggcuuugaaauugaaucgcauaaaugcuacuguaguuuauuuugcugccccuacuguaggcacugcucugcugacagagaaauucaccaguugcacuuggguaucugcaaaaaaagaaaaacggggagcaaugucaugcuggcugucugcaagcgcaugugcuuuaaggcaaccauagaagcaagcagaagagccuugcucauccgaagcauuaucaauaccacuuuuguaauaugcauccuaacauuagcaaucuguguuguuagcacuucugcaguagagauggaaaaucuuccagcaggcacuugggagagagaggaagaccugacaaauuucugccaucaggaaugccagguaagcgagacggaaugccucuguccauacgaagcucuugugcucaggaaaccucuuuucuuagacaguauaguuaaagguaugaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggauuugucacaaauguauuccccuguuuuugaguacuuaucaggagauagacagguugaagaauggcccaaggcaaccugcacaggugauugcccagaaagguguggcugcacaucaucaaccugcuugcauaaagaauggccucacucaagaaacuggagauguaaucccacuuggugcuggggaguaggaaccggcugcacaugcugcggaguggauguaaaagaccuuuuuacagaucacauguuuaucaaauggaagguugaauauauaaaaaccgaagccauaguauguguugagcucaccagccaagaaagacagugcagucugauugaggcagguacuagauucaacuuggguccugugacuaucacccugucugagccaagaaacauucagcagaagcuucccccugagaucauuacgcugcauccuaaaauugaagaaggcuucuuugacuugaugcaugugcaaaaaguguuaucugcaaguacaguguguaaacugcagaguugcacacaugguauaccaggagaucuacaaauuuaccacauuggcaacuuguugaaaggggauagauuaaacgggcaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccauucuaaaagagucacagcacauggagacacaccacaauuagacuuaaaagcaaggccgacuuacggugcaggugagaucacugugcugguugagguugcugacauggaguugcauaccaagaaaguugagauaucaggcuugaaauuugcaagucuggcuugcacggguugcuaugcuuguagcucuggcaucuccuguaaagucagaauucauguagaugaaccggaugagcucacagugcauguaaagagcagugauccagaugugguugcagcuagcacaagccuuauggcaaggaagcuugaauuugggacagauagcacauucaaggcauuuucagcuaugcccaaaaccucuuuaugcuuuuacauuguggagagggaauacugcaagagcugcagugaagaugauacaaaaaaauguguugacacaaaacuugaucagccacagagcauacuaauugagcacaaagggaccauaauuggaaagcagaaugacacuugcacagccaaggcaaguuguuggcuagagucagucaagaguuuuuuuuauggauugaagaauaugcuuggcaguguuuuugguaauuuuuucguaggcauuuuguuauuccuugcccccuuugucuuguuggugcuuuucuuuauguguggauggaaauucuuguuuugcuuuaaguguugcaggaggaccagaggcuuguuuaaguauagacaccucaaagaugaugaggaaacaggcuacagaaggauuauugaaagacugaacagcaaaaaaggaaagaacagacugcuugauggugagagguuggcugauaggaaaauugcugagcuguucucuacaaaaucacacauuggcuaa

SEQ ID NO: 3644 - RNA, 5055 nt, Artificial Sequence
  derived and/or modified CDS sequence (wt) from CCHFV(Matin)__AF467769.2__GP
auguacacacuacuguugugugcaauucuuugcucacagcuguggaguucagaagguauucauggacuguccaacgaaacccaacaugguaaugcaagcaccauaaaggcgcccgaagugagccaaggacuuggauugccugugagcacagcaccacccauuacgucagacccucccuccaucacaucugcagcgucagucaguggaccagaagguucaggagacacgaacaccucuccuccggucaccacacaaggcuugacuuugccagaaaccacacuggaacuccucacaacaaccaacacaggugcaucaagcacagucaucgucgaugucagcacacagacggucaaggacacccccgugucaacagcccacacaagcccgcccggcacccccagcgcgccaaccacaccacagggcacacaucacacugcaaggggucuacugucagucaccagcacaaagucagaagaagcaucaacacaaacaaauccaaaaaaaacaagcauggagaccaacagcccgggcccagccaccagcgaaacaccaucccccucuccaacaacccaggcccccaccgaaaacaacaaccccaauacacccaggcagcccacgcccccgacacaaccagcaaccccaagcccagugaccucuccagcacugcuagccuccucucagggugacacgucuacggcuguucaagauguacaucccagcccaacaaacagaucuaagagaaaccuugagauggagauaauuuugacuuuaucucaagguuugaagaaguacuauggcaagauacuaaaacuucuggaccuuacuuuggaggaagacacugaaggccuguuagagugguguaagagaaaucuugguuuggucugugaugacagcuucuuucagaagaggauagaagaguuuuuuuugaccggugaaggucacuucaaugaagucuuacaguuuaaaacaccaagcacacuaagccccacggaaccagcucgagcugggucaccaacaguugaacccuucaaaucuuauuucgccagaggccuccuuucaauggacucagguuacuucucugccaaguguuauccaagagcauccaauucaggacuucaguugaucaacaucacccaacauucagcuagaauaacagacacaccuggacccaagaucacuaaucuaaaaaccaucaauugcauaaacuuaaaggcaucaaccuucaaagagcauagagagauugaaaucaauguucuucucccucaagucgcagucaaccucucaagcugccacguacugaucaaaucgcaugucugugacuacucuuuggacauugacgggccagugagacuaccucguauccaccaugaagguacuuucauaccaggaacuuacaaaauaguuauagacaaaaaaaacaaacagaacgacaggugcacuauagucaccaacuguguaauaaaaggaagggaaauucguaagggucagucgguguuaagacaauacaagacagaaaucaagauuggcaaggcaucuucugguuccagaagacuguuguccgaagagucuggugaugacuguauaucaagaacucagcuauugaggacagagacugcggaaauucacagugauagcuaugguggaccaggugauaagauaaccaucugcaaugguucaacuguuguagaucagagguugggcagugaacuaggguguuacacuauaaauagaguaaagucauuuaagcuuugcgagaacagugccacagguaaauccugugaaauagauagcaccccaguuaaaugcaggcaggguuuuugcuuaaaaauuacucaggagggaaggggccacgugaagcugucgagagguucagaaguugucuuggaugccugugacucaagcugugaaauaaugauaccaaagggcacuggagacauccuaguugacuguucaggugggcagcaacauuucuuaaaagauaaccugauugaucugggaugccccaacauuccacuauuaggcaaaauggccaucuacauuuguagaaugucaaaucaucccaaaacaacuaugguuuuucuuuuuugguuuagcuuugguuauguaauaaccuguauacucuguaaggucaucuucuaucuauuaauaguuguagggacauuagggaaaaaguucaaacaguauagagaguugaaaccucagaccuguaccauaugcgaaacaacuccuguuaaugcaauagaugcugaaaugcacgaccuuaacugcaguuacaauauauguccuuacugugcauccagguugacaucagauggucuugccagacauguaaugcagugccccaaacggaaggaaaaaauagaagaaaccgaauuauacuuaaacuuagaaaggaucccuuggguuguuaggaaauuacugcaggugucagaaucuaccgguguggcacuaaagaggaguagcuggcugguugugcuacuuguguuacuuacaguuucacuaucaccaguacaaucagcaccuaucggccauggaaagacaguugaaacauaucagaucagagaaggguacacaaguguuugccuuuuuguacuagggagcaucuuguuuauagucucuugccuaaugaaagggcugguugacagugacgguaacaguuuuuucccugguuuguccauuugcaagacauguucuauuggcaguauaaauggcuuugaaauugaaucucacaaauguuacuguagccuauuuuguugccccuacuguagacacugcucuacagauagagaaauacauaaauugcacuugagcaucugcaagaaaaggaaaacuggaaguaaugucauguuggccgucuguaagcgcaugugcuuuagggcaacuguagaaguaagcaacaaggcucuacuaauccgaagcaucaucaacaccacuuuuguuguguguauacugauauuagcaguuuguguugucaguaccuccgcaguggagauggaaagccugccagcuggcacuugggagagagaagaagaccugauaaauuucugucaucaggaaugccaagucacugagacugaaugucucuguccuuacgaagcucuugugcucagaaaacccuuguuuuuagacaguauuauuaaggguaugaagaacuugcuaaauucaacaagcuuagaaacaagcuuaucaauugaggcaccauggggagcaauaaauguccaaucaacuuucaaaccuacuaugucagcugcgaacauagcgcuaaguuggagcucaguggaacacagagguaauaagauuuugguuucaggcagaucagagucgaucaugaagcuagaggaaaggacaggaaucagcugggaucuaggaguagaagaugccucugagucuaaauugcuuacuguaucuguuauggacuuaucacagauguauucuccugucuuugaguacuuaucaggugauagacaaguggaggaauggcccaaggcaaccugcacaggcgauuguccagaaagauguggcugcacaucaucaaccugccuacacaaagaauggccccauucaagaaacuggagaugcaauccuacuugguguuggggagucggcacuggauguaccugcugugggcuagacguaaaagaccuuuuuacugauuacauguuugucaaguggaaaguugaauacauuaaaacggaaguuauaguguguguugagcuuacuagccaagaaagacaauguagcuugauugaggcaggcacaagauucaacuuagguccugugaccauuacauugucagagccaagaaacauucagcaaaagcucccuccagagauagucacauugcaucccagaauugaagaagguuucuuugauuuaaugcauguacaaaaagugcuaucagcaaguacagugugcaagcuacagaguugcacacauggugugccaggggaccuacaggucuaccacauaggaaacuuguuaaaaggagauaaggugaacgggcacuugauucacaaaauugaaccacacuucaacacuuccuggaugucuugggacggcugugaccuagacuacuacuguaauaugggggauuggccaucuugcucauauacuggaguaacccaacacaaucaugcugcauuuguaaacaugcucagcaucgaaacugauuauacaaaaaacuuccacuuucacucuaagagaguuacugcacauggagacacaccacaauuagaucugaaagcuaggccaacuuacggugcaggugaaaucacugugcugguagagguugcugacauggaauuacauacaaagaaaauugagauaucagguuugaaguuugcaagcuuaacuugcacaggauguuaugcuuguagcucugguaucuccuguaagguuagaauccauguagaugaaccagaugagcuuacaguacaugugaagagugaagacccagacauaguugcugcuagcucaagucucauggcuagaaagcuugaauuugggacagauaguacauucaaagccuuuucagccaugcccaaaaccuccuuaugcuuuuacauuguggagagagaauauuguaaaaguugcaguaaagaagacacacaaaaaugugucaacacaaagcuugagcaaccacagagcaucuuaaucgagcauaaagggacgauaauuggaaagcaaaacgacaccuguacagccaaagcaagcugcuggcuggagucagucaaaaguuuuuuuuauggacuaaagaacaugcuuaguggcauuuuuggcaauguuuucauagggauuuucuuauuccuugcuccuuuugcccuuuuaauacuuuucuuuauguuuggauggagaauccuguucugcuuuaaauguugcagaagaacuagaggccuauuuaaauacagacaccucaaggacgacgaagaaaccgguuacaggaaaaucauugagaggcugaacaacaaaaaagguaaaaacaaacugcucgacggugaaagacuagcugacaggaagaucgcugagcuguucuccacaaaaacacacguuggcuaa

SEQ ID NO: 3645 - RNA, 5052 nt, Artificial Sequence
  derived and/or modified CDS sequence (wt) from CCHFV(UCCR4405)__KY484029.1__GP
augcaugcacuauuagugugcuucauucuuuaccuacagcuaucggguuuaggaggagcucauagacagucaaacgcaacugaacacaauggaacaaacaccaccacagcacccggcacaagucaaagcccuaagccacccgugagcaccacucuaccacacacaccagaagccuccaccaucaaacucaccacaccaacaagcgaaacagaaggcucaggggaaacgaccccacccccaaacaccacccagggccugccccuaccagggaccacaccagaacgcuccgcaacaaccgccacaagcacgucaagcacagacgacaugaauuccaccacacagaugaccgacaacacccccacaucaacagucagcauaggucuauccagcagccccagcaugccauccacaucacaaggcauacauuaucccguaaggagucuauugucagucucgagcccuaagacagcaacaacaccaacaccaaugagcccuggagaggugagcccggaaaccagcagucagcacucagccaugagcagaauaccaacccucuacacagcaacccaggucuccacugagaacaccaaccgcagcauaccuagacaaucugaguccucagugcagccggcaacccaaagcccaauaacuuccccagcgcaaacaauccuucugaugagugcugcuccuacagcuauucaggacaugcaucccagcccaaaaaacagguccaagaggaaccuugagguggaaauaauuuuaacucugucucaaggucuaaagaaauauuacggcaaaauacugaagcuucugcaccuuaccuuggaagaggauacugaaggccuguuagaaugguguaagagaaaccuugggucgaauugugaugaugacuucuuucaaaagagaauagaagaauucuucauaacuggugagggcuacuucaaugaaguccuacaauuuaaaacaccaagcacacuaagccccacggagccgucucaugucaggcuaccaacagcagagcccuucaaaucuuacuucgcuaagggcuuccuuucaauagauucugguuacuucucugccaaauguuauccaagaucauccacuucagggcuucagcugaucaaugucacccaacacccagcuaggauagcagaaacaccuggacccaaaacaacgagucugaaaaccaucaacuguaucaaccuaagagcaucagucuucaaagaacacagagaaguugagaucaaugugcuucuuccucagauugcagucaaccucucaaacugccauguugugaucaacucacaugucugugauuacucuuuagacacugacgggccagugaggcuuccucgcauucaccaugaaggugcuuucauaccaggaacuuauaaaauagugauagacaaaaaaaauaagcuaaaugaccgaugcucgcuagucacuaacuguguaauaaagggaagagagguucguaagggccaaucagugcugaggcaguacaaaacagaaaucaagauaggcaaggcaucaacaggcucuaggaaacuacugucugaagagccaggugacgacugcauaucaagaacucagcuauugaagacagaaacagcagagauccaugacgacaacuauggugguccaggugacaaaauaacuaucugcaaugguucaaccauuguggaucagagacugggcagugaacuaggguguuauaccaucaacagggugaagucauucaagcuaugcgaaaacagugccacagggaaaaccugugagauagacagcacuccggucaagugcaggcaagguuuuuguuugaaaaucacccaagagggaaggggccacguaaaauuauccaggggcucagagguuguuuuggaugcuugcgacucgagcugugaaguaaugauaccuaaaggcacuggagauauccuaguagacuguucagguggacagcagcauuucuuaaaagacaacuugauugaccuagggugcccucauaucccgcuauuggguaagauggccauuuacauuugcagaaugucaaaucaucccaggacaaccauggcuuuccucuucugguucaguuuuggcuauguaaucaccuguauauuuugcaaggcucuuuuuuacucauugauaauuauugggacacuagggaaaaaaaucaagcaauauagggagcugaaaccucaaacuugcaccauaugugagacagcuccugucaaugcaauagaugcugaaaugcaugaccucaaauguaguuacaauauaugcccuuauugugcaucaagauugaccucugaugggcuagcuaggcaugugacacaaugcccuaagcgaaaggagaaaguugaggagacugaacuguacuugaaccuggaaagaauuccuuggauagucagaaagcuauugcaagugucagaguccacugguguagcauugaaacgaagcaguuggcugauugugcugcuuguguuacucacagucucauugucaccgguucaaucagcaccuguuggucaugguaagacaauugaaacauaucagaccagagaaggauucacaaguaucugucucuuuauguuaggaagcauccuauucauagucucuugccuaguaaaggggcugguugacagugucagugacagcuucuuccccggccugucugucuguaagacaugcucuauuggcaguauaaauggcuuugaaauugaaucgcauaaaugcuacuguaguuuauuuugcugccccuacuguaggcacuacucugcugacagagaaauucaccaguugcacuugaguaucugcaaaaaaaggaaaacggggagcaaugucaugcuggcugucugcaaacgcaugugcuuuaaggcaacuauagaagcaagcagaagagcccugcucauccgaaguauuaucaacaccacuuuuguaauauguauucuaauauuagcaaucuguguuguuagcaccucugcaguagagauggaaaaccuuccagcaggcacuugggagagagaggaagaccugacaaauuucugccaccaggaaugccaggugaccgagacggaaugccucuguccauacgaagcucuugugcucaggaaaccucuuuucuuagacaguacaguuaaagguaugaaaaauuugcuaaacucaacaagcuuggaaacaagcuuaucaauugaggcaccauggggagcaauaaauguccagucaaccuuuaaaccaacaguaucgacugcaaacauagcacucaguuggagcucaguggagcacagaggcaacaagaucuuggucacaggcaggucugaaucaauuaugaaacuagaggaaaggacaggagucagcugggaucuaggcguagaagaugccucugaauccaaauuacuuaccgucuccaucauggauuugucacaaauguauuccccuguuuuugaguacuuaucaggagauagacagguugaagaauggcccaaggcaaccuguacaggugauugcccagaaagguguggcugcacaucaucaaccugcuugcauaaagaauggccucacucaagaaacuggagauguaaccccacuuggugcuggggaguaggaaccggcugcacaugcugcggaguggauguaaaagaccuuuuuacagaucacauguuugucaaauggaagguugaauauauaaaaaccgaagccauaguauguguugagcucaccagccaagaaagacagugcagucugauugaggcagguacuagauucaacuuggguccugugacuaucacccugucugagccaagaaacauucagcagaagcuucccccugagaucauuacgcugcaucccaaaauugaagaaggcuucuuugacuugaugcauguacaaaaaguguuaucugcaaguacaguguguaaacugcagaguugcacacaugguauaccaggagaucuacaaauuuaccacauuggcaacuuguugaaaggggauagaguaaacgggcaucuaauucacaaaauugaaccacauuuuaacaccucuuggauguccugggaugguugugaccuagacuacuauugcaacauggggaauuggccuucuugcacauacacaggagugacccaacauaaucaugcugcauuuguaaauuugcuuaacauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaagaaaguugagauaucaggcuugaaauuugcaagucugguuugcacggguugcuaugcuuguagcucuggcauuuccuguaaagucagaauucauguagaugaaccagaugagcucacagugcauguaaagagcagugauccagaugugguugcagcuagcacaagccuuauggcaaggaagcuugaauuugggacagauagcauauucaaggcauuuucagcuaugcccaaaaccucuuuaugcuuuuacauuguggagagggaauacugcaagagcugcagugaagaugauacaaaaaaauguguugacacaaaacuugagcagccacagagcauacuaauugagcacaaagggacgauaauuggaaagcagaaugauacuugcacagccaaggcaaguuguuggcuagagucagucaagaguuuuuuuuauggauugaagaauaugcuuggcaguguuuuugguaauuuuuucguaggcauuuuguuauuccuugccccuuuugucuuguuggugcuuuucuuuauguuuggauggaaaaucuuguuuugcuuuaaguguugcaggaggaccagaggcuuguuuaaguauagacaccucaaagacgaugaggaaacaggcuacagaaggauuauugaaagacugaauaguaaaaaaggaaaaaacagacugcuugauggugagagguuggcugauaggaaaauugcugagcuguucuccacaaaaacacacauuggcuaa

SEQ ID NO: 3646 - RNA, 5052 nt, Artificial Sequence
  derived and/or modified CDS sequence (wt) from CCHFV(Drosdov)__DQ211630.1__GP
augcaugcacuauuagugugcuucauucuuuaccuacagcuaucggguuuaggaggagcucauagacagucaaacgcaacugaacacaauggaacaaacaccaccacagcacccggcacaagucaaagcccuaagccacccgugagcaccacucuaccacacacaccagaagccuccaccaucaaacucaccacaccaacaagcgaaacagaaggcucaggggaaacgaccccacccccaaacaccacccagggccugccccuaccagggaccacaccagaacgcuccgcaacaaccgccacaagcacgucaagcacagacgacaugaauuccaccacacagaugaccgacaacacccccacaucaacagucagcauaggucuauccagcagccccagcaugccauccacaucacaaggcauacauuaucccguaaggagucuauugucagucucgagcccuaagacagcaacaacaccaacaccaaugagcccuggagaggugagcccggaaaccagcagucagcacucagccaugagcagaauaccaacccucuacacagcaacccaggucuccacugagaacaccaaccgcagcauaccuagacaaucugaguccucagugcagccggcaacccaaagcccaauaacuuccccagcgcaaacaauccuucugaugagugcugcuccuacagcuauucaggacaugcaucccagcccaaaaaacagguccaagaggaaccuugagguggaaauaauuuuaacucugucucaaggucuaaagaaauauuacggcaaaauacugaagcuucugcaccuuaccuuggaagaggauacugaaggccuguuagaaugguguaagagaaaccuugggucgaauugugaugaugacuucuuucaaaagagaauagaagaauucuucauaacuggugagggcuacuucaaugaaguccuacaauuuaaaacaccaagcacacuaagccccacggagccgucucaugucaggcuaccaacagcagagcccuucaaaucuuacuucgcuaagggcuuccuuucaauagauucugguuacuucucugccaaauguuauccaagaucauccacuucagggcuucagcugaucaaugucacccaacacccagcuaggauagcagaaacaccuggacccaaaacaacgagucugaaaaccaucaacuguaucaaccuaagagcaucagucuucaaagaacacagagaaguugagaucaaugugcuucuuccucagauugcagucaaccucucaaacugccauguugugaucaacucacaugucugugauuacucuuuagacacugacgggccagugaggcuuccucgcauucaccaugaaggugcuuucauaccaggaacuuauaaaauagugauagacaaaaaaaauaagcuaaaugaccgaugcucgcuagucacuaacuguguaauaaagggaagagagguucguaagggccaaucagugcugaggcaguacaaaacagaaaucaagauaggcaaggcaucaacaggcucuaggaaacuacugucugaagagccaggugacgacugcauaucaagaacucagcuauugaagacagaaacagcagagauccaugacgacaacuauggugguccaggugacaaaauaacuaucugcaaugguucaaccauuguggaucagagacugggcagugaacuaggguguuauaccaucaacagggugaagucauucaagcuaugcgaaaacagugccacagggaaaaccugugagauagacagcacuccggucaagugcaggcaagguuuuuguuugaaaaucacccaagagggaaggggccacguaaaauuauccaggggcucagagguuguuuuggaugcuugcgacucgagcugugaaguaaugauaccuaaaggcacuggagauauccuaguagacuguucagguggacagcagcauuucuuaaaagacaacuugauugaccuagggugcccucauaucccgcuauuggguaagauggccauuuacauuugcagaaugucaaaucaucccaggacaaccauggcuuuccucuucugguucaguuuuggcuauguaaucaccuguauauuuugcaaggcucuuuuuuacucauugauaauuauugggacacuagggaaaaaaaucaagcaauauagggagcugaaaccucaaacuugcaccauaugugagacagcuccugucaaugcaauagaugcugaaaugcaugaccucaaauguaguuacaauauaugcccuuauugugcaucaagauugaccucugaugggcuagcuaggcaugugacacaaugcccuaagcgaaaggagaaaguugaggagacugaacuguacuugaaccuggaaagaauuccuuggauagucagaaagcuauugcaagugucagaguccacugguguagcauugaaacgaagcaguuggcugauugugcugcuuguguuacucacagucucauugucaccgguucaaucagcaccuguuggucaugguaagacaauugaaacauaucagaccagagaaggauucacaaguaucugucucuuuauguuaggaagcauccuauucauagucucuugccuaguaaaggggcugguugacagugucagugacagcuucuuccccggccugucugucuguaagacaugcucuauuggcaguauaaauggcuuugaaauugaaucgcauaaaugcuacuguaguuuauuuugcugccccuacuguaggcacuacucugcugacagagaaauucaccaguugcacuugaguaucugcaaaaaaaggaaaacggggagcaaugucaugcuggcugucugcaaacgcaugugcuuuaaggcaacuauagaagcaagcagaagagcccugcucauccgaaguauuaucaacaccacuuuuguaauauguauucuaauauuagcaaucuguguuguuagcaccucugcaguagagauggaaaaccuuccagcaggcacuugggagagagaggaagaccugacaaauuucugccaccaggaaugccaggugaccgagacggaaugccucuguccauacgaagcucuugugcucaggaaaccucuuuucuuagacaguacaguuaaagguaugaaaaauuugcuaaacucaacaagcuuggaaacaagcuuaucaauugaggcaccauggggagcaauaaauguccagucaaccuuuaaaccaacaguaucgacugcaaacauagcacucaguuggagcucaguggagcacagaggcaacaagaucuuggucacaggcaggucugaaucaauuaugaaacuagaggaaaggacaggagucagcugggaucuaggcguagaagaugccucugaauccaaauuacuuaccgucuccaucauggauuugucacaaauguauuccccuguuuuugaguacuuaucaggagauagacagguugaagaauggcccaaggcaaccuguacaggugauugcccagaaagguguggcugcacaucaucaaccugcuugcauaaagaauggccucacucaagaaacuggagauguaaccccacuuggugcuggggaguaggaaccggcugcacaugcugcggaguggauguaaaagaccuuuuuacagaucacauguuugucaaauggaagguugaauauaugaaaaccgaagccauaguauguguugagcucaccagccaagaaagacagugcagucugauugaggcagguacuagauucaacuuggguccugugacuaucacccugucugagccaagaaacauucagcagaagcuucccccugagaucauuacgcugcaucccaaaauugaagaaggcuucuuugacuugaugcauguacaaaaaguguuaucugcaaguacaguguguaaacugcagaguugcacacaugguauaccaggagaucuacaaauuuaccacauuggcaacuuguugaaaggggauagaguaaacgggcaucuaauucacaaaauugaaccacauuuuaacaccucuuggauguccugggaugguugugaccuagacuacuauugcaacauggggaauuggccuucuugcacauacacaggagugacccaacauaaucaugcugcauuuguaaauuugcuuaacauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaagaaaguugagauaucaggcuugaaauuugcaagucugguuugcacggguugcuaugcuuguagcucuggcauuuccuguaaagucagaauucauguagaugaaccagaugagcucacagugcauguaaagagcagugauccagaugugguugcagcuagcacaagccuuauggcaaggaagcuugaauuugggacagauagcauauucaaggcauuuucagcuaugcccaaaaccucuuuaugcuuuuacauuguggagagggaauacugcaagagcugcagugaagaugauacaaaaaaauguguugacacaaaacuugagcagccacagagcauacuaauugagcacaaagggacgauaauuggaaagcagaaugauacuugcacagccaaggcaaguuguuggcuagagucagucaagaguuuuuuuuauggauugaagaauaugcuuggcaguguuuuugguaauuuuuucguaggcauuuuguuauuccuugccccuuuugucuuguuggugcuuuucuuuauguuuggauggaaaaucuuguuuugcuuuaaguguugcaggaggaccagaggcuuguuuaaguauagacaccucaaagacgaugaggaaacaggcuacagaaggauuauugaaagacugaauaguaaaaaaggaaaaaacagacugcuugauggugagagguuggcugauaggaaaauugcugagcuguucuccacaaaaacacacauuggcuaa

SEQ ID NO: 3647 - RNA, 5052 nt, Artificial Sequence
  derived and/or modified CDS sequence (wt) from CCHFV(44-ST-2010)__KR814859.1__GP
augcauacacuauuagugugcuucauucuuuaccuacagcuaucggguuuaggaggagcucauggacagucaaacgcaacugaacacaauggaacaaacaccaccacaguacccggcacaagucaaagccccaagccacccgcgagcaccacucuaccacacacaccagaauccuccaccgucaaacucaccacaccaacaagcgaaacagaaggcucaggggaaacgaccccacccccaaacaccacccagggccugcccccaccagggaccacaccagaacgccccgcaacaaccgccacaagcaugucaagcacagacaacaugaauuccaccacacaggugaccgacaacacccccacaucaacagucagcauaaguccauccagcagccccagcaugccauccacaucacaaggcauacauuaucccguaaggagucuauugucagucucgagcccuaagacaguaacaacaccgacaccaaugagcccuggagagaugagcccggaaaccagcagucaacacucagccaugagcagaauaccaacccucuacacagcaacccaggucuccacugagaacaccaaccgcagcacaccuagacaauccgaguccucagcacagccggcaacccaaagcccaacaacuuccccaacgcaaacaauccuucugaugagugcugcuccuaaagcuauucaggacaugcaucccagcccaacaaacagguccaagaggaaccuugagguggaaauaauuuuaacucugucucaaggucuaaagaaguauuacgguaaaauacugaagcuucugcaccuuaccuuggaagaggauacugaaggccuguuagaaugguguaagagaaaccuugggucaaauugugaugaugacuucuuucaaaagagaauagaagaauucuucauaacuggugagggcuacuucaaugaaguccuacaauuuaaaacacuaagcacacuaagccccacggagccgucucaugucaggcuaccaacagcggagcccuucaaaucuuacuucgcuaagggcuuccuuucaauagauucggguuacuucucugccaaauguuauccaagaucauccacuucagggcuucagcugaucaaugucacccaacacccagcuaggauagcagaaacaccuggacccaaaacaacgagucuaaaaaccaucaacuguaucaaccuaagagcaucagucuucaaagaacacagagaaguugagaucaaugugcuucuuccucagauugcagucaaccucucaaacugccauguugugaucaacucacaugucugugauuacucuuuagacacugacgggccagugaggcuuccucgcauucaccaugaagguacuuucauaccaggaacuuauaaaauagugauagacaaaaaaaauaagcuaaaugaccgaugcucgcuagucacuaacugugugauaaagggaagagagguucguaaaggccaaucagugcugaggcaguacaaaacagaaauuaagauaggcaaggcaucaacaggcucuaggaaacuacuguccgaagagccaggugacgacugcauaucaagaacucagcuauugaagacagaaacagcagagauccaugacgacaacuauggugguccaggugacaaaauaacuaucugcaaugguucaaccauuguagaucagagacugggcagugaacuaggguguuauaccaucaacaggguaaagucauucaagcuaugcgaaaacagugccacagggaaaaccugugagauagacagcacuccggucaagugcaggcaagguuuuuguuugaaaaucacccaagaggggaggggccacguaaaauuauccaggggcucagagguuguuuuggaugcuugcgacucgagcugugaaauaaugauaccuaaaggcacuggagauauccuaguagacuguucagguggacagcaacauuucuuaaaagacaacuugauugaccuagggugcccucauaucccgcuauuggguaagauggccauuuacauuugcagaaugucaaaucaucccaggacaaccauggcuuuccuccucugguucaguuuuggcuauguaaucaccuguauauuuugcaaagcucuuuuuuauucauugauaauuauugggacacuaggaaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuagcuaggcaugugacacaaugcccuaagcgaaaggagaaaguugaggagacugaacuguauuugaaccuggaaagaauuccauggauagucagaaagcuguugcaagugucagaguccacugguguggcauugaaacgaagcagcuggcugauugugcugcuuguguuacucacagucucauugucaccgguucaaucagcaccuguuggucaugguaagacaauugaaacauaucagaccagagaaggauucacaaauaucugucucuuuauguuaggaagcauccuauucauaguuucuugccugguaaaggggcugguugacagugucagugacagcuuuuuccccggccugucugucuguaagacaugcucuuuuggcaguauaaauggcuuugaaauugaaucgcauaaaugcuacuguaguuuauuuugcugccccuacuguaggcacugcucugcugacagagaaauucaccaguugcacuuggguaucugcaaaaaaagaaaaacggggagcaaugucaugcuggcugucugcaagcgcaugugcuuuaaggcaaccauagaagcaagcagaagagccuugcucauccgaagcauuaucaauaccacuuuuguaauaugcauccuaacauuagcaaucuguguuguuagcacuucugcaguagagauggaaaaucuuccagcaggcacuugggagagagaggaagaccugacaaauuucugccaucaggaaugccagguaagcgagacggaaugccucuguccauacgaagcucuugugcucaggaaaccucuuuucuuagacaguauaguuaaagguaugaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggauuugucacaaauguauuccccuguuuuugaguacuuaucaggagauagacagguugaagaauggcccaaggcaaccugcacaggugauugcccagaaagguguggcugcacaucaucaaccugcuugcauaaagaauggccucacucaagaaacuggagauguaaucccacuuggugcuggggaguaggaaccggcugcacaugcugcggaguggauguaaaagaccuuuuuacagaucacauguuuaucaaauggaagguugaauauauaaaaaccgaagccauaguauguguugagcucaccagccaagaaagacagugcagucugauugaggcagguacuagauucaacuuggguccugugacuaucacccugucugagccaagaaacauucagcagaagcuucccccugagaucauuacgcugcauccuaaaauugaagaaggcuucuuugacuugaugcaugugcaaaaaguguuaucugcaaguacaguguguaaacugcagaguugcacacaugguauaccaggagaucuacaaauuuaccacauuggcaacuuguugaaaggggauagauuaaacgggcaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccauucuaaaagagucacagcacauggagacacaccacaauuagacuuaaaagcaaggccgacuuacggugcaggugagaucacugugcugguugagguugcugacauggaguugcauaccaagaaaguugagauaucaggcuugaaauuugcaagucuggcuugcacggguugcuaugcuuguagcucuggcaucuccuguaaagucagaauucauguagaugaaccggaugagcucacagugcauguaaagagcagugauccagaugugguugcagcuagcacaagccuuauggcaaggaagcuugaauuugggacagauagcacauucaaggcauuuucagcuaugcccaaaaccucuuuaugcuuuuacauuguggagagggaauacugcaagagcugcagugaagaugauacaaaaaaauguguugacacaaaacuugaucagccacagagcauacuaauugagcacaaagggaccauaauuggaaagcagaaugacacuugcacagccaaggcaaguuguuggcuagagucagucaagaguuuuuuuuauggauugaagaauaugcuuggcaguguuuuugguaauuuuuucguaggcauuuuguuauuccuugcccccuuugucuuguuggugcuuuucuuuauguguggauggaaaaucuuguuuugcuuuaaguguugcaggaggaccagaggcuuguuuaaguauagacaccucaaagaugaugaggaaacaggcuacagaaggauuauugaaagacugaacagcaaaaaaggaaagaacagacugcuugauggugagagguuggcugauaggaaaauugcugagcuguucucuacaaaaucacacauuggcuaa

SEQ ID NO: 3648 - RNA, 5052 nt, Artificial Sequence
  derived and/or modified CDS sequence (wt) from CCHFV(3756-ST-2007)__KR814866.1__GP
augcauacacuauuagugugcuucauucuuuaccuacagcugucggguuuaggaggagcucauggacagucaaacgcaacugaacacaauagaacaaacaccaccacaguacccggcacaagucaaagccccaagccacccgcgagcaccacucuaccacacacaccagaauccuccaccgucaaacucaccacaccaacaagcgaaacagaaggcucaggggaaacgaccccacccccaaacaccacccagggccugccccuaccagggaccacaccagaacgcuccgcaacaaccgccacaagcacgucaagcacagacaacaugaauaccaccacacaggugaccgacaacacccccacaucaacagucagcauaaguccauccagcagccccagcaugccauccacaucacaaggcauacauuaucccguaaggagucuauugucagucucgagcccuaagacaguaacaacaccgacaccaaugagcccuggagagaugagcccggaaaccagcagucagcacucagccaugagcagaauaccaacccucuacacagcaacccaggucuccacugagaacaucaaccgcagcacaccuagacaaucugaguccucaguacagccggcaacccaaagcccaauaacuuccccagcgcaaacaauccuucugaugagugcugcuccuaaagcuauucaggacaugcaucccagcccaacaaacagguccaagaggaaccuugagguggaaauaauuuuaacucugucucaaggucuaaagaaauauuacgguaaaauacugaagcuucugcaccuuaccuuggaagaggauacugaaggccuguuagaaugguguaagagaaaccuugggucaaauugugaugaugacuucuuucaaaagagaauugaagaauucuucauaacuggugagggcuacuucaaugaaguccuacaauuuaaaacacuaagcacacuaagccccacggagccgucucaugucaggcuaccaacagcggagcccuucaaaucuuacuuugcuaagggcuuccuuucaauagauucggguuacuucucugccaaauguuauccaagaucauccacuucagggcuucagcugaucaaugucacccaacacccagcuaggauagcagaaacaccuggacccaaaacaacgagucugaaaaccaucaacuguaucaaccuaagagcaucagucuucaaagaacacagagaaguugagaucaaugugcuucuuccucagauugcagucaaccucucaaacugccauguugugaucaacucacaugucugugauuacucuuuagacacugacgggccagugaggcuuccucgcauucaccaugaagguacuuucauaccaggaacuuauaaaauagugauagacagaaaaaauaagcuaaaugaccgaugcucgcuagucacuaacugugugauaaagggaagagagguucguaagggccaaucagugcugaggcaguacaaaacagaaauuaagauaggcaaggcaucaacaggcucuaggaaacuacuguccgaagagccaggugacgacugcauaucaagaacucagcuauugaagacagaaacagcagagauccaugacgacaacuauggugguccaggugacaaaauaacuaucugcaaugguucaaccauuguagaucagagacugggcagugaacuaggguguuauaccauuaacagggugaagucauucaagcuaugcgaaaacagugccacagggaaaaccugugagauagacagcacuccggucaagugcaggcaagguuuuuguuugaaaaucacccaagagggaaggggccacguaaaauuauccaggggcucagagguuguuuuggaugcuugcgacucgagcugugaaauaaugauaccuaaaggcacuggagauauccuaguagacuguucagguggacagcaacauuucuuaaaagacaacuugauugaccuagggugcccucauaucccgcuauuggguaaaauggccauuuacauuugcagaaugucaaaucaucccaggacaaccauggcuuuccucuucugguucaguuuuggcuauguaaucaccuguauauuuugcaaggcucuuuuuuauucauugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuagcuaggcaugugacacaaugcccuaagcgaaaggagaaaguugaggagacugaacuguauuugaaccuggaaagaauucccuggauagucagaaagcuauugcaagugucagaguccacugguguggcauugaaacgaagcaguuggcugauugugcugcuuguguuacucacagucucauugucaccgguccaaucagcaccuguuggucaugguaagacaaucgaaacauaucagaccagagaaggauucacaaguaucugucucuuuauguuaggaagcauccuauucauaguuucuugccugguaaaggggcugguugacagugucagugacagcuucuuccccggccugucugucuguaagacaugcucuauuggcagcauaaauggcuuugaaauugaaucgcauaaaugcuacuguaguuuauuuugcugccccuacuguaggcacugcucugcugacagagaaauucaccaguugcacuugaguaucugcaaaaaaagaaaaacggggagcaaugucaugcuggcugucugcaagcgcaugugcuuuaaggcaaccauagaagcaagcagaagagcccugcucauccgaagcauuaucaauaccacuuuuguaauaugcauucuaacauuagcaaucuguguuguuagcaccucugcaguagagauggaagaccuuccagcaggcacuugggagagagaggaagaccuaacaaauuucugccaucaggaaugccagguaaccgagacggaaugccucuguccauacgaagcucuugugcucaggaaaccucuuuucuuagacaguauaguuaaagguaugaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggauuugucacaaauguauuccccuguuuucgaguacuuaucaggagauagacagguugaagaauggcccaaggcaaccugcacaggugauugcccagaaagguguggcugcacaucaucaaccugcuugcauaaagaauggccucauucaagaaacuggagauguaaucccacuuggugcuggggaguaggaaccggcugcacaugcugcggaguggauguaaaagaccuuuuuacagaccacauguuuaucaaauggaagguugaauauauaaaaaccgaagccauaguauguguugagcucaccagccaagaaagacaaugcagucugauugaggcagguacuagauucaacuuggguccugugacuaucacccugucugagccaagaaacauucagcagaagcuucccccugagaucauuacgcugcaucccaaaauugaagaaggcuucuuugacuugaugcaugugcaaaaaguguuaucugcaaguacaguguguaaacugcagaguugcacacauggcauaccaggagaucuacaaauuuaccacauuggcaacuuguugaaaggggauagaguaaacgggcaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaagaaaguugagauaucaggcuugaaauuugcaagucugacuuguacggguugcuaugcuuguagcucuggcaucuccuguaaagucagaauucauguagaugaaccagaugagcucacagugcauguaaagagcagugauccagaugugguugcagcuagcacaagccuuauggcaaggaagcuugaauuugggacagauagcacauucaaggcauuuucagcuaugcccaaaaccucuuuaugcuuuuacauuguggagagggaauacugcaagagcugcagugaagaugauacaaaaaaauguguugacacaaaacuugagcagccacagagcauacuaauugagcacaaagggacgauaauuggaaagcagaaugauacuugcacagccaaggcaaguuguuggcuagagucggucaagaguuuuuuuuauggauugaagaauaugcuuggcaguguuuuugguaguuuuuucguaggcauuuuguuauuccuuaccccuuuugucuuguuggugcuuuucuuuauguuuggauggaaaaucuuguuuugcuuuaaguguugcaggaggaccagaggcuuguuuaaguauagacaccucaaagaugacgaggaaacaggcuacagaaggauuauugaaagacugaacagcaaaaaaggaaaaaacagacugcuugauggugagagguuggcugauaggaaaauugcugagcuguucucuacaaaaacacacauuggcuaa

SEQ ID NO: 3649 - RNA, 5052 nt, Artificial Sequence
  derived and/or modified CDS sequence (wt) from CCHFV(47-ST-2013)__KR814861.1__GP
augcauacacuauuagcgugcuucauucuuuaccuacagcugucggguuuaggaggagcucauggacagucaaacgcaacugaacacaauggaacaaacaccaccacaguacccggcacaagucaaagccccaaaccacccgcgagcaccacuuuaccacacacaccagaauccuccaccgucaaacucaccacaccaacaagcgaaacagaaggcucaggggaaacgaccccacccccaaacaccacccagggccugcccccaccagggaccacaccagaacgcuccgcaacaaccgccacaagcacgucaagcacagacaacaugaauuccaccacacagaugaccggcaacacccccacaccaacagucaacaugaguccauccagcagccccagcaugccauccacaucacaaggcauacauuaucccguaaggagucuauugucagucccgagccccaagacagcaacaacaccgacaccagugagcccuggagagaugagcccggaaaccagcagucagcacucagccacgagcagaauaccaacccucuacacagcaacccagguuuccacugagaacaccaaccgcagcacaccuagacaaucuaaguccucaguacagccggcaacccaaagcccaauaacucccccagcgcaaacaauccuucugaugagugcugcuccuaaagcuauucaggacaugcaucccagcccaacaaacagguccaagaggaaccuugagguggaaauaauuuuaacucugucucaaggucuaaagaaauauuacgguaaaauacugaagcuucugcaccuuaccuuggaagaggauacugaaggccuguuagaauggugcaagagaaaccuugggucaaauugugaugaugacuucuuucaaaagagaauagaagaauucuucauaacuggugagggcuacuucaaugaaguccuacaauuuaaaacacuaagcacacuaagccccacggagccgucucaugucaggcuaccaacagcggagcccuucaaaucuuacuacgcuaagggcuuccuuucauuagauucggguuacuucucugccaaauguuauccaagaucauccacuucagggcuucagcugaucaaugucacccaacacccagcuaggauagcagaaacaccuggacccaaaacaacaagucugaaaaccaucaacuguaucaaccuaagagcaucagucuucaaagaacacagagaaguugagaucaaugugcuucuuccucagauugcagucaaccucucaaacugccauguugugaucaacucacaugucugugauuauccuuuagacacugacgggccagugaggcuuccucgcauucaccaugaagguacuuucauaccaggaacuuauaaaauagugauagacaaaaaaaauaagcuaaaugaccgaugcucgcuagucacuaacugugugauaaagggaagagagguucguaagggccaaucagugcugaggcaguacaaaacagaaauuaagauaggcaaggcaucaacaggcucuaggaaacuacuguccgaagagccaggugacgacugcauaucaagaacucagcuguugaagacagaaacagcagagauccaugacgacaacuauggugguccaggugacaaaauaacuaucugcaaugguucaaccauuguagaucagagacuggguagugaacuaggguguuauaccaucaacagggugaagucauucaagcuaugcaaaaacagugccacagggaaaaccugugagauagacagcacuccggucaagugcaggcaagguuuuuguuugaaaaucacccaagagggaaggggccacguuaaauuauccaggggcucagagguuguuuuggaugcuugcgacucgagcugugaaauaaugauaccuaaaggcacuggagauauccuaguagacugcucagguggacagcaacauuucuuaaaagacaacuugauugaccuagggugcccucauaucccgcuauuggguaagauggccauuuacauuugcagaaugucaaaucaucccaggacaaccauggcuuuccucuucugguucaguuuuggcuauguaaucaccuguauauuuugcaaggcucuuuuuuauucauugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagauugaccucugaugggcuagcuagacaugugacacaaugcccuaagcgaaaggagaaaguugaggagacugaacuguauuugaaccuggaaagaauuccuuggauagucagaaaguuauugcaagugucagaguccacugguguggcauugaaacgaagcaguuggcugauugugcugcuuguguuacucacagucucauugucaccgguucaaucagcaccuguuggucaugguaagacaauugaaacauaucagaccagagaaggauucacaaguaucugucucuuuauguuaggaagcauccuauucauaguuuccugccugguaaaggggcugguugacagugucagugacagcuucuuccccggccugucugucuguagaacaugcucuauuggcaguauaaauggcuuugaaauugaaucgcacaaaugcuacuguaguuuauuuugcugccccuacuguaggcacugcucugcugacagagaaauucaccaguugcacuugaguaucugcaaaaaaagaaaaacggggagcaaugucaugcuggcugucugcaagcgcaugugcuuuaaggcaaccauagaagcaagcagaagagcccuguucauccggagcauuaucaauaccacuuuuguaacaugcauucuaacauuagcaaucuguguuguuagcaccucugcaguagagauggaagaccuuccagcaggcacuugggagagagaggaagaccugacaaauuucugccaucaggaaugccaggugaccgagacggaaugccucuguccauacgaagcucuugugcucaggaaaccucuuuucuuagacaguauaguuaaagguaugaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagauccuggucacaggcaggucugaaucaauuaugaaacuagaggaaaggacaggagucagcugggaucuagguguagaagaugccucugaauccaaauuacuuaccgucucuaucauggauuugucacaaauguauuccccuguuuuugaguacuuaucaggagauagacagguugaagaauggcccaaggcaaccugcacaggugaaugcccagaaagguguggcugcacaucaucaaccugcuugcauaaagaauggccucacucaagaaacuggagauguaaucccacuuggugcuggggaguaggaaccggcugcacaugcugcggaguggauguaaaagaccuuuuuacagaucacauguuuaucaaauggaagguugaauauauaaaaaccgaagccauaguauguguugagcucaccagccaagaaagacagugcagucugauugaggcagguacuagauucaacuuagguccugugacuaucacccugucugagccaagaaacauucagcagaagcuucccccugagaucauuacgcugcaucccaaaauugaagaaggcuucuuugacuugaugcauguacaaaaaguguuaucugcaaguacaguguguaaacugcagaguugcacacaugguauaccaggagaucuacaaauuuaccacauuggcaacuuguugaaaggggauagaguaaacgggcaucuaauucacaaaauugaaccacauuuuaacaccucuuggauguccugggaugguugugaccuagacuacuacugcaacaugggggauuggccuucuugcacauacacaggagugacccaacauaaucaugcugcauuuguaaacuugcuuaacauugaaacugauuacacaaaaaccuuccacuuccacucuaaaagagucacagcacauggagacacaccacaauuagacuuaaaagcaaggccgaccuacggugcaggugagaucaccgugcugguugagguugcugacauggaguugcauaccaagaaaguugagguaucaggcuugaaauuugcaagucuggcuugcacggguugcuaugcuuguagcucuggcaucuccuguaaagucagaauucauguagaugaaccagaugagcucacagugcauguaaagagcagugauccagaugugguugcagcuagcacaagccuuauggcaaggaagcuugaauuugggacagauaguacauucaaggcauuuucagcuaugccuaaaaccucuuuaugcuuuuacauuguggagagggaauacugcaaaagcugcagugaagaugauacaaaaaaauguguugacacaaaacuugaacagccacagagcauacuaauugagcacaaagggacaauaauuggaaagcagaaugauacuugcacagccaaggcaaguuguuggcuagagucagucaagaguuuuuuuuauggauugaagaauaugcuuggcaguguuuuugguaauuuuuuuguaggcauuuuguuauuccuugccccuuuugucuuguuggugcuuuucuuuauguuuggauggaaaaucuuguuuugcuuuaaguguugcaggaggaccagaggcuuguuuaaguauagacaccucaaagaugaugaggaaacaggcuacagaaggauuauugaaagacugaacagcaaaaaagggaaaaacagacugcuugauggugagagguuggcugauaggaaaauugcugagcuguucucuacgaaaacacacauuggcuaa

SEQ ID NO: 3650 - RNA, 5052 nt, Artificial Sequence
  derived and/or modified CDS sequence (wt) from CCHFV(1-CR/HU-2015)__KU161584.1__GP
augcauacacuauuagugugcuucauucuuuaccuacagcuguugggucuaggaggggcucaugaacagucaaacgcaacugaucacaauagaacaaacaccaucacagcacccagcacaagucaaaaccccaagccacccgcgagcacaaccccaccacacacaccggaaucauccaccaucaagcucaucacaucaacaggcgaagcagaaggcucaggggaaacgacuccaccccuaaacaccacccagggcccauucccaccagagaccacaucagaacacccugcaucaaccgccacaaacacgucaagcacaaacagcaugaauuccaccacacagaugaccgauaauacccucacaucaacagucagcacaagucuauccaucagccccagcacgccauccacaucacaaggcauacauuaucccguaaggagucuauugucagucucgagcccuaagacagcagcaacaccaacaccaaugagcacuagagagaugagcucagaaaccagcagucagcacucagccaugagcagaacaccaaccuuccacacagcaacucaggucuccacugagaacgccaaccgcagcaccccuagacagucugaauccucagcacagccggcaacccaaagcccaaugacuuccccagcgcaaucaaucuuucuggugagugcugcuccuacaaccauucagaacauacaucccagcccaacaaacagguccaagaggaaccuugagauggaaauaauuuugacucugccucaaggucuaaagaaauacuacgguaaaauacugaagcuucugcaccuuacccuagaagaggacacugaaggccuguuagaaugguguaagagaaaccuuggaucgaacugugaugaugaauucuuccaaaagagaauagaagaauucuucauaacuggugagggcuacuucaaugagguccuacaauuuaaaacacuaagcacacuaagccccacggagccgucucaugccaggccaccaacagcggaacccuucaaaucuuacuucgcuaagggcuuccuuucaauagauucagguuacuucucugccaaauguuauccaagaucauccacuucagggcuucagcugauuaauauuacccaacacccagcuaggauagcagaaacaccuggucccaaaacaacgagucugaaaaccaucaacuguaucaaucuaagagcaucuguuuucaaagaacacagagaaguugagaucaauguacuucuuccucagauugcagucaaccuuucaaacugccauguugugaucaauucacaugucugugauuacucuuuagacacugaugggccugugaggcuuccucgcauuuaccaugaaggaacuuucauaccagggacuuauaaaauagugauagacaaaaaaaacaagcuaaaugaccggugcacgcuagucacuaacugugugauaaagggaagagaaguucguaagggccaaucagugcugaggcaauacaaaacagaaauuaagauaggcaaggcaucaacaggcucuaggaaacuacuguccgaagagccaggugaugacugcauaucaagaacucagcuauugaggacagaaacagcagagauccaugacgacaacuacggcgguccaggugacaaaauaacuaucugcaaugguucaaccaucguagaucagagacugggcagugaacuaggguguuauaccaucaacagggugaagucauucaagcuaugcgaaaacagcgcuacagggaaaaccugugagauagacagcacuccggucaagugcaggcaagguuucuguuuaaaaaucacccaagagggaaggggccacguaaaauuaucuagaggcucagagguugucuuggaugcuugcgacucaagcugugaagugaugauaccuaaaggcaccggagauauccuaguagacuguucagguggacagcagcauuuuuuaaaagacaacuugauugaccuagggugcccccacaucccgcuauuggguaagauggccauuuacauuugcagaaugucaaaucauccuaggacaaccauggcuuuucucuucugguucagcuuuggcuaugugaucaccuguauauuuugcaaggcucuuuuuuauucauuaauaauuauugggacacuagggaaaaagaucaagcaguauagagaacuaaaaccucaaacuuguacuauaugugagacagcuccugucaaugcaauagaugcugaaaugcaugaccucaacuguaguuacaauauaugcccuuauugugcaucaagacugaccucugaugggcuagcuaggcauguaacgcaaugcccuaagcgaaaggagaaaguugaggagacugaacuguacuugaaccuagaaagaauuccuuggaucgucagaaagcuauugcaagugucagaguccacugguguggccuugaaacgaagcaguugguugauugugcugcuuguguuacucacaguuucauugucaccgguucaaucagcaccuguuggucaugguaagacaaucgaaacauaucagaccagagaaggauucacaaguaucugucucuuuauguuaggaagcauccuauucauagucucuugcuuggugaaggggcugguugacagcgucagugacagcuucuuccccggccugucugucuguaggacaugcucuauuggcagcauaaauggcuuugaaauugagucgcauaagugcuacuguagcuuauuuugcugccccuacuguaggcacuguucugcugacagagaaauucaccaguuacacuugaguaucugcaaaaaaagaaaaacggggagcaaugucaugcuggcugucugcaaacgcauguguuuuagggcaaccauggaggcaagcagaagagcccugcucauccgaagcauuaucaauaccacuuuuguaauaugcauucuaacauuaacaaucuguguugucagcaccucugcaguagagauggaaaaccuuccagcaggcacuugggagagagaggaagaccugacaaauuucugucaucaggaaugccagguaaccgagacggagugccucuguccauacgaagcucuugugcucaggaaaccccuuuuccuagacaguauaguuaaagguaugaaaaauuugcuaaacucgacaagcuuagaaacaagcuuaucaauugaggcaccauggggagcaauaaauguccagucaaccuuuaaaccaacaguaucaacugcaaacauagcacucaguuggagcucaguggagcacagaggcaacaagaucuuagucacaggcaggucugaaucaauuaugaaacuagaggaaaggacaggagucagcugggaucuaggcguagaagaugccucugaauccaaauuacuuaccgucucuauaauggauuuaucacaaauguauuccccuguuuuugaguacuugucaggagacagacagguugaagaguggcccaaagcaacuuguacaggugauugcccagaaagguguggcugcacaucaucaaccugcuugcauaaagaauggccucacucaagaaacuggagauguaaucccacuuggugcuggggaguaggaaccggcugcaccuguugcgggguggauguaaaagaccuuuuuacagaucacauguuugucaaauggaagguugaauauauaaaaacugaagccauaguauguguugagcucaccagccaggaaagacagugcagucuuauugaggcagguacaagauucaacuuaggcccugugacuaucacccugucugagccaagaaacauucagcagaagcuucccccugagaucauuacguugcaucccaaaauugaagaaggcuucuuugacuugaugcauguacaaaaaguguugucugcaaguacaguguguaaacugcagaguugcacacaugguauaccaggagaccuacaaguuuaccacauuggcaacuuguugaaaggggauagaguaaacgggcaucuaauucacaaaauugaaccacauuuuaacaccucuuggauguccugggaugguugugaucuagacuacuacugcaacaugggggacuggccuucuugcacauacacaggagugacccagcauaaucaugcugcauuuguaaacuugcuuaacauugaaacugauuacacgaaaaccuuccacuuccacucuaaaagagucacagcacauggugacacaccacaauuagacuuaaaagcaaggccgaccuacggugcaggugagaucacugugcugguugagguugcugacauggaguugcauaccaaaaaaguugagauaucaggcuugaaauuugcaagccuggcaugcacggguugcuaugcuuguagcucuggcaucuccuguaaagucagaauucauguagaugaaccagaugagcucacagugcauguaaagagcagugauccagacgugguugcagcuagcacaagucuuauggcaaggaagcuugaauuugggacagacagcacauucaaggccuuuucagcuaugccuaaaaccucuuuauguuuuuacauuguggagagagaauacugcaagagcugcagugaagaugauaccaaaaaauguguugacacaaaacuugagcagccacagagcauacuaauugagcacaaagggacgauaauuggaaagcagaaugauacuugcacagccaaggcaagcuguuggcuagagucagucaagaguuuuuuuuauggauugaagaauaugcucggcaguguuuuuggcaauuuuuuuauaggcauuuuguuauuccuugccccuuuuguccuguuggugcuuuucuuuauguuuggauggaaaaucuuguuuugcuuuaaauguugcaggaggaccagaggcuuguuuaaguauagacaccucaaagacgaugaggaaacaggcuacagaaggauuauugaaagacugaacaacaaaaaggggaaaaacagacugcuugauggugaaagguuggcugauaggaaaauugcugagcuguucuccacaaaaacacacauuggcuaa

SEQ ID NO: 3651 - RNA, 5049 nt, Artificial Sequence
  derived and/or modified CDS sequence (wt) from CCHFV(3820-ST-2007)__KR814868.1__GP
augcauacacuauuagugugcuucauucuuuaccuacagcugucggguuuaggaggagcucauggacagucaaacgcaacugaacacaauggaacaaacaccaccacaguacccggcacaagucaaagccccaagccacccgcgagcaccacucuaccacacacaccagaauccuccaccgucaaacucaccacaccaacaagcgaaacagaaggcucaggggaaacgacccccccaaacaccacccagggccugccccuaccagggaccacaccagaacgcuccgcaacaaccgccacaagcacgucaagcacagacaacaugaauuccaccacacaggugaccgauaacacccccacaucaacagucagcauaaguccauccagcagcuccagcaugccauccacaucacaaggcauacaucaucccguaaggagucuauugucagucucgagcccuaagacaguaacaacaccgacaccaaugagcccuggagagaugagcccggaaaccagcagucagcacucagccaugagcagaguaccaacccucuacacagcaacccagaucuccacugagaacaccgaccgcagcacaccuagacaaucugaguccucaguacagccggcaacccaaagcccaauaacuuccccagcgcaaacaauccuucugaugagugcugcuccuaaagcuauucaggacaugcaucccagcccaacaaacagguccaagaggaaccuugagguggaaauaauuuuaacucugucucaaggucuaaagaaauauuacgguaaaauacugaagcuucugcaccuuaccuuggaagaggauacugaaggccuguuagaaugguguaagagaaaccuugggucaaauugugaugaugacuucuuucaaaagagaauagaagaauucuucauaacuggugagggcuacuucaaugaaguccuacaauuuaaaacacuaagcacacuaagccccacggagccgucucaugucaggcuaccaacagcggagcccuucaaaucuuacuucgcuaagggcuuccuuucaauagauucggguuacuucucugccaaauguuauccaagaucauccacuucagggcuucagcugaucaaugucacccaacacccagcuaggauagcagaaacaccuggacccaaaacaacgagucugaaaaccaucaacuguaucaaccuaagagcaucagucuucaaagaacacagagaaguugagaucaaugugcuucuuccucagauugcagucaaccucucaaacugccauguugugaucaacucacaugucugugauuacucuuuagacacugacgggccagugaggcuuccucgcauucaccaugaagguacuuucauaccaggaacuuauaaaauagugauagacagaaaaaauaagcuaaaugaccgaugcucgcuagucacuaacugugugauaaagggaagagagguucguaagggccaaucagugcugaggcaguacaaaacagaaauuaagauaggcaagacaucaacaggcucuaggaaacuacuguccgaagagccaggugacgacugcauaucaagaacucagcuauugaagacagaaacagcagagauccaugacgacaacuaugguaguccaggugacaaaaucacuaucugcaaugguucaaccauuguagaucagagacugggcagugaacuaggguguuauaccaucaacagggugaagucauucaagcuaugcgaaaacagugccacagggaaaaccugugagauagacagcacuccggucaagugcaggcaagguuuuuguuugaaaaucacccaagagggaaggggccacguaaaauuauccaggggcucagagguuguuuuggaugcuugcgacucgagcugugaaauaaugauaccuaaaggcacuggagauauccuaguagacuguucagguggacagcaacauuucuuaaaagacaacuugauugaccuagggugcccucauaucccgcuauuggguaaaauggccauuuacauuugcagaaugucaaaucaucccaggacaaccauggcuuuccucuucugguucaguuuuggcuauguaaucaccuguauauuuugcaaggcucuuuuuuauucacugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuggcuaggcaugugacacaaugcccuaagcgaaaggagaaaguugaggagacugaacuguauuugaaccuggaaagaauuccuuggauagucagaaagcuauugcaagugucagaguccacugguguggcauugaaacgaagcaguuggcugauugugcugcuuguguuacucgcagucucauugucaccgguccaaucagcaccuguuggucaugguaagacaaucgaaacauaucagaccagagagggauucacaagcaucugucucuuuauguuaggaagcauccuauucauaguuucuugccugguaaaggggcugguugacagugucagugacagcuucuuccccggccugucugucuguaagacaugcucuauuggcaguauaaauggcuuugaaauugaaucgcauaaaugcuacuguaguuuauuuugcugccccuacuguaggcacugcucugcugacagagaaauucaccaguugcacuugaguaucugcaaaaaaagaaaaacggggagcaaugucaugcuggcugucugcaagcgcaugugcuuuaaggcaaccauagaagcaagcagaagagcccugcucauccgaagcauuaucaauaccacuuuuguaaugugcauucuaacauuagcaaucuguguuguuagcaccucugcaguagagauggaagaccuuccagcaggcacuugggagagagaggaagaccuaacaaauuucugccaucaggaaugccaggugaccgagacggaaugccucuguccauacgaagcucuugugcucaggaaaccccuuuucuuagacaguauaguuaaagguaugaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaccuaggcguagaagaugccucugaauccaaauuacuuaccgucucuaucauggauuugucacaaauguauuccccuguuuuugaguacuuaucaggagauagacagguugaagaauggcccaaggcaaccugcacaggugauugcccagaaagguguggcugcacaucaucaaccugcuugcauaaagaauggccucauucaagaaacuggagauguaaucccacuuggugcuggggaguaggaaccggcugcacaugcugcggaguggauguaaaagaccuuuuuacagaccacauguuuaucaaauggaagguugaauauauaaaaaccgaagccauaguauguguugagcucaccagccaagaaagacagugcagucugauugaggcagguacuagauucaacuuggguccugugacuaucacccugucugagccaagaaacauucagcagaagcuucccccugagaucauuacgcugcaucccaaaauugaagaaggcuucuuugacuugaugcaugugcaaaaaguguuaucugcaaguacaguguguaaacugcagaguugcacacaugguauaccaggagaucuacaaauuuaccacauuggcaacuuguugaaaggggauagaguaaacggccaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaaaaaaguugagauaucaggcuugaaauuugcaagucugacuuguacggguugcuaugcuuguagcucuggcaucuccuguaaagucagaauucauguagaugaaccagaugagcucacagugcauguaaagagcagugauccagaugugguugcagcuagcacaagccuuauggcaaggaagcuugaauuugggacagauagcacauucaaggcauuuucagcuaugcccaaaaccucuuuaugcuuuuacauuguggagagggaauacugcaagagcugcagugaagaugauacaaaaaaauguguugacacaaaacuugagcagccacagagcauacuaauugagcacaaagggacgauaauuggaaagcagaaugauacuugcacagccaaggcaaguuguuggcuagagucagucaagaguuuuuuuuauggauugaagaauaugcuuggcaguguuuuugguaguuuuuucguaggcauuuuguuauuccuugccccuuucgucuuguuggugcuuuucuuuauguuuggauggaaaaucuuguuuugcuuuaaguguugcaggaggaccagaggcuuguuuaaguauagacaccucaaagaugacgaggaaacaggcuacagaaggauuauugaaagacugaacagcaaaaaaggaaaaaacagacugcuugauggugagagguuggcugauaggaaaauugcugagcuguucucuacaaaaacacacauuggcuaa

SEQ ID NO: 3652 - RNA, 5052 nt, Artificial Sequence
  derived and/or modified CDS sequence (wt) from CCHFV(Ast199)__KX056051.1__GP
augcauacacuauuagugugcuucauucuuuaccuacagcugucggguuuaggaggagcucauguacagucaaacgcaacugaacacaauggaacaaacaccaccacaguacccggcacaagucaaagccccaagccacccgcgagcaccacucuaccacacacaccagaauccuccaccgucaaacucaccacaccaacaagcgaaacagaaggcucaggggaaacgaccccacccccaaacaccacccagggccugcccccaccagggaccacaccagaacgccccgcaacaaccgccacaaccacgucaagcacagacaacaugaacuccaccacacaggugaccgacaacacccccacaucaacagucagcauaaguccauccagcaaccccagcaugccauccacaucacaaggcauacauuaucccguaaggagucuauugucagucucgagccccaagacaguaacaacaccgacaccaaugagcccuggagagaugagcccggaaaccagcagucagcacucagccaugagcagaauaccaacccucuacacagcagcccaggucuccacugagaacaccaaccgcagcacaccuagacaaucagaguccucagcacagccggcaacccagagcccaacaacuuucccagcgcaaacaaucccccugaugagugcugcucccaaagccauucaggacaugcaucccagcccaacaaacagguccaagaggaaccuugagguggaaauaauuuuaacucugucucaaggucuaaagaaguauuacgguaaaauacugaagcuucugcaccuuaccuuggaagaggauacugaaggccuguuagaaugguguaagagaaaccuugggucaaauugugaugaugacuucuuucaaaagagaauagaagaauucuucauaacuggugagggcuacuucaaugaaguccuacaauuuaaaacaccaagcacacuaagccccacggagccgucucauguuaggcuaccaacagcagagcccuucaaaucuuacuucgcuaagggcuuccuuucaauagauucggguuacuucucugccaaauguuauccaagaucauccacuucagggcuucagcugaucaaugucacccaacacccagcuaggauagcagaaacaccuggacccaaaacaacgagucugaaaaccaucaacuguaucaaccuaagagcaucagucuucaaagaacacagagaaguugagaucaaugugcuucuuccucagauugcagucaaccucucaaacugccauguugugaucaacucacaugucugugauuacucuuuagacacugacgggccagugaggcuuccucgcauucaccaugaggguacuuucauaccaggaacuuauaaaauagugauagacaaaaaaaauaagcuaaaugaccgaugcucgcuagucacuaacugugugauaaagggaagagagguucguaagggccaaucagugcugaggcaguacaaaacagaaauuaagauaggcaaggcaucaacaggcucuaggaaacuacuguccgaagagccaggugacgacugcauaucaagaacucagcuauugaagacagaaacagcagagauccaugacgacaacuauggugguccaggugacaaaauaacuaucugcaaugguucaaccauuguagaucagagacugggcagugaacuaggguguuacaccaucaacagggugaagucauucaagcuaugcgaaaacagugccacagggaaaaccugugagauagacagcacuccggucaagugcaggcaagguuuuuguuugaaaaucacccaagagggaaggggccacguaaaauuauccaggggcucagagguuguuuuggaugcuugcgacucgagcugcgaaauaaugauaccuaaaggcacuggagauauccuaguagacuguucagguggacagcaacauuucuuaaaagacaacuugauugaccuagggugcccucauaucccgcuauuggguaagauggccauuuacauuugcagaaugucaaaucaucccaggacaaccauggcuuuccucuucugguucaguuuuggcuauguaaucaccuguauauuuugcaaggcucuuuuuuauucauugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuagcuaggcaugugacacaaugcccuaagcgaaaggagaaaguugaggagacugaacuguauuugaaccuggaaagaauuccauggauagucagaaagcuguugcaagugucagaguccacugguguggcauugaaacgaugcagcuggcugauugugcugcuuguguuacucacagucucauugucaccgguucaaucagcaccuguuggucaugguaagacaaucgaaacauaucagaccagagaaggauucacaaauaucugucucuuuauguuaggaagcauccuauucauaguuucuugccugguaaaggggcugguugacagugucagugacagcuucuuccccggccuaucugucuguaagacaugcucuauuggcaguauaaauggcuuugaaauugaaucgcacaaaugcuacuguaguuuauuuugcugccccuacuguaggcacugcucugcugacagagaaauucaccagcugcacuuggguaucugcaaaaaaagaaaaacggggagcaaugucaugcuggcugucugcaagcgcaugugcuuuaaggcaaccauagaagcaagcagaagagcccuacucauccgaagcauuaucaauaccacuuuuguaauaugcauccuaacauuagcaaucuguguuguuagcaccucugcaguagagauggaaaaucuuccagcaggcacuugggagagagaggaagaccugacaaauuucugccaucaggaaugccagguaaccgagacggaaugccucuguccauacgaagcucuugugcucaggaaaccucuuuucuuagacaguauaguuaaagguaugaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggauuugucacaaauguauuccccuguuuuugaguacuuaucaggagauagacagguugaagaauggcccaaggcaaccugcacaggugauugcccagaaagguguggcugcacaucaucaaccugcuugcauaaagaauggccucacucaagaaacuggagauguaaucccacuuggugcuggggaguaggaaccggcugcacaugcugcggaguggauguaaaagaccuuuuuacagaucacauguuuaucaaauggaagguugaauauauaaaaaccgaagccauaguauguguugagcucaccagccaagaaagacagugcagucugauugaggcagguacuagauucaacuuggguccugugacuaucacccugucugagccaaggaacauucagcagaagcuucccccugagaucauuacgcugcauccuaaaauugaagaaggcuucuuugacuugaugcaugugcaaaaaguguuaucugcaaguacaguguguaaacugcagaguugcacacaugguauaccaggagaucuacaaauuuaccacauuggcaacuuguugaaaggggauagauuaaacgggcaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaagaaaguugagguaucaggcuugaaauuugcaagucuggcuugcacggguugcuaugcuuguagcucuggcaucuccuguaaagucagaauucauguagaugaaccggaugagcucacagugcauguaaagagcagugauccagaugugguugcagcuagcacaagccuuauggcaaggaagcuugaauuugggacagauagcacauucaaggcauuuucagcuaugcccaaaaccucuuugugcuuuuacauuguggagagggaauacugcaagagcugcagugaagaugauacaaaaaaauguguugacacaaaacuugagcagccacagagcauacuaauugagcacaaagggacgauaauuggaaagcagaaugauacuugcacagccaaggcaaguuguuggcuagagucagucaagaguuuuuuuuauggauugaagaauaugcuuggcaguguuuuugguaauuuuuucguaggcauuuuguuauuccuugccccuuuugucuuguuggugcuuuucuuuauauuuggauggaaaaucuuguuuugcuuuaaguguugcaggaggaccagaggcuuguuuaaguauagacaccucaaagaugaugaggaaacaggcuacagaaagauuauugaaagacugaacagcaaaaaaggaaaaaacagacugcuugauggugagagguuggcugauaggaaaauugcugagcuguucucuacaaaaacacacauuggcuaa

SEQ ID NO: 3653 - RNA, 5052 nt, Artificial Sequence
  derived and/or modified CDS sequence (wt) from CCHFV(Turkey200310849)__DQ211636.1__GP
augcauacacuguuggugugcuucauucuuuaccuacagcuguugugucuaggaggagcucaugggcaguuaaacacaacugaacacaauggaacaaacaacaccacagcaccuggcgcaagccaaagccccaagccacccaugagcacaaccccaccacacgcaccggaaucauccaccaucaaacccaccacaccaauaagcgaagcagaaggcucaggggaaacgacuucaaccccaaacaccacccagggccuguccucgccagagaccacaucagaacgcccugcaacaacugccauaagcacgucaagcacagacagcacgaaccccaccacacagaugaccgacaacacccccacacuaacagucaguacaagcccauccagcagccccagcacgccauccacaccacaaggcauauaucauccugcaaggagucuauugucagucucgagcccuaagacaguaacaacaccaacaccaacgagcccuggagagaugagcucggaaaccagcagucagcacucagccaugagcagaauaccaaccccccacacagcaacccgggucuccacugagaacaccaaccacagcacaccuagacaaucugaauccucagcacagcagacaaccccaagcccaaugacuuccccagcgcaaucgauccuucuaaugagugcugcuccuacagcuguucaagacauacaucccagcccaacaaacaggucuaagaggaaccuugagacggaaauaauuuuaacucuaucucaaggucuaaagaaauacuacgguaagauacugaagcuucugcaccucaccuuagaagaggacaccgaaggccuguuagaaugguguaagagaaaccuugggucaaacugugaugaugacuucuuucaaaagagaauagaagaauucuucaugacuggugagggcuacuucaaugaagucuuacaauuuaaaacacuaagcacacuaagccccacggagccgucucaugccaggcuaccaacagcagaacccuucaaaucuuacuuugcuaagggcuuccuuucaauagauucagguuacuucucugccaaauguuauccaagaucaucugcuucagggcuucagcugaucaauguuacccaacacccagcuaggauagcagaaacaccuggacccaagacaacgagucugaaaaccaucaacuguauaaaccuaagagcaucagucuucaaagaacacagagaaauugagaucaaugugcuucuuccucagauugcagucaaccucucaaacugccauguugugaucaauucacaugucugugauuacucuuuagacacugaugggccagugaggcuuccucgcauuuaucaugaagggacuuucauaccaggaacuuauaaaauagugauagacaaaaaaaauaagcuaaaugaccguuguacacuggucaccaacugugugauaaagggaagagagguucguaaggggcaaucagugcugaggcaguacaaaacagaaaucaagauaggcaaggcaucaacaggcuuuaggaaacuacuguccgaagagccaggugaugacugcauaucaagaacucagcuauugaggacagaaacagcagagauccaugaugacaacuauggugguccaggugauaaaauaacuaucugcaacgguucaaccauuguagaucagagacugggcagugaacuaggguguuauaccaucaacagggugaagucauucaagcuaugcgaaaacagcgccacagggaaaaccugugagguagacagcacuccgguuaagugcaggcaagguuuuuguuuaaaaaucacccaagagggaaggggccacguaaaauuaucuagaggcucagagguuguccuggaugcuugcgacucaagcugugaaguaaugauaccuaaaggcacuggggauauccuaguggacuguucaggugggcagcaacauuucuuaaaagacaacuuaauugaccuagggugcccccauaucccgcuauuggguaagauggcuauuuacauuugcagaaugucaaaucauccuagaacaaccauggcuuuucucuucugguucagcuuuggcuauguuaucaccuguauaucuugcaaggcucuuuuuuauucauugauaauuauuggaacacuaggaaaaaagaucaagcaauauagggaacugaaaccucaaaccugcaccauaugugagacagcuccugucaaugcaauagaugcugaaaugcaugaccucaacuguaguuacaauauaugcccuuauugugcaucaagauugaccuccgaugggcuagccaggcauguaacgcaaugccccaagcggaaagagaagguugaagagacugaacuguaccugaaccuggaaagaauuccuuggauugucagaaagcuauugcaggugucagaguccacugguguggcauuaaaacgaagcagcuggcugauuguacugcuuguguuacuaacaguuucauugucaccgguucaaucagcaccuguuggucauggaaagacaaucgaaauauaucagaccagggaaggauucgcaagcaucugucucuuuauguuaggaagcauucuauuuauagucucuugcuuggugaaagggcuaguugacagugucagugacagcuucuuccccggccuaucugucuguaagacaugcucuauuggcaguguaaauggcuuugaaauugaaucgcacaaaugcuacuguagccuauuuugcugccccuacugcaggcacugcucugcugacagagaaauucaccaguuacacuugaguaucugcaaaaaaaggaaaacggggagcaaugucaugcuggccgucugcaaacgcaugugcuuuagggcaaccauagaagcaagcagaagagcccugcucauccgaagcauuaucaauaccacuuuuguaauaugcauucuaacauugacaaucuguguuguuagcaccucugcaguggagauggaaaaccuuccagcaggaacuugggagagggaggaagaucugacaaauuucugucaucaggaaugccagguaacugagacagaaugccucuguccauacgaagcucuugugcucagaaaaccucuuuucuuggacaguauaguuaaagguaugaaaaauuugcuaaacucaacaagcuuggaaacaagcuuaucaauugaggcaccauggggagcaauaaauguccagucaaccuuuaaaccagcuguaucgacugcaaacauagcacucaguuggagcucaguggagcacagaggcaacaagaucuuagucacaggcaggucugaaucaauuaugaaacuggaggaaaggacaggagucagcugggaucuagguguagaagaugccucugaauccaaauuacuuaccguuucuaucauggauuugucacaaauguauucuccuguuuuugaguacuugucaggagacagacagguugaagaauggcccaaagcaacuuguacaggugauugcccggagaggugugguugcacaucaucaaccugcuuacauaaagaauggccucacucaagaaacuggagauguaaucccacuuggugcuggggaguaggaaccggcugcaccugcugcgggguggauguaaaagaucuuuuuacagaucacauguuugucaaauggaaaguugaauacauaaaaacugaagcuauaguauguguugaacucaccagccaagaaagacagugcagucugauugaggcagguacuagauucaacuugggcccugugacuauuacccugucugagccaagaaacauucagcagaagcuuccuccugagauuaucacguugcaucccaaaauugaagaaggcuucuuugacuugaugcauguacaaaaaguguugucugcaaguacaguguguaaacugcagaguugcacacaugguauaccaggagaucuacaaguuuaccacauuggcaacuuguugaaaggggauagaguaaacgggcaucuaauucacaaaauugaaucacauuucaacaccucuuggauguccugggaugguugugacuuagacuacuacugcaacaugggggauuggccaucuugcacauacacaggagugacccagcauaaccaugcugcauuuguaaacuugcuuaacauugaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcauaccaagaaaguugaaauaucaggcuugaaauuugcaagucuggcuugcacggguugcuaugcuuguagcucuggcaucuccuguaaaguuagaauucauguagaugaaccagaugagcucacaguacauguaaagagcagugauccagaugugguugcagcuagcacaagucucauggcgaggaagcuugaauuugggacagacagcacauucaaggccuuuucagcuaugcccaaaaccucuuuauguuuuuacauuguggagagagaauacugcaagagcugcagugaagaugauacacaaaaauguguugacacaagacuugagcagccacagagcauacuaauugagcacaaaggaacgauaauuggaaagcagaaugauacuugcacagccaaggcaagcuguugguuagagucagucaagaguuuuuuuuauggauugaagaauaugcuuggcaguguuuuugguaaucuuuucauaggcauuuuguuauuccuugccccuuuuguccuguuggugcuuuucuuuauguuuggguggaaaaucuuguuuugcuuuaaauguugcaggaggaccagaggcuuauuuaaguauagacaccucaaagacgaugaggaaacaggcuacagaaggauuauugaaagacugaacagcaaaaaagggaaaaacaggcugcuugauggugauagacuggcugauaggaaaauugcugagcuguucuccacaaaaacacacauuggcuaa

SEQ ID NO: 3654 - RNA, 5052 nt, Artificial Sequence
  derived and/or modified CDS sequence (wt) from CCHFV(5170-R-2011)__KR814873.1__GP
augcauacacuauuagugugcuucauucuuuaccuacagcugucggguuuaggaggggcucauggacagucaaacgaaacugaacacaauggaacaaacaccaccacaguacccggcacaagucaaagccccaagccacccgcgagcaccacucuacaacacacaccagaauccuccaccgucaaacucaccacaccaacaagcgaaacagaaggcucaggggaaacgaccccacccccaaacaccacccagggccugcccccaccagggaccacaccagaacgcuccgcaacaaccgccacaagcacgucaagcacagacaacaugaauuccaccacacaggugaccgacaacacccccacaucaacagucagcauaaguccauccagcagccccagcaugccauccacaucacaaggcauacauuaucccauaaggagucuauugucagucucgagcccuaagacaguaacaacaccgacaccaauaagcccuggagagaugagcccggaaaccagcagucagcacucagccaugagcagaauaccaacccucuacacagcaacccaggucuccacugagaacaccaaccgcagcacaccuagacaaucugagucuucaguacagccggcaacccaaagcccaauaacuuccccagcgcaaacaauccuucugaugagugcugcuccuaaagcuauucaggacaugcaucccagcccaacaaacagguccaagaggaaccuugagguggaaauaauuuuaacucugucucaaggucuaaagaaauauuacgguaaaauacugaagcuucugcaccuuaccuuggaagaggauacugaaggccuguuagaaugguguaagagaaaccuugggucaaauugugaugaugacuucuuucaaaagagaauagaggaauucuucauaacuggugagggcuacuucaaugaaguccuacaauuuaaaacacuaagcacacuaagccccacggagcugucucaugucaggcuaccaacagcggagcccuucaaaucuuacuucgcuaagggcuuccuuucaauagauucggguuacuucucugccaaauguuauccaagaucauccacuucagggcuucagcugaucaaugucacccaacacccagcuaggauagcagaaacaccuggacccaaaacaacgagucugaaaaccaucaacuguaucaaccuaagagcaucagucuucaaagaacacagagaaguugagaucaaugugcuucuuccucagauugcagucaaccucucaaacugccauguugugaucaacucacaugucugugauuacucuuuagacacugacgggccagugaggcuuccucgcauucaccaugaagguacuuucauaccaggaacuuauaaaauagugauagacaaaaaaaauaagcuaaaugaccgaugcucgcuagucacuaacugugugauaaagggaagagagguucguaagggccaaucagugcugaggcaguacaaaacagaaauuaagauaggcaaggcaucaacaggcucuaggaaacuacuguccgaagagccaggugacgacugcauaucaagaacucagcuauugaagacagaaacagcagaaauccaugacgacaacuauggugguccaggugacaaaauaacuaucugcaaugguucaaccauuguagaucagagacugggcagugaacuaggguguuauaccaucaacagggugaagucauucaagcuaugcgaaaacagugccacagggaaaaccugugagauagacagcacuccggucaagugcaggcaagguuuuuguuugaaaaucacccaagagggaaggggccacguaaaauuauccaggggcucagagguuguuuuggauguuugcgacucgagcugugaaauaaugauaccuaaaggcacuggagauauccuaguagacuguucagguggacagcaacauuucuuaaaagacaacuugauugaccuagggugcccucauaucccgcuauuggguaaaauggccauuuacauuugcagaaugucaaaucaucccaggacaaccauggcuuuccucuucugguucaguuuuggcuauguaaucaccuguauauuuugcaaggcucuuuuuuauucauugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaagggcuagcuaggcaugugacacaaugcccuaagcgaaaggagaaaguugaggagacugaacuguauuugaaccuggaaagaauuccuuggauagucagaaagcuauugcaagugucagaguccacugguguggcauugaaacgaagcaguuggcugauugugcugcuuguguuacucacagucucauugucaccgguccaaucagcaccuguuggucaugguaagacaaucgaaacauaucagaccagagaaggauucacaaguaucugucucuuuauguuaggaagcauccuauucauaguuucuugccugguaaaggggcugguugacagugucagugacagcuucuuccccggccugucugucuguaagacaugcucuauuggcaguauaaauggcuuugaaauugaaucgcauaaaugcuacuguaguuuauuuugcugccccuacuguaggcacugcucugcugacagagaaauucaccaguugcacuugaguaucugcaaaaaaagaaaaacagggagcaaugucaugcuggcugucugcaagcgcaugugcuuuaaggcaaccauagaagcaagcagaagagcccugcucauccgaagcauuaucaauaccacuuuuguaauaugcauucuaacauuagcaaucuguguuguuagcaccucugcaguagagauggaagaccuuccagcaggcacuugggagagagaggaagaccuaacaaauuucugccaucaggaaugccaggugaccgagacggaaugccucuguccauacgaagcucuugugcucaggaaaccucuuuucuuagacaguauaguuaaagguaugaaaaauuugcuaaacucaacaagcuuagaaacaagcuuaucaauugaggcaccauggggagcaauaaauguccagucaaccuuuaaaccaacaguaucuacugcaaacauagcacucaguuggagcucaguagagcacagaggcaacaagaucuuggucacaggcaggucugaaucaauuaugaaacuagaggaaaggacaggagucagcugggaucuaggcguggaagaugccucugaauccaaauuacuuaccgucucuaucauggacuugucacaaauguauuccccuguuuuugaguacuuaucaggagauagacagguugaagaauggcccaaggcaaccugcacaggugauugcccagaaagguguggcugcacaucaucaaccugcuugcauaaagaauggccucauucaagaaacuggagauguaaucccacuuggugcuggggaguaggaaccggcugcacaugcugcggaguggauguaaaagaccuuuuuacagaccacauguuuaucaaauggaagguugaauauauaaaaaccgaagccauaguauguguugagcucaccagccaagaaagacagugcagucugauugaggcagguacuagauucaacuuggguccugugacuaucacccugucugagccaagaaacauucagcagaagcuucccccugagaucauuacgcugcaucccaaaauugaagaaggcuucuuugacuugaugcaugugcaaaaaguguuaucugcaaguacaguguguaaacugcagaguugcacacaugguauaccaggagaucuacaaauuuaccacaucgguaacuuguugaaaggggauagaguaaacgggcaucugauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaagaaaguugagauaucaggcuugaaauuugcaagucugacuuguacggguugcuaugccuguagcucuggcaucucuuguaaagucagaauucauguagaugaaccagaugagcucacagugcauguaaagagcagugauccagaugugguugcagcuagcacaagccuuauggcaaggaagcuugaauuugggacagauagcacauucaaggcauuuucagccaugcccaaaaccucuuuaugcuuuuacauuguagagagggaauacugcaagagcugcagugaagaugauacaaaaaaauguguugacacaaaacuugagcagccacagagcauacuaauugagcacaaggggacgauaauuggaaagcagaaugauacuugcacagccaaggcaaguuguuggcuagagucagucaagaguuuuuuuuauggacugaagaauaugcuuggcaguguuuuugguaguuuuuucguaggcauuuuguuauuccuugccccuuuugucuuguuggugcuuuucuuuauguuuggauggaaaaucuuguuuugcuuuaaguguugcaggaggaccagaggcuuguuuaaguauagacaccucaaagaugacgaggaaacaggcuacagaaggauuauugaaagacugaacagcaaaaaagggaaaaacagacugcuugauggugagagguuggcugauaggaaaauugcugagcuguucucuacaaaaacacacauuggcuaa

SEQ ID NO: 3655 - RNA, 5055 nt, Artificial Sequence
  derived and/or modified CDS sequence (wt) from CCHFV(SCT ex Afghanistan)__KC344856.1__GP
auguauacacugcuagugugugcuauucuuuguccacagccguggaguuuggaagggacccauguuccgcuuaacgggacuaaacacaacggaacuggcaucacagcagcaccuggagggagucaaggccccacgucgccugcaagcacagcaguaucccucacaccggaccccuucaccaccgaacccacagcaucagcugucgaacuggaaagcucgggagaagggcacaccucccucucagucacuacacaaggucugaccucgccggaaaccacgccagggcucccaacaguaaccgacacaggagugucuagcacaagcaucuucggcaucggcauacggguggcuggggacacucccacaucgacaacccacacaggucugcccagcagucccagcaugccauccacagcacagggcccacaucaugcaguaagggguuuacugucgguuuccagcaccaggccaggagaggcaucaacaauaacagucccaggagaagcaggcacagaggccaacagcucaagcucagccauuagcaaaaaaccagccccuucaccaacagcugaagccaucacugaagccaacaacuccagcaaccccagacaaccagagcucucaacacaaccagcaaucccaggccuagugaccucuucagcgcagccaauccuccuacagagugcuacuuccacagcugcucaagacauauaccccagcccaacaaacagaucuaaaagaaaccuugagauggaaauaauuuugacuuuaucucaaggucuaaagaaguacuacgguaaaauacuaagaauuuuggaucucaccuuagaagaagacacugaaggccugcuagagugguguaagagaaaucuuggucugaccuguaaugauaauuucuuccaagagagaauagaagaguuuuuucugaccggugaaggccacuuuaaugaaguuuugcaguuuaaaacaccaagcacacuaagccccacagaaccaacucacaccagaacaccaacaguuaaacccuuuaaaucuuauuuugccagaggcuuccuuucaauagacucaggcuacuucucugccaagugcuauucaaagaccucuaauucaggacuucaguugaucaauaucacccagcauccagcuagaauagcggacacaccuggaccuaagaucacuaaucuaaaggcuaucaauuguauaaacuuaaaggcaucagucuucaaggagcauagggagauugagaucaaugugcuucucccacaagucgcggucaaccucucaaacugccaugucuugauuaaaucacaugucugugauuacucuuuagacauugauggggcaguaagacuaccucauguccaccacaaaggaacauucauaccaggaacuuauaaaauaguaauagauaaaagaaacaagcaaaaugacaggugcaccuuggucacuaauugugugauuaaaggaaaggagauucguaaaggccagucagcacuaaggcaauacagaacagaaaucagaauaggcaaggcaucugccgggucuagaagauugcugucugaagagucuggugacgacuguauaucgaggacucagcuauugaggacagagacugcagagguccauaaugauaacuauggugguccaggugacaaaauuaccaucugcaacgguucaaccauuguagaucagagacuuggcagugaacugggguguuauacuaucaacagagugaagucauucaagcuaugcgaaaauagcgccacgggaaaguccuguaaaauagacagcaccccgguuaagugcaggcaagguuuuugcuuaaaaaucacucaggaaggaaggggccaugugaagcuaucgagaggcucagaaguugucuuagaugccugcgauucaagcugugaaauaaugauaccgaagggcacuggagacauccuaguggacuguucaggugggcagcaacauuucuuaaaagauaauuugauugaucuaggaugcccuaacauuccacuauuagguaaaauggcuaucuauauuuguagaaugucaaaucaucccaaaacaacuauggcuuuucucuuuugguucaguuuugguuauguaauaacauguauauuuugcaaagucauuuuuuauuuauugauaguuguggggacauugggaaaaaaguucaaacaguaucgagagcugaaaccucagacuuguacaauaugugaaacaacuccuaccaaugcaauagaugcugaaaugcacgaucuuaacugcaguuacaauauauguccuuauugugcaucuagauuaaccucggacgggcuugccaggcaugugacacaaugcccuaagcgaaaggaaaaaguagaagagacugaguuguacuugaacuuggaaagaauuccuuggauugucagaaaacuacugcaggugucagagucuacagguguggcacugaagaggagcaguuggcuaauuguguuacuugugcuacuuacaguuucauugucaccgguucaaucggcacccaucgggcauggaaagacaauugagacauaucagaccagagagggguauauaaguguuugccuguuugugcuagggggcauacuguuuguagucuccugccugaucaaaggacugguugacagugucggcaacaguuuuuuuccuggguuaucuauuugcaagacauguucuaucggcaguguaaauggcuuugaaauugaaucccauaaauguuacuguagcuuacuuuguugcccuuauuguagacacugcucuacugauagggagauccaccaauugcacuugagcaucugcaaaaaaagaaggacagggggcaaugucauguuggcugucugcaagcgcaugugcuucagagcaacuauggaaguaagcaacaagguccuauuuauccgaaacaucaucaauaccaccuuuguuauaugcauacugauauuagcagucugugucguuagcaccucugcaguagagauggaaagccuacccgccggcacuugggaaagggaagaagaccuaacaaacuucugccaccaagaaugccaagucacagagacugaaugucucuguccuuacgaagcucuuguacucaggaaaccccuuuucuuaaacaguauagucaagggcaugaaaaaccugcuaaauucaacuaacuuggaaacaagcuuaucaaucgaagcaccauggggagcaauaaauguccagucaaccuuuaaacccacuguaucaacugcaaacauagcacucagcuggaguucaguggaacacagagguaauaaaauucuagucucaggcagaucagagucaauuaugaagcuagaagaaaggacaggaaucagcugggauuugggcguagaagaugccucugagucuaaaucgcuuacuguuucugucauggauuuaucacagauguauucuccugucuucgaguaucugucaggugacagacagguagaggaguggccuaaagcaaccugcacaggcgauugcccggagagauguggcugcacaucaucaaccugcuuacacaaggaauggccccauucaaggaauuggagaugcaaccccacuugguguuggggagucggcacuggaugcaccugcugugggcuagaugugaaagaccuuuucacagauuauauguuugucaaguggaagguugaauacauaaagacagaggccauaguguguguugagcucacuagccaagaaaggcagugcagcuugauugaggcaggaacaagguucaacuuagguccugugaccaucacguugucagagccaagaaacauucagcagaagcuuccuccugaaauaaucacauugcauccuagaauugaggaaggcuuuuucgaucuaaugcauguacaaaaggugcugucugcaaguacagugugcaagcugcaaagcugcacacaugguguuccaggagacuugcaggucuaccacauuggcaacuuguuaaaaggggauaaguuaaacgggcauaugauucacaaaauugagccacacuucaauaccucuuggauguccugggauggcugugaccuagacuauuacuguaauaugggggauuggcccucuugcacauacacuggggugacccaacauaaccaugcugcuuuuguuaacuuacuuaacaucgaaacugauuacacaaagaacuuccacuuucacucuaaaagaguuacugcacauggagacacaccacaauuggacuugaaagcuagaccaacuuacggugcgggugaaaucacuguacuaguggaaguugcugacauggaguuacacacaaaaaagauugauauaucagguuugaaauuugcaagucuaacuugcgcggguugcuaugcuuguagcucuggcaucuccuguaaagucaggauucauguagaugaaccugaugagcuuacaguacaugugaaaagugaagauccggacauuguugcagcuagcacaagccucauugcaaggaagcucgaacuugggacagacagcacauucaaggccuucucagccaugcccaaaaccuccuugugcuucuacauuguggagagagaauacuguaagagcugcagcaaagaggacacacagaaauguguuaacacaaagcuugagcacccacaaggcauuuuaauugagcacaaaggaacaauaaucggaaagcaaaaugacaccugcacagccaaagcaggcugcugguuggagucagucaagaguuuuuuuuauggauugaagaacaugcuuaguggcaucuucggcaacguuuuuauagguauuuucuuauuccuugcuccuuuuguucuauugauacucuucuuuauguuuggguggagacuccuguuuugcuuuaaguguuguagaagaaccagagguuuauucaaguacagacaucucaaggaagaugaagaaucugguuauagaagaaucauugaaagauuaaacaacaaaaaaggaaagaacaagcugcuugauggugaaagacuagcugauagaaggaucgcugagcuguucuccacaaaaacacauauugguuaa

SEQ ID NO: 3656 - RNA, 5055 nt, Artificial Sequence
  derived and/or modified CDS sequence (wt) from CCHFV(SPU 44/08)__KJ682805.1__GP
auguacacaccacuauugugugcuauucuuuguuugcagcuguggagcuuagaaggaauuuauggauuguccaacaauacccaacacaaugacacuaguaccauaaaagugcccgaggagagucaaaaaaccagucugcccgcgaacacagcaucacccaucacgucagacccccccccgaccacacccacagcaucagccaguggaccagaaggcucaggggacacgagcaccucucccccagucaccacacaaggcccgaccccaccagaaaccacgccagagccccacacaacaauugacaucgauaaaucaagcacagccaucgcugacaucagcacacagacagucaagaacauccccacaccaacagcccacaccaguuugcccagcacucucagcgcgccaaccaugccgcaagaagcacaucacacugcaaggggccuacugucagucaccagcacaaaaccaggagaagcaucaacaccaacaagcccaggggaagcaagcacagaggccagcagcccacaaccaaccaucagagagacaccaucccccccuccaacaacccaaacucccaccgaaaucaacaaccccaacacauccagacagcccaugcccucaacacaaccagcagcucccagcucagugacccauccagcacagccaacccccucucagagcgacguccccacggcugcucaagauauacaccccagcccaacaaacagaucuaaaagaaaucuugaaauggaaauaauuuugacuuuaucucaagguuugaagaaguacuacggcaagguacuaaaacuucuggaucuuacuuuagaagaagacacugaaggccuguuagagugguguaagagaaaccuuggucugaccugcgaugacaacuucuuucagaagagaauagaagaguuuuuuuuaacuggugaaggucacuucaaugaaguguugcaguucaaaacaccaagcacacuaagcccuacggaaccugcucguguugagucaccgacaguagaacccuuuaaaucuuacuuugcuaaaggcuuccucuuaauggacucagguuacuucuccgccaaguguuacccaaagucauccaauucaggacuucagcugauuaacgucacccaacauuuaauuagaauaacagacacaccugggccuaagaucacuaaucugaaaaccaucaauugcauaaacuugaaggcauuagucuucaaagagcauagggagauugaaaucaauguucuccucccucaagucgcggucaaccucucaaacugccaugugcugaucaaaucucauguuugugacuacucuauagacaucgacgggccgguaagacugccccguauccaccaugaaggaacuuuuauaccaggaacuuacaaaauaguuauagauaaaaaaaacaagcagaacgacagaugcacuuuggucacuaacugugugauaaaaggaagggaaauucgcaaaggccagucaguguuaaggcaauacagaacagaaaucaagauuggcaaggcaucuucugguucuagaagacuauugucugaagagucuaaugaugacuguuuaucaaggacucagcuauugaggacagagaaugcggaaauucacagugacaacuauggugguccaggugacaagauaacuaucugcaacgguucaacuauuguagaucagagauugggcagugaacuaggguguuacacuaucaauagagugaaaucauuuaagcucugcgaaaacagugcuacagguaaaucuugugaaauagauagcaccccagucagauguaggcaggguuuuugcuugaaaauuacucaggagggaaggggccacgugaagcuaucaagaggcucagaaguugucuuggacgccugugacucaagcugugaaauaaugauaccaaagggcacuggggacauccuaguugacugcucaggugggcagcaacauuuccuaaaagauaaccugguugauuuaggaugccccaacaucccacuguuaggcaaaauggccaucuacauuuguagaaugucaaaucaucccaagacaacuauggcuuuccuuuuuugguuuagcuuugguuaugugauaaccuguauacuuuguaaagcaaucuucuaucuauuaauaguuguagggacauuaggaaaaaaguucaaacaguacagagaguuaaaaccucagaccuguaccauaugugaaacaaauccuguuaaugcaauagaugcugagaugcacgaccucaacugcaguuacaauauauguccuuauugugcaucuagguuaaccucagauggucuugccagacauguaaugcaaugccccaaacggaaggaaaaaauagaagaaaccgaauuauauuuaaacuuagaaagaaucccuuggguuguuaggaaauuacugcaggugucagaauccaccgguguagcacuaaagaggaguaguuggcugguuauacuacuugugcugcucacaguuucauugucaccaguacaaucagcacccaucagccauggagagacagucgaaguauaucaaaccagagaaggguacacaaguauuugccuuuuuguacuaggaagcauccuguuuuugguauccugccugaugaggggguugguugacagugucagcaauagcuuuuucccuggcuuguccauuuguaagacauguucuauuggcaguauaaacggcuuugaaauugaaucucacaaauguuacuguagccuauuuugcugccccuacuguagacacugcucugccgacauagaaauacauaaguugcacuugagcaucugcaagaaaaggaaaacugggaguaaugucauguuagccgucuguaagcgcaugugcuuuagggcaacuguggaaguuagcaauaaagcuuuacuuauccgaaacaucaucaacaccacuuuuguugugugcauacugauauuagcaguuuguguugucagcaccucugcaguggagauggaaaaucugccagcaggcacuugggaaaaagaggaagaccugacaaauuucugucaucaggaaugccaagucacugagacugaaugccucuguccuuaugaagcucuugugcucaggaaacccuuguuuuuggacaguauuguuaaaggcaugaagaacuugcuaaauucaacaagccuagaaacaagcuuaucaauugaggcaccauggggggcaauaaauguccaaucaacuuucaaaccaacugugucagcugcaaacauagcgcuuaguuggagcucaguagaacauagaggcaauaaaauuuugguuucaggcagaucagagucaaucaugaaauuagaggaaaggacaggaauuagcugggaucuggguguggaagacgccucugaguccaaauugcucacugucucuguaauggacuugucacaaauguauucuccugucuuugaguaccuaucaggugauagacaaguggaagaauggcccaaggcaaccugcacaggagauugcccagaaagaugcggcugcacgucaucaaccugccuacacaaggaauggccccauucaagaaacuggagaugcaacccuacuugguguuggggagucggcacuggaugcaccuguugugggcuggaugugaaagaccucuuuacagauuacauguuugucaaguggaaaguugacuacauuaaaacagaagcuauaguguguguugagcuuacuagccaggaaagacaauguagcuuaauugaggcaggcacaagauucaacuuggguccugugaccaucacauugucagagccaagaaacauucagcagaagcucccuccagaaauaguuacauugcauccuaggauugaagaaggcuucuuugacuuaaugcauauacaaaaagugcuaucagcaaguacaguauguaagcuacagaguugcacacauggcgugccaggagaccuacagaucuaccacauuggaaacuuguuaaaaggagacaaggugaacgggcaccugauucacaaaauugaaccacacuucaacaccuccuggaugucuugggacggcugugaccuagacuacuacuguaauaugggggauuggccgucuugcucauauacuggcguaacccaacacaaucaugcugcauuuguaaacaugcucaacaucgaaacugauuauacaaaaaacuuccacuuucacucuaagagaguuacagcacauggggacacaccacaauuagauuuaaaagcuagaccaacuuauggugcaggugaaaucacugugcugguagagguugcugacauggaguugcauacaaagaaaauugagauaucagguuugaaguuugcaagcuuaacuugcacaggcuguuaugcuuguaguucuggcaucuccuguaagguuaggauccauguagaugaaccagaugagcuuacaguacaugugaagagcgaggauccagacauaguugcugcuaguucaagucucauggcuaggaagcuugaauuugggacagauagcacauuuaaagccuuuucagccaugcccaaaaccuccuugugcuuuuacauuguggagagggaauacugcaaaagcuguaguaaagaagacacacaaaaaugugucaacacaaagcuugaacaaccacaaagcauuuuaaucgagcacaaagggacgauaaucggaaagcagaacgacacuuguacagccaaagcaaguugcugguuagagucaauuaagaguuuuuuuuauggacuaaagaauaugcuuaguggcauuuuuggcaauguuuucauagggauuuucuuauuccucgcuccuuuuaucaugcuaauacuuuucuucauguuuggauggaggauccuguucugcuucaaguguugcagaagaacuagaggcuuauuuaaguauagacaccucaaagacgaugaagaaaucgguuacaggaaaaucauugagaggcuaaacaacaaaaaagggaaaaacaaacuacuugacggugaaagacuagcugauaggaagaucgcugagcuguucucuacaaaaacacacauuggcuaa

SEQ ID NO: 3657 - RNA, 5052 nt, Artificial Sequence
  derived and/or modified CDS sequence (wt) from CCHFV(K323_27)__KX013472.1__GP
augcauacacuauuagugugcuucauucuuuaccuacagcugucagguuuaggaggagcucauggacagucaaaugcaacugaacacaauggaacaaacaccaccacaguacccggcacaagucaaagccccaagccacccgcgagcaccacucuaccacacacaccagaauccuccaccgucaagcucaccacaccaacaagcgaaacagaaggcucaggggaaacgaccccacccccaaacaccacccagggccugccccuaccagggaccacaccagaacgcuccgcaacaaccgccacaagcacgucaagcacagacaacaugaauuccaccacacaggugaccgacaacacccccacaucaacagucagcauaaguccauccagcagccccagcaugccauccacaucacaaggcauacaucaucccguaaggagucuauugucagucucgagcccuaagacaguaacaacaccgacaccaaugagcccuggagagaugagcccggaaaccagcagucagcacucagccaugagcagaauaccaacccucuacacagcaacccaggucuccacugagaacaccgaccgcagcacaccuagacaaucugaguccucaguacagccggcaacccaaagcccaauaacuuccccagcgcaaacaauccuucugaugagugcugcucccaaagcuauucaggacaugcaucccagcccaacaaacagguccaagaggaaccuugagguggaaauaauuuuaacucugucucaaggucuaaagaaauauuacgguaaaauacugaagcuucugcaccuuaccuuggaagaggauacugaaggccuguuagaaugguguaagagaaaccuugggucaaauugugaugaugacuucuuucaaaagagaauagaagaauucuucauaacuggugagggcuacuucaaugaaguccuacaauuuaaaacacuaagcacacuaagccccacggagucgucucaugucaggcuaccaacagcggagcccuucaaaucuuacuucgcuaagggcuuccuuucaauagauucggguuacuucucugccaaauguuauccaagaucauccacuucagggcuucagcugaucaaugucacccaacacccagcuaggauagcagaaacaccuggacccaaaacaacgagucugaaaaccaucaacuguaucaaccuaagagcaucagucuucaaagaacacagagaaguugagaucaaugugcuucuuccucagauugcagucaaccucucaaacugccauguugugaucagcucacaugucugugauuacucuuuagacacugacggaccagugaggcucccucgcauucaccaugaagguacuuucauaccaggaacuuauaaaauagugauagacagaaaagauaagcuaaaugaccgaugcucgcuagucacuaacugugugauaaagggaagagagguucguaagggccaaucagugcugaggcaguacaaaacagaaauuaagauaggcaaggcaucaacaggcucuaggaagcuacuguccgaagagccaggugacgacugcauaucaagaacucagcuauugaagacagaaacagcagagauccaugacgacaacuauggugguccaggugacaaaauaacuaucugcaaugguucaaccauuguagaucagagacugggcagugaacuaggguguuauaccaucaacagggugaagucauucaagcuaugcgaaaacagugccacagggaaaaccugugagauagacagcacuccggucaagugcaggcaagguuuuuguuugaaaaucacccaagagggaaggggccacguaaaauuauccaggggcucagagguuguuuuggaugcuugcgacucgagcugugaaauaaugauaccuaaaggcacuggagauauccuaguagacuguucagguggacagcaacauuucuuaaaagacaacuugauugaccuagggugcccucauaucccgcuauuggguaaaauggccauuuacauuugcagaaugucaaaucaucccaggacaaccauggcuuuccucuucugguucaguuuuggcuauguaaucaccuguauauuuugcaaagcucuuuuuuauuuauugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuagcuaggcaugugacacaaugcccuaagcgaaaggagaaaguugaggagacugaacuguauuugaaccuggaaagaauuccuuggauagucagaaagcuauugcaagugucagaguccacugguguggcauugaaacgaagcaguuggcugacugugcugcuuguguuacucacagucucauugucaccgguccaaucagcaccuguuggccaugguaauacaaucgaaacauaucagaccagagagggauucacaaguaucugucucuuuauguuaggaagcauccuauucauaguuucuugccugguaaaggggcugguugacagugucagugacagcuucuuccccggccugucugucuguaagacaugcucuauuggcaguauaaauggcuuugaaauugaaucgcauaaaugcuacuguaguuuauuuugcugcccccacuguaggcaccgcucugcugacagagaaauucaccaguugcacuugaguaucugcaaaaaaagaaaaacggggagcaaugucaugcuggcugucugcaagcgcaugugccccaaggcaaccauagaagcaagcagaagagcccugcccauccgaagcaucaucaacaccacucuuguaaugugcauucuaacauuagcaaucuguguuguuagcaccucugcaguagagauggaagaccuuccagcaggcaccugggagagagaggaagaccuaacaaauuucugccaucaggaaugccaggugaccgagacggaaugccucuguccauacgaagcucuugugcucaggaaaccucuuuucuuagacaguauagccaaagguaugaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggauuugucacaaauguauuccccuguuuuugaguacuuaucaggagauagacagguugaagaauggcccaaggcaaccugcacaggugauugcccagaaagguguggcugcacaucaucaaccugcuugcauaaagaauggccucauucaagaaacuggagauguaaucccacuuggugcuggggaguaggaaccggcugcacaugcugcggaguggauguaaaagaccuuuuuacagaccacauguuuaucaaauggaagguugaauacauaaaaaccgaagccauaguauguguugagcucaccggccaagaaagacagugcagucugauugaggcagguacuagauucaacuuggguccugugacuaucacccugucugagccaagaaacauucagcagaagcuucccccugagaucauuacgcugcaucccaaaauugaagaaggcuucuuugacuugaugcaugugcaaaaaguguuaucugcaaguacaguguguaaacugcagaguugcacacaugguauaccaggagaucuacaaauuuaccacauuggcaacuuguugaaaggggauagaguaaacgggcaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaagaaaguugagauaucaggcuugaaauuugcaagucugacuuguacggguugcuaugcuuguagcucuggcaucuccuguaaagucagaauucauguagaugaaccagaugagcucacagugcauguaaagagcagugauccagauguuguugcagcuagcacaagccuuauggcaaggaagcuugaauuugggacagauagcacauucaaggcauuuucagcuaugcccaaaaccucuuuaugcuuuuacauuguggagagggaauacugcaagagcugcagugaagaugauacaaaaaaauguguugacacaaaacuugagcagccacagagcauacuaauugagcacaaagggacgauaauuggaaagcagaaugauacuugcacagccaaggcaaguuguuggcuggagucagucaagaguuuuuuuuauggauugaagaauaugcuuggcaguguuuuugguaguuuuuucguaggcauuuuguuauuccuugccccuuuugucuuguuggugcuuuucuuuauguuuggauggaaaaucuuguuuugcuuuaaguguugcaggaggaccagaggcuuguuuaaguauagacaccucaaugaugacgaggaaacaggcuacagaaggaucauugaaagacugaacagcaaaaaaggaaaaaacagacugcuugauggugagagguuggcugauaggaaaauugcugagcuguucucuacaaaaacacacauuggcuaa

SEQ ID NO: 3658 - RNA, 5052 nt, Artificial Sequence
  derived and/or modified CDS sequence (wt) from CCHFV(1231-CR/TI-2015)__KU161585.1__GP
augcauacacuauuagugugcuucauucuuuaccuacagcuguugggucuaggaggggcucaugaacagucaaacgcaacugaucacaauagaacaaacaccaucacagcacccagcacaagucaaaaccccaagccacccgcgagcacaaccccaccacacacaccggaaucauccaccaucaagcucaucacaucaacaggcgaagcagaaggcucaggggaaacgaccccaccccuaaacaccacccagggcccguucccaccagagaccacaucagaacacccugcaucaaccgccacaaacacgucaagcacaaacagcaugaauuccaccacacagaugacugauaaaacccucacaucaacagucagcacaagucuauccaucagccccagcacgccauccacaucacaaggcauacauuauccgauaaggagucuauugucagucucgagcccuaggacagcagcaacaccaacaccaaugagcacuagagagaugagcucggaaacaaacagucagcacucagccgugagcagaacaccaaccuuccacacagcaacccaggucuccacugagaacgacaaccgcagcaccccuagacagucugaauccucagcacagccggcaacccaaagcccaaugacuuccccagcgcaaucaauccuucuggugagugcugcuccuacaaccauucagaacauacaucccagcccaacaaacagguccaagaggaaccuugagauggaaauaauuuugacucugccucaaggucuaaagaaauacuacgguaaaauacugaagcuucugcaccuuacccuagaagaggacacugaaggccuguuagaaugguguaagagaaaccuugggucgaacugugaugaugaauucuuccaaaagagaauagaagaauucuucauaacuggugagggcuacuucaaugaaguccuacaauuuaaaacacuaagcacacuaagccccauggagccgucucaugccaggccaccaacagcggaacccuucaaaucuuacuucgcuaagggcuuccuuucaauagauucagguuacuucucugccaaauguuauccaagaucauccucuucagggcuucagcugauuaauauuacccaacauccagcuaggauagcagaaacaccuggucccaaaacaacgagucugaaaaccaucaacuguaucaaucuaagagcaucuguuuucaaagaacacagagaaguugagaucaaugugcuucuuccucagauugcagucaaccuuucaaacugccauguugugaucaauucacaugucugugauuacucuuuagacacugaugggccugugaggcuuccucgcauuuaccaugaaggaacuuucauaccagggacuuauaaaauagugauagacaaaaaaaacaagcuaaaugaccgaugcacgcuagucacuaacugugugacaaagggaagagaaguucguaagggccaaucagugcugaggcaauacaaaacagaaauuaagauaggcaaggcaucaacaggcucuaggaaacuacuguccgaagagccaggugaugacugcauaucaagaacucagcuauugaggacagaaacagcagagauccaugacgacaacuacggcgguccaggugacaaaauaacuaucugcaaugguucaaccaucguagaucagagacugggcagugaacuaggguguuauaccaucaacagggugaagucauucaagcuaugcgaaaacagcgcuacagggaaaaccugugagauagacagcacuccggucaagugcaggcaagguuucuguuuaaaaaucacccaagagggaaggggccacguaaaauuaucuagaggcucagagguugucuuggaugcuugcgacucaagcugugaaguaaugauaccuaaaggcaccggagauauccuaguagacuguucagguggacagcagcauuuuuuaaaagacaacuugauugaucuagggugcccccacaucccgcuauuggguaagauggccauuuacauuugcagaaugucaaaucauccuagaacaaccauggcuuuucucuucugguucagcuuuggcuaugugaucaccuguauauuuugcaaggcucuuuuuuauucauuaauaauuauugggacacuagggaaaaagaucaagcaauauagagaacugaaaccucaaacuuguacuauaugugagacagcuccugucaaugcaauagaugcugaaaugcaugaccucaacuguaguuacaauauaugccccuauugugcaucaagacugaccucugaugggcuagcuaggcauguaacgcaaugcccuaagagaaaggagaaaguugaggagacugaacuguacuugaaccuagaaagaauuccuuggaucgucagaaagcuauugcaagugucagaguccacugguguggccuugaaacgaagcaguugguugauugugcugcuuguguuacucacaguuucauugucaccgguucaaucagcaccuguuggucaugguaagacaaucgaaacauaucagaccagagaaggauucacaaguaucugucucuuuauguuaggaagcauccuauucauagucucuugcuuggugaaggggcugguugaaagugucagugauagcuucuuccccggccugucugucuguaggacaugcucuauuggcagcauaaauggcuuugaaauugagucgcauaagugcuacuguagcuuauuuugcugccccuacuguaggcacuguucugcugacagagaaauucaccaguuacacuugaguaucugcaaaaaaagaaaaacggggagcaaugucaugcuggcugucugcaaacgcauguguuuuagggcaaccauggaagcaagcagaagagcccugcuuauccgaagcauuaucaauaccacuuuuguaauaugcauucuaacauuaacaaucuguguugucagcaccucugcaguagagauggaaaaccuuccagcaggcacuugggagagagaggaagaccugacaaauuucugucaucaagaaugccagguaaccgagacggagugccucuguccauaugaagcucuugugcucaggaaaccccuuuuccuagacaguauaguuaaagguaugaaaaauuugcuaaacucgacaagcuuagaaacgagcuuaucaauugaggcaccauggggagcaauaaauguccagucaaccuuuaaaccaacaguaucaacugcaaacauagcacucaguuggagcucaguggagcacagaggcaacaagaucuuagucacaggcaggucugaaucaauuaugaaacuagaggaaaggacaggagucagcugggaucuagguguagaagaugccucugaauccaaauuacuuaccgucucuauaauggauuuaucacaaauguauuccccuguuuuugaguacuugucaggagacagacagguugaagaguggcccaaagcaacuuguacaggugauugcccagaaagguguggcugcacaucaucaaccugcuugcauaaagaauggccucacucaagaaacuggagauguaaucccacuuggugcuggggaguaggaaccggcugcaccuguugcgggguggauguaaaagaccuuuuuacagaucacauguuugucaaauggaagguugaauauauaaaaacugaagccauaguauguguugagcucaccagccaggaaagacagugcagucuuauugaggcagguacaagauucaacuuaggcccugugacuaucacccugucugagccaagaaacauucagcagaagcuucccccugagaucauuacguugcaucccaaaauugaagaaggcuucuuugacuugaugcauguacaaaaaguguugucugcaaguacaguguguaaacugcagaguugcacacaugguauaccaggagaccuacaaguuuaccacauuggcaacuuguugaaaggggauagaguaaacgggcaucuaauucacaaaauugaaccacauuuuaacaccucuuggauguccugggaugguugugaucuagacuacuacugcaacaugggggacuggccuucuugcacauacacaggagugacccagcauaaucaugcugcauuuguaaacuugcuuaacauugaaacugauuacacgaaaaccuuccacuuccacucuaaaagagucacagcacauggugacacaccacaauuagacuuaaaagcaaggccgaccuacggugcaggugagaucacugugcugguugagguugcugacauggaguugcauacaaaaaaaguugagauaucaggcuugaaauuugcaagccuggcaugcacggguugcuaugcuuguagcucuggcaucuccugcaaagucagaauucauguagaugaaccagaugagcucacagugcauguaaagagcagugauccagaugugguugcggcuagcacaagccuuauggcaaggaagcuugaauuugggacagacagcacauucaaggccuuuucagcuaugccuaaaaccucuuuauguuuuuacauuguggagagagaauacugcaagagcugcagugaagaugauacaaaaaaauguguugacacaaaacuugagcagccacagagcauacuaauugagcacaaagggacgauaauuggaaagcagaaugauacuugcacagccaaggcaagcuguugguuagagucagucaagaguuuuuuuuauggauugaagaauaugcucggcaguguuuuuggcaauuuuuuuauaggcauuuuguuauuccuugccccuuuuguccuguuggugcuuuucuuuauguuuggauggaaaaucuuguuuugcuuuaaauguugcaggaggaccagaggcuuguuuaaguauagacaccucaaagacgaugaggaaacaggcuacagaaggauuauugaaagacugaacaacaaaaaggggaaaaacagacugcuugauggugaaagguuggcugauaggaaaauugcugagcuguucuccacaaaaacacacauuggcuaa

SEQ ID NO: 3659 - RNA, 5052 nt, Artificial Sequence
  derived and/or modified CDS sequence (wt) from CCHFV(K229_194)__KX013463.1__GP
augcauacacuauuagugugcuucauucuuuaccuacagcugucggguuuaggaggagcucauggacagucaaacgcaacugaacacaauggaacaaacaccaccacaguacccggcacaagucaaagccccaagccacccgcgagcaccacucuaccacacacaccagaauccuccaccgucaaacucaccacaccaacaagcgaaacagaaggcucaggggaaacgaccccacccccaaacaccacccagggccugcccccaccagggaccacaccagaacgccccgcaacaaccgccacaagcacgucaagcacagacaacaugaauuccaccacacaggugaccgacaacacccccauaucaacagucagcauaaguccauccagcagccccagcaugccauccacaucacaaggcauacauuaucccguaaggagucuauugucagucucgagcccuaagacaguaacaacaccgacaccaaugagcccuggagagaugagcccggaaaccagcagucaacacucagccaugagcagaauaccaacccucuacacagcaacccaggucuccacugagaacaccaaccgcagcacaccuagacaauccgaguccucagcacagccggcaacccaaagcccaacaacuuccccaacgcaaacaauccuucugaugagugcugcuccuaaagcuauucaggacaugcaucccagcccaacaaacagguccaagaggaaccuugagguggaaauaauuuuaacucugucucaaggucuaaagaaguauuacgguaaaauacugaagcuucugcaccuuaccuuggaagaggauacugaaggccuguuagagugguguaagagaaaccuugggucaaauugugaugaugacuucuuucagaagagaauagaagaauucuucauaacuggugagggcuacuucaaugaaguccuacaauuuaaaacacuaaacacacuaagccccacggagccgucucaugucaggcuaccaacagcggagcccuucaaaucuuacuucgcuaagggcuuccuuucaguagauucggguuacuucucugccaaauguuauccaagaucauccacuucagggcuucagcugaucaaugucacccaacacccagcuaggauagcagaaacaccuggacccaaaacaacgagucugaaaaccaucaacuguaucaaccuaagagcaucagucuucaaagaacacagagaaguugagaucaaugugcuucuuccucagauugcagucaaccucucaaacugccauguugugaucaacucacaugucugugauuacucuuuagacacugacgggccagugaggcuuccucgcauucaccaugaagguacuuucauaccaggaacuuauaaaauagugauagacaaaaaaaauaagcuaaaugaccgaugcucgcuagucacuaacugugugauaaagggaagagagguucguaagggccaaucagugcugaggcaguacaaaacagaaauuaagauaggcaaggcaucaacaggcucuaggaaacuacuguccgaagagccaggugacgacugcauaucaagaacucagcuauugaagacagaaacagcagagauccaugacgacaacuauggugguccaggugacaaaauaacuaucugcaaugguucaaccauuguagaucagagacugggcagugaacuaggguguuauaccaucaacagggugaagucauucaagcuaugcgaaaacagugccacagggaaaaccugugagauagacagcacuccggucaagugcaggcaagguuuuuguuugaaaaucacccaagagggaaggggccacguaaaauuauccaggggcucagagguuguuuuggaugcuugcgacucgagcugugaaauaaugauaccuaaaggcacuggagauauccuaguagacuguucagguggacagcaacauuucuuaaaaggcaacuugauugaccuagggugcccucauaucccgcuauuggguaagauggccauuuacauuugcagaaugucaaaucaucccaggacaaccauggcuuuccucuucugguucaguuuuggcuauguaaucaccuguauauuuugcaaggcucuuuuuuauucauugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuagcuaggcaugugacacaaugcccuaagcgaaaggagaaaguugaggagacugaacuguauuugaaccuggaaagaauuccauggauagucagaaagcuguugcaaguaucagaguccacugguguggcauugaaacgaagcagcuggcugauugugcugcuuguguuacucacagucucauugucaccgguucaaucagcaccuguuggucaugguaagacaaucgaaacauaucagaccagagaaggauucacaaauaucugucucuuuauguuaggaagcauccuauucauaguuucuugccuggugaaggggcugguugacagugucagugacagcuucuuccccggccugucugucuguaagacaugcucuauuggcaguauaaauggcuuugaaauugaaucgcauaaaugcuacuguaguuuauuuugcugccccuacuguaggcacugcucugcugacagagaaauucaccaguugcacuuggguaucugcaaaaaaagaaaaacggggagcaaugucaugcuggcugucugcaagcgcaugugcuuuaaggcaaccauagaagcaagcagaagagcccugcucauccgaagcauuaucaauaccacuuuuguaauaugcauccuaacauuagcaaucuguguuguuagcaccucugcaguagagauggaaaaucuuccagcaggcacuugggagagagaggaagaccugacaaguuucugccaucaggaaugccagguaaccgagacggaaugccucuguccauacgaagcucuugugcucaggaaaccucuuuuuuuagacaguauaguuaaagguaagaaaaaucugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggaccugucacaaauguauuccccuguuuuugaguacuuaucaggagauagacagguugaagaauggcccaaggcaaccugcacaggugauugcccagaaagguguggcugcacaucaucaaccugcuugcauaaagaauggccucacucaagaaacuggagauguaaucccacuuggugcuggggaguaggaaccggcugcacaugcugcggaguggauguaaaagaccuuuuuacagaucacauguuuaucaaauggaagguugaauauauaaaaaccgaagccauaguauguguugagcucaccagccaagaaagacagugcagucugauugaggcagguacuagauucaacuuggguccugugacuaucacccugucugagccaagaaacauucagcagaagcuucccccugagaucauuacgcugcauccuaaaauugaagaaggcuucuuugacuugaugcaugugcaaaaaguguuaucugcaaguacaguguguaaacugcagaguugcacacaugguauaccaggagaucuacaaauuuaccacauuggcaaccuguugaaaggggauagauuaaacgggcaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaagaaaguugagauaucaggcuugaaauuugcaagucuggcuugcacggguugcuauucuuguagcucuggcaucuccuguaaagucagaauucauguagaugaaccggaugagcucacagugcauguaaagagcagugauccagaugugguugcagcuagcacaagccuuauggcaaggaagcuugaauuugggacagauagcacauucaaggcauuuucagcuaugcccaaaaccucuuuauguuuuuacauuguggagagggaauacugcaagagcugcagugaagaugauacaaaaaaauguguugacacaaaacuugagcagccacagagcauacuaauugagcacaaagggacgauaauuggaaagcaaaaugacacuugcacagccaaggcaaguuguuggcuagagucagucaagaguuuuuuuuauggauugaagaauaugcuuggcaguguuuuugguaauuuuuucguaggcauuuuguuauuccuugcccccuuugucuuguuggugcuuuucuuuauguuuggauggaaaaucuuguuuugcuuuaaguguugcaggaggaccagaggcuuguuuaaguauagacaccucaaagaugaugaggaaacaggcuacagaaagauuauugaaagacugaacagcaaaaaaggaaaaaacagacugcuugauggugagagguuggcugauaggaaaauugcugagcuguucucuacaaaaacacacauuggcuaa

SEQ ID NO: 3660 - RNA, 5052 nt, Artificial Sequence
  derived and/or modified CDS sequence (wt) from CCHFV(K315_14)__KX013469.1__GP
augcauacacuauuagugugcuucauucuuuaccuacagcugucggguuuaggaggggcucauggacagucaaacgaaacugaacacaauggaacaaacaccaccacaguacccggcacaagucaaagccccaagccacccgcgagcaccacucuacaacacacaccagaauccuccaccgucaaacucaccacaccaacaagcgaaacagaaggcucaggggaaacgaccccacccccaaacaccacccagggccugcccccaccagggaccacaccagaacgcuccgcaacaaccgccacaagcacgucaagcacagacaacaugaauuccaccacacaggugaccgacaacacccccacaucaacagucagcauaaguccauccagcagccccagcaugccauccacaucacaaggcauacauuaucccauaaggagucuauugucagucucgagcccuaagacaguaacaacaccgacaccaauaagcccuggagagaugagcccggaaaccagcagucagcacucagccaugagcagaauaccaacccucuacacagcaacccaggucuccacugagaacaccaaccgcagcacaccuagacaaucugagucuucaguacagccggcaacccaaagcccaauaacuuccccagcgcaaacaauccuucugaugagugcugcuccuaaagcuauucaggacaugcaucccagcccaacaaacagguccaagaggaaccuugagguggaaauaauuuuaacucugucucaaggucuaaagaaauauuacgguaaaauacugaagcuucugcaccuuaccuuggaagaggauacugaaggccuguuagaaugguguaagagaaaccuugggucaaauugugaugaugacuucuuucaaaagagaauagaggaauucuucauaacuggugagggcuacuucaaugaaguccuacaauuuaaaacacuaagcacacuaagccccacggagccgucucaugucaggcuaccaacagcggagcccuucaaaucuuacuucgcuaagggcuuccuuucaauagauucggguuacuucucugccaaauguuauccaagaucauccacuucagggcuucagcugaucaaugucacccaacacccagcuaggauagcagaaacaccuggacccaaaacaacgagucugaaaaccaucaacuguaucaaccuaagagcaucagucuucaaagaacacagagaaguugagaucaaugugcuucuuccucagauugcagucaaccucucaaacugccauguugugaucaacucacaugucugugauuacucuuuagacacugacgggccagugaggcuuccucgcauucaccaugaagguacuuucauaccaggaacuuauaaaauagugauagacaaaaaaaauaagcuaaaugaccgaugcucgcuagucacuaacugugugauaaagggaagagagguucguaagggccaaucagugcugaggcaguacaaaacagaaauuagaauaggcaaggcaucaacaggcucuaggaaacuacuguccgaagagccaggugacgacugcauaucaagaacucagcuauugaagacagaaacagcagaaauccaugacgacaacuauggugguccaggugacaaaauaacuaucugcaaugguucaaccguuguggaucagagacugggcagugaacuaggguguuauaccaucaacagggugaagucauucaagcuaugcaaaaacagugccacagggaaaaccugugagauagacagcacuccggucaagugcaggcaagguuuuuguuugaaaaucacccaagagggaaggggccacguaaaauuauccaggggcucagagguuguuuuggauguuugcgacucgagcugugaaauaaugauaccuaaaggcacuggagauauccuaguagacuguucagguggacagcaacauuucuuaaaagacaacuugauugaccuagggugcccucauaucccgcuauuggguaaaauggccauuuacauuugcagaaugucaaaucaucccaggacaaccauggcuuuccucuucugguucaguuuuggcuauguaaucaccuguauauuuugcaaggcucuuuuuuauucauugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaagggcuagcuaggcaugugacacaaugcccuaagcgaaaggagaaaguugaggagacugaacuguauuugaaccuggaaagaauuccuuggauagucagaaagcuauugcaagugucagaguccacugguguggcauugaaacgaagcaguuggcugauugugcugcuuguguuacucacagucucauugucaccgguccaaucagcaccuguuggucaugguaagacaaucgaaacauaucagaccagagaaggauucacaaguaucugucucuuuauguuaggaagcauccuauucauaguuucuugccugguaaaggggcugguuuacagugucagugacagcuucuuccccggccugucugucuguaagacaugcucuauuggcaguauaaauggcuuugaaauugaaucgcauaaaugcuacuguaguuuauuuugcugccccuacuguaggcacugcucugcugacagagaaauucaccaguugcacuugaguaucugcaaaaaaagaaaaacagggagcaaugucaugcuggcugucugcaagcgcaugugcuuuaaggcaaccauagaagcaagcagaagagcccugcucauccgaagcauuaucaauaccacuuuuguaauaugcauucuaacauuagcaaucuguguuguuagcaccucugcaguagagauggaagaccuuccagcaggcacuugggagagagaggaagaccuaacaaauuucugccaucaggaaugccaggugaccgagacggaaugccucuguccauacgaagcucuugugcucaggaaaccucuuuucuuagacaguauaguuaaagguaugaaaaaauugcuaaacucaacaagcuuagaaacaagcuuaucaauugaggcaccauggggagcaauaaauguccagucaaccuuuaaaccaacaguaucuacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggacuugucacaaauguauuccccuguuuuugaguacuuaucaggagauagacagguugaagaauggcccaaggcaaccugcacaggugauugcccagaaagguguggcugcacaucaucaaccugcuugcauaaagaauggccucauucaagaaacuggagauguaaucccacuuggugcuggggaguaggaaccggcugcacaugcugcggaguggauguaaaagaccuuuuuacagaccacauguuuaucaaauggaagguugaauauauaaaaaccgaagccauaguauguguugagcucaccagccaagaaagacagugcagucugauugaggcagguacuagauucaacuuggguccugugacuaucacccugucugagccaagaaacauucagcagaagcuucccccugagaucauuacgcugcaucccaaaauugaagaaggcuucuuugacuugaugcaugugcaaaaaguguuaucugcaaguacaguguguaaacugcagaguugcacacaugguauaccaggagaucuacaaauuuaccacaucgguaacuuguugaaaggggauagaguaaacgggcaucugauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaagaaaguugagauaucaggcuugaaauuugcaagucugacuuguacggguugcuaugccuguagcucuggcaucuccuguaaagucagaauucauguagaugaaccagaugagcucacagugcauguaaagagcagugauccagaugugguugcagcuagcacaagccuuauggcaaggaagcuugaauuugggacagauagcacauucaaggcauuuucagccaugcccaaaaccucuuuaugcuuuuacauuguagagagggaauacugcaagagcugcagugaagaugauacaaaaaaauguguugacacaaaacuugagcagccacagagcauacuaauugagcacaaggggacaauaauuggaaagcagaaugauacuugcacagccaaggcaaguuguuggcuagagucagucaagaguuuuuuuuauggacugaagaauaugcuuggcaguguuuuugguaguuuuuucguaggcauuuuguuauuccuugccccuuuugucuuguuggugcuuuucuuuauguuuggauggaaaaucuuguuuugcuuuaaguguugcaggaggaccagaggcuuguuuaaguauagacaccucaaagaugacgaggaaacaggcuacagaaggauuauugaaagacugaacagcaaaaaagggaaaaacagacugcuugauggugagagguuggcugauaggaaaauugcugagcuguucucuacaaaaacacacauuggcuaa

SEQ ID NO: 3661 - RNA, 5055 nt, Artificial Sequence
  derived and/or modified CDS sequence (wt) from CCHFV(BA8402)__AF350449.1__GP
auguacacaccacuuuugugugcuguucuuugcuuacagcuguggaguuuagaagggucucauggacuguccaacaaaacccaacacaguaauacaagcaccacaaaggcgccugaaguaagccaggaacuuggauugccugugagcacaguaucgacuaucacgucagaaccuccuuccaucacauccgcaguaucagucaguggaucagaaggcucaggagacacgaacaccucucccucggucaccacacaaggcccgacuuugccagaaaccacgcuggaaccccuaacaacaaccgacacagaugcaucaagcacugucgucgucgaugucagcacacagacggucaaggacaccccuauaucaacaaccuacacaaguuugcccaguacucccagcgagccaacuacaccacaggguacacaucauacugcaaggggucuacugucagucaccagcacaaagccagaagaagcaucaccacaagcaaauccaggaaaaauaagcauggagaccaauggcccgcgccuagccaucagcgagacaccauccuucucuccaacaacucaggcuccuaccgaaaacagcaaccccaucacauccaaacagcuuaugcucucagcacaaccaguaaccccaaacccaaugaccucuccaguacagccagcccucucucagagugacacguccacggccauccaagauguacacccaagcccaacaggcagaucuaaaagaaaccuugagauggaaauaauuuugacuuuaucucaagguuugaagaaguacuacggcaagauacuaaaacuucuggaccuuacuuuggaagaagacacugaaggccugcuagagugguguaagagaaaucuugguuuggucugugaugacaacuucuuucagaagaggauagaagaguuuuuuuugacugggaagggucacuucaaugaagucuuacaguucaaaacaccaagcacacuaagccccacgggaccagcccgaacugggucaccaacaguggaaccuuuuaaaucuuacuucgcuaaaggguuccuuucaauggacucaggcuacuucucugccaaguguuauccaagagcauccaauucaggacuucagcugaucaaugucacccaacauucaacuagaauaacagacacaccuggacccaagaucacuaaucugaagaccaucaauugcauaaacuuaaaggcaucagucuuuaaagagcauagagagauugaaaucaauguucuucucccucaagucgcaguuaaccucucaagcugccacguguugaucaaaucgcaugucugugacuacucuuuggacauugacgggccaguaagacuaccccgcauccaccaugaaggaacuuucauaccaggaacuuacaaaauaguuauagacaaaaaaaacaaacaaaaugauagaugcacuuuggucaccaacuguguaauaaaaggaagggaaauucguaagggccagucaguguuaagacaauacaggacagaaaucaagauuggcaaggcaucuucugguuccagaagacuauuguccgaagagucuggugaugacugcauaucaagaacucagcuauugaggacagagacugcggaaauucacaaugauaacuauggugguccaggugacaagauaaccaucugcaaugguucaacuguuguggaucagagauugggcagugaacugggguguuacacuaucaauagaguaaacucuuuuaaccuuugcgaaaacacugccacgggcaaauccugugaaauagauagcaccccagucaaaugcaggcaggguuucuguuugaaaauuacucaggagggaaggggccacgugaagcuaucgagagguucagaaguuguccuggacgccugcgaaucaagcugugaaauaaugauaccaaagggcaccggagacauccuaguugacuguucagguggacagcaacauuucuuaaaagauaacuugauugaucuaggaugcccaaacaucccacuauuaggcaagauggcuaucuacauuuguagaaugucaaaucauccuaaaacgacuauggcuuuucuuuuuugguuuagcuuugguuauguggugaccuguauacucuguaaggucaucuucuaucuauuaauaguuguggggacguuggggaaaaaguucaaacaguauagagaguugaaaccucagaccuguaccauaugcgaaacaacuccuguuaaugcaauagaugcugaaaugcacgaccucaauugcaguuacaauauauguccauacugugcaucuaggccaaccucagauggucuugccagacauguuaugcagugcccuaagcggaaggaaaaaauugaagaaaccgcauuauacuuaaacuuggaaagaauccccuggguuguuaggaaauuacugcaggugucagaauccaccgguguggcacuaaagaggaguaguuggcugguugugcuacuugugcuacuuacaguuucauugucaccaguacaaucagcaccuaucggccauggaaagacaguugaaacauaucaaaccagagaaggauacacaaguauuugccucuuuguacuaggaagcaucuuauuuauagucucuugccuaaugaagggguugguugacaguguugguaacaguuuuuucccugguuuguccauuuguaagacauguucuauuggcaguguaaauggcuuugagauugaaucucacaaauguuacuguagccuauuuuguugucccuacuguagacacugcucugccgauagagaaauacauagguugcacuugagcaucugcaagaaaaggaagacugggaguaaugucaugcuggccgucuguaagcgcaugugcuuuagggcaacuguggaaguaagcaacaaggcucuacucauccgaaacaucaucaacaccacuuuuguucugugcauacugauauuagcaguuuguguugucagcaccuccgcaguggagauggaaagccugccagcuggcacuugggagagagaggaagaucugacaaauuucugucaucaagaaugccaagucacugagacugaaugccucugucccuacgaagcucuugugcucaggaaacccuuguuuucagacagcauugucaaaggcaugaagaacuugcuaaauucaacaagcuuagaaacaagcuuaucaauugaggcaccauggggagcaauaaauguccaaucaaccuucaaaccuacugugucagcugcgaauauagcucuuaguuggagcucaguggaacacagggguaauaagauuuugguuucagguagaucagaaucaaucaugaagcuagaagaaaggacaggaaucagcugggaucuagggguagaagaugcuucugaaucuaaauugcuuacugucucuguuauggacuugucacagauguacucuccugucuuugaguaccuaucaggugacagacaaguggaggaauggcccaaggcaaccugcacaggagauugcccagaaagauguggcugcacaucaucaaccugccuacacaaagaauggccccauucaagaaacuggagaugcaaccccaccugguguuggggagucggcacuggauguaccugcugugggcuggauguaaaagaccuuuuuacagauuacauguuuaucaaguggaaaguugaguacauuaaaacagaagcuauaguguguguugagcuuacuagccaagagagacaauguaccuugauugaggcaggcacaagauucaacuuagguccugugaccaucacauugucagagccaagaaacauucagcaaaagcucccuccagagauaguuacauugcaccccagaauugaagaagguuucuuugauuuaaugcauguacaaaaggugcuaucagcaaguacaguguguaagcuacagaguugcacacauggugugccaggggaccuacaggucuaucacauaggaaacuuguuaaaaggagacaaggugaaugggcaccugauucacaaaauugaaccacacuucaacacuuccuggaugucuugggacggcugugaccuacacuacuacuguaauaugggggauuggccaucuugcacauauacuggagucacccagcacaaucaugcugcauuuguaaacaugcucaacaucgaaacugauuauacaaaaaacuuccacuuucacucuaagagaguuacugcacauggagacacaccacaauuagauuugaaagcuagaccaacuuauggugcaggugaaaucacugugcugguggaaguugcugacauggaguuacacacaaagaaaauugagauaucagguuugaaguuugcaagcuuaacuugcacaggcuguuaugcuuguagcucugguaucuccuguaagguuagaauccauguagaugagccagaugagcuuacaguacaugugaagagugaagaccccgacauaguugcugcuagcucaagucucauggcuaggaagcuugaauuugggacagauaguacauucaaagccuuuucagccaugcccaaaaccuccuuaugcuucuacauuguggagagagaauauugugaaagcugcagcaaagaagauacacaaaaauguguuaacacaaagcuugagcaaccacagagcauuuuaaucgagcacaaaggcacgauaauugguaagcagagcaacaccugcacagcuaaagcaagcuguuggcuagagucagucaagagcuucuuuuaugggcuaaagaacaugcuuaguggcauuuuuggcaauguuuucauagggguuuucuuauucuuugcuccuuuuauccuuuugauacuuuucuuuauguuuggauggagaauccuguucugcuuuaaauguugcagaagaacuagaggccuuuuuaaguacagacaccucaaggacgaugaagaaaccgguuacaggaaaaucauugagagacugaacaacaaaaaagggaaaaacaaacugcuugauggugaaagauuagcugauaggaagauugcugagcuguucuccacaaagacacacauuggcuaa

SEQ ID NO: 3662 - RNA, 5055 nt, Artificial Sequence
  derived and/or modified CDS sequence (wt) from CCHFV(UCCR4459)__KY484032.1__GP
auguacacaccacuuuugugugcuguucuuugcuuacagcuguggaguuuagaagggucucauggacuguccaacaaaacccaacacaguaauacaagcaccacaaaggcgccugaaguaagccaggaauuuggauugccugugagcacaguaucgacuaucacgucagacccuccuuccaucacauccgcaguaucagucaguggaucagaaggcucaggagacacgaacaccucucccucggucaccacacaaggccugacuuugccagaaaccacgcuggaacuccuuacaacaaccgacacagaugcaucaagcacugucgucgucgaugucagcacacagacggucaaggacacccccauaucaacaacccacacaaguuugcccaguacuccuagcgcgacaacuacaccacaggguacacaccauacugcaaggggucuacugucagucaccagcacaaagccagaaggagcaucaacacaagcaaauccagaaaaaauaagcauggagaccaauagcccgcgccuagccaucagcgagacaccauccuucucuccaacaacucaggcuccuaccgaaaacagcaaccccaucacauccaaacagcucauauucucagcacaaccaguaaccccaaacccagugaccccuccaguacagccagcccucucucagagugacacguccacggccauccaggauauacaccccagcccaacaagcagaucuaagagaaaccuugagauggaaauaauuuugacuuuaucucaggguuugaagaaguacuacggcaagauacuaaaacuucuggaccuuacuuuggaagaagacacugaaggccugcuagaguggugcaagagaaaucuugguuuggucugugaugaugacuucuuucagaagagaauagaagaguuuuuuuugacuggggagggucacuucaaugaagucuuacaguucaaaacaccaagcacacuaagccccacgggaccagcccgaacugggucaccaacaguggaaccuuuuaaaucuuacuucgcuaaaggguuucuuucaauggacucaggcuacuucucugccaaguguuauccaagagcauccaauucaggacuucagcugaucaacgucacccaacauucaacuagaauaacagacacaccuggacccaaggucacuaaucugaagaccaucaauugcauaaacuuaaaggcaucagucuuuaaagagcauagagagauugaaaucaauguucuucucccucaagucgcaguuaaccucucaagcugccacguguugaucaaaucgcaugucugugacuacucuuuggacauugaugggccaguaaggcuaccccgcauccaccaugaaggaacuuucauaccaggaacuuacaaauuaguuauagacaaaaaaaacaaacaaaaugacagaugcacuuugaucaccaacuguguaauaaaaggaagggaaauucguaagggccagucaguguuaagacaauacaggacagaaaucaagauuggcaaggcaucuucugguuccagaagacuauuguccgaagagucuggugaugacugcauaucaagaacucagcuaucgaggacagagacugcggaaauucacagugauaacuauggugguccaggugacaagauaaccaucugcaaugguucaacuauuguagaucagagauugggcagugaacuaggguguuacacuaucaauagaguaaagucauuuaagcuuugcgagaacagugccacagguaaauccugugaaauagauagcaccccaauuaaaugcaggcaggguuuuuguuuaaaaauuacucaggagggaaggggccacgugaagcuaucaagagguucagaaguugucuuggacgccugugauucaagcugugagauaaugauaccaaagggcacuggagacauccuaguugacuguucagguggacagcaacauuucuuaaaagauaacuugauugaucugggaugcccaaacaucccacuauuagguaagauggcuaucuacauuuguagaaugucaaaucauccuaaaacgacuauggcuuuucuuuuuugguuuagcuuugguuaugugauaaccuguauacucuguaaggucaucuucuaccuauuaauaguuguggggacguugggaaaaaaguucaaacaguauagagaguugaaaccucagaccuguaccauaugcgaaacaacuccuguuaaugcaauagaugcugaaaugcacgaccucaacugcaguuacaauauauguccuuacugugcaucuagguuaaccucagacggucuugccagacauguaaugcagugcccuaagcggaaggaaaaaguagaagaaaccgaauuauacuuaaacuuagaaagaauccccuggguuguuaggaaauuacugcaggugucagaauccaccgguguggcacuaaagaggaguaguuggcugguugugcuacuuguguuacuuacaguuucauugucaccaguacaaucagcaccuaucggccauggaaagacaguugaaacauaucaaaccagagaaggguacacaagcauuugccuuuuuguacuaggaagcaucuuauuuauagucucuugccuaaugaagggguugguugacaguguugguaacaguuuuuucccugguuuguccauuuguaagacauguucuauuggcagcauaaauggcuuugagauugaaucucacaaauguuacuguagccuauuuuguugccccuacuguagacacugcucugccgauagagaaauacauaaguugcacuugagcaucugcaagaaaaggaagacugggaguaaugucauguuggccgucuguaagcgcaugugcuuuagggcaacuguggaaguaagcaacaaggcucuacuuauccgaaacaucaucaauaccacuuuuguugugugcauacugauauuagcaguuuguguugucagcaccuccgcaguggagauggaaagccugccagcuggcacuugggagagagaggaagaucugacaaauuucugucaucaagaaugccaagucacugagacugaaugccucuguccuuacgaagcucuugugcucaggaaacccuuguuuucagacaguauugucaaaggcaugaagaacuugcuaaauucaacaagcuuagaaacaagcuuaucaauugaggcaccauggggagcuauaaauguccaaucaaccuucaaaccuacuguguccgcugcgaacauagcucuuaguuggagcucaguggaacacagggguaauaagauuuugguuucagguagaucagagucaauuaugaagcuagaggaaaggacaggaaucagcugggaucuagggguagaagaugccucugagucuaaauugcuuacugucucuauuauggacuugucacagauguauucuccugucuuugaguaccuaucaggugauagacaaguggaggaauggcccaaggcaaccugcacaggagauugcccagaaagauguggcugcacaucaucaaccugccuacacaaagaauggccccauucaagaaacuggagaugcaaccccaccugguguuggggagucggcacuggauguaccugcugugggcuggauguaaaagaccuuuuuacagauuacauguuugucaaguggaaaguugaguacauuaaaacagaagcuauaguguguguugagcuuacuagccaagagagacaauguagcuugauugaggcaggcacaagauucaacuuagguccugugaccaucacauugucagagccaagaaacauucagcaaaagcucccuccagagauaguuacauugcaucccagaauugaagaagguuucuuugauuuaaugcauguaaaaaaagugcuaucagcaaguacaguauguaagcuacagaguugcacacauggugugccaggggaccuacaggucuaccacauaggaaacuuguuaaaaggagacaaggugaaugggcaccugauucacaaaauugaaccacacuucaacacuuccuggaugucuugggacggcugugaccuagacuacuacuguaauaugggagacuggccaucuugcucauauacuggaguaacccagcacaaucaugcugcauuuguaaacaugcucaacaucgaaacugauuauacaaaaaucuuccacuuucacucuaagagaguuacugcacauggagacacaccacaauuagauuugaaagcuagaccaacuuauggugcaggugaaaucacugugcuaguggaaguugcugacauggaguuacacacaaagaaaauugagauaucagguuuaaaguuugcaagcuuaacuugcacaggcuguuaugcuuguagcucugguaucuccuguaagguuagaauccauguagaugagccugaugagcuuacaguacaugugaagagugaagacccagacauaguugcugcuagcucaagucucauggcuagaaaacuugaauuugggacagauagcacauucaaagccuuuucagccaugcccaaaaccuccuugugcuuuuacauuguggagagagaauauuguaaaagcugcaguaaagaagauacacaaaaaugugucaacacaaagcuugagcaaccacagagcauuuuaauugagcacaaaggaacgauaauugguaagcaaaacgacaccugcacaucuaaagcaggcuguuggcuagagucagucaagagcuucuuuuaugggcuaaaaaacaugcuuaguggcauuuuuggcaauguuuucauagggauuuucuuauuccuugcuccuuuuauccuuuuaauacuuuucuuuauguuuggauggagaauccuguucugcuuuaaauguugcagaagaacuagaggcuuauuuaaguacagacaccucaaggacgaugaagaaaccgguuacaggaaaaucauugagaggcugaacaacaaaaaagggaaaaacaaacugcuugauggugaaagauuagcugauaggaagauugcugagcuguucuccacaaagacacacauuggcuaa

SEQ ID NO: 3663 - RNA, 5052 nt, Artificial Sequence
  derived and/or modified CDS sequence (wt) from CCHFV(Ast149)__KX056054.1__GP
augcauacacuauuagugugcuucauucuuuaccuacagcugucggguuuaggaggagcucauggacagucaaacgcaacugaacacaacggaacaaacaccaccacagcacccggcacaagucaaagccccaagccacccgcgagcaccacuccaccacacacaccagaauccuccaccgucaaacucaccacaccaacgagcgaaacagaaggcucaggggaaacgaccccacccccaaacaccacccagggccugcccccaccagggaccacaccagaacgccccgcaacaaccgccacaagcacgucaagcacagacaacaugaacuccaccacacaggugaccgacaacacccccacaucaacagucagcacaaguccauccagcagccccagcaugccauccacaucacaaggcauacauuaucccguaaggagucuauugucagucucgagcccuaagacaguaacaacaccgacaccaaugagcccuggagagaugagcccggaaaccagcagucagcacucagccaugagcagaauaccaacccucuacacagcagcccaggucuccacugagaacgccaaccgcagcacaccuagacaaucagaguccucagcacagccggcaacccaaagcccaacaacuuucccagcgcaaacaauccuucugaugagugcugcuccuaaagcuauucaggacaugcaucccagcccaacaaacagguccaagaggaaccuugagguggaaauaauuuuaacucugucucaaggucuaaagaaguauuaugguaaaauacugaagcuucugcaccuuaccuuggaagaggauacugaaggccuguuagaaugguguaagagaaaccuugggucaaauugugaugaugacuucuuucaaaagagaauagaagaauucuucauaacuggugagggcuacuucaaugaaguccuacaauuuaaaacacuaagcacacuaagccccacggagccgucucaugucaggcuaccaacagcagagcccuucaaaucuuacuucgcuaagggcuuccuuucaauagauucggguuacuucucugccaaauguuauccaagaucauccacuucagggcuucagcugaucaaugucacccaacacccagcuaggauagcagaaacaccuggacccaaaacaacgagucugaaaaccaucaacuguaucaaccuaagagcaucagucuucaaagaacacagagaaguugagaucaaugugcuucuuccucagauugcagucaaccucucaaacugccauguugugaucuacucacaugucugugauuacucuuuagacacugacgggccagugaggcuuccucgcauucaccaugaggguacuuucauaccaggaacuuauaaaauagugauagacaaaaaaaauaagcuaaaugaccgaugcucgcuagucacuaacugugugauaaagggaagagagguucguaagggccaaucagugcugaggcaguacaaaacagaaauuaagauaggcaaggcaucaacaggcucuaggaaacuacuguccgaagagccaggugacgacugcauaucaagaacucagcuauugaagacagaaacagcagagauccaugacgacaacuauggugguccaggugacaaaauaacuaucugcaaugguucaaccauuguagaucagagacugggcagugaacuaggguguuauaccaucaacagggugaagucauucaagcuaugcgaaaacagugccacagggaaaaccugugagauagacagcacuccggucaagugcaggcaagguuuuuguuugaaaaucacccaagagggaaggggccacguaaaauuauccaggggcucagagguuguuuuggaugcuugcgacucgagcugugaaauaaugauaccuaaaggcacuggagauauccuaguagacuguucagguggacagcaacauuucuuaaaagacaacuugauugaccuagggugcccucauaucccgcuauuggguaagauggccauuuacauuugcagaaugucaaaucaucccaggacaaccauggcuuuccucuucugguucaguuuuggcuauguaaucaccuguauauuuugcaaggcucuuuuuuauucguugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuagcuaggcaugugacacaaugcccuaagcgaaaggagaaaguugaggagacugaacuguauuugaaccuggaaagaauuccauggauagucagaaagcuguugcaagugucagaguccacugguguggcauugaaacgaagcagcuggcugauugugcuacuuguguuacucacagucucauugucaccgguucaaucagcaccuguuggucaugguaagacaaucgaaacauaucagaccagagaaggauucacaaauaucugucucuuuauguuaggaagcauccuauucauaguuucuugccugguaaaggggcugguugacagugucagugacagcuucuuccccggccuaucugucuguaagacaugcucuauuggcaguauaaauggcuuugaaauugaaucgcacaaaugcuacuguaguuuauuuugcugccccuacuguaggcacugcucugcugacagagaaauucaccagcugcacuuggguaucugcaaaaaaagaaaaacggggagcaaugucaugcuggcugucugcaagcgcaugugcuuuaaggcaaccauagaagcaagcagaagagcccuacccauccgaagcauuaucaauaccacuuuuguaauaugcauacuaacauuagcaaucuguguuguuagcaccucugcaguagagauggaaaaucuuccagcaggcacuugggagagagaggaagaccugacaaauuucugccaucaggaaugccagguaaccgagacggaaugccucuguccauacgaagcucuugugcucaggaaaccucuuuucuuagacaguauaguuaaagguaugaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggauuugucacaaauguauuccccuguuuuugaguacuuaucaggagauagacagguugaagaauggcccaaggcaaccugcacaggugauugcccagaaagguguggcugcacaucaucaaccugcuugcauaaagaauggccucacucaagaaacuggagauguaaucccacuuggugcuggggaguaggaaccggcugcacaugcugcggaguggauguaaaagaccuuuuuacagaucacauguuuaucaaauggaagguugaauauauaaaaaccgaagccauaguauguguugagcucaccagccaagaaagacagugcagucugauugaggcagguacuagauucaacuuggguccugugacuaucacccugucugagccaaggaacauucagcagaagcuucccccugagaucauuacgcugcauccuaaaauugaagaaggcuucuuugacuugaugcaugugcaaaaaguguuaucugcaaguacaguguguaaacugcagaguugcacacaugguauaccaggagaucuacaaauuuaccacauuggcaacuuguugaaaggggauagauuaaacgggcaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaagaaaguugagguaucaggcuugaaauuugcaagucuggcuugcacggguugcuaugcuuguagcucuggcaucuccuguaaagucagaauucauguagaugaaccggaugagcucacagugcauguaaagagcagugauccagaugugguugcagcuagcacaagccuuauggcaaggaagcuugaauuugggacagauagcacauucaaggcauuuucagcuaugcccaaaaccucuuugugcuuuuacauuguggagagggaauacugcaagagcugcagugaagaugauacaaaaaaauguguugacacaaaacuugagcagccacagagcauacuaauugagcacaaagggacgauaauuggaaagcagaaugauacuugcacagccaaggcaaguuguuggcuagagucagucaagaguuuuuuuuauggauugaagaauaugcuuggcaguguuuuugguaauuuuuucguaggcauuuuguuauuccuugccccuuuugucuuguuggcgcuuuucuuuauauuuggauggaaaaucuuguuuugcuuuaaguguugcaggaggaccagaggcuuguuuaaguauagacaccucaaagaugaugaggaaacaggcuacagaaagauuauugaaagacugaacagcaaaaaaggaaaaaacagacugcuugauggugagagguuggcugauaggaaaauugcugagcuguucucuacaaaaacacacauuggcuaa

SEQ ID NO: 3664 - RNA, 5052 nt, Artificial Sequence
  derived and/or modified CDS sequence (wt) from CCHFV(Ast137)__KX056057.1__GP
augcauacacuauuagugugcuucauucuuuaccuacagcugucggguuuaggaggagcucauggacagucaaacgcaacugaacacaauggaacaaacaccaccacaguacccggcacaagucaaagccccaagccacccgcaagcaccacucuaccacacacaccagaauccuccaccgucaaacucaccacaccaacaagcgaaacagaaggcucaggggaaacgaccccacccccaaacaccacccagggccugcccccaccagggaccacaccagagcgccccgcaacaaccgccacaagcacgucaagcacagacaacaugaacuccaccacacaggugaccgacaacacccccacaucaacagucagcauaaguccauccagcagccccagcaugccauccacaucacaaggcauacauuaucccguaaggagucuauugucagucucgagcccuaagacaguaacaacaccgacaccaaugagcccuggagagaugagcccggaaaccagcagucagcacucagccaugagcagaauaccaacccucuacacagcagcccaggucuccacugagaacaccaaccgcagcacaccuagacaaucagaguccucagcacagccggcaacccaaagcccaacaacuuucccagcgcaaacaauccuucugaugagugcugcuccuaaagcuauucaggacaugcaucccagcccaacaaacagguccaagaggaaccuugagguggaaauaauuuuaacucugucucaaggucuaaagaaguauuacgguaaaauacugaagcuucugcaccuuaccuuggaagaggauacugaaggccuguuagaaugguguaagagaaaccuugggucaaauugugaugaugacuucuuucaaaagagaauagaagaauucuucauaacuggugaaggcuacuucaaugaaguccuacaauuuaaaacacuaagcacacuaagccccacggagccgucucaugucaggcuaccaacagcagagcccuucaaaucuuacuucgcuaagggcuuccuuucaauagauucggguuacuucucugccaaauguuauccaagaucauccacuucagggcuucagcugaucaaugucacccaacacccagcuaggauagcagaaacaccuggacccaaaacaacgagucugaaaaccaucaacuguaucaaccuaagagcaucagucuucaaagaacacagagaaguugagaucaaugugcuucuuccucagauugcagucaaccucucaaacugccauguugugaucaacucacaugucugugauuacucuuuagacacugacgggccagugaggcuuccucgcauucaccaugaggguacuuucauaccaggaacuuauaaaauagugauagacaaaaaaaauaagcuaaaugaccgaugcucgcuagucacuaacugugugauaaagggaagagagguucguaagggccaaucaguacugaggcaguacaaaacagaaauuaagauaggcaaggcaucaacaggcucuaggaaacuacuguccgaagagccaggugacgacugcauaucaagaacucagcuauugaagacagaaacagcagagauccaugacgacaacuauggugguccaggugacaaaauaacuaucugcaaugguucaaccauuguggaucagagacugggcagugaacuaggguguuauaccaucaacagggugaagucauucaagcuaugcgaaaacagugccacagggaaaaccugugagauagacagcacuccggucaagugcaggcaaggguuuuguuugaaaaucacccaagagggaaggggccacguaaaauuauccaggggcucagagguuguuuuggaugcuugcgacucgagcugugaaauaaugauaccuaaaggcacuggagauauccuaguagacuguucagguggacagcaacauuucuuaaaagacaacuugauugaccuagggugcccucauaucccgcuauuggguaagauggccauucacauuugcagaaugucaaaucaucccaggacaaccauggcuuuccucuucugguucaguuuuggcuauguaaucaccuguauauuuugcaaggcucuuuuuuauucauugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuagcuaggcaugugacacaaugcccuaagcgaaaggagaaaguugaggagacugaacuguauuugaaccuggaaagaauuccauggauagucagaaagcuguugcaagugucagaguccacugguguggcauugaaacgaagcagcuggcugauugugcugcuuguguuacucacagucucauugucaccgguucaaucagcaccuguuggucaugguaagacaaucgaaacauaucagaccagagaaggauucacaaauaucugucucuuuauguuaggaagcauccuauucauaguuucuuaccugguaaaggggcugguugacagugucagugacagcuucuuccccggccuaucugucuguaagacaugcucuauuggcaguauaaauggcuuugaaauugaaucgcacaaaugcuacuguaguuuauuuugcugccccuacuguaggcacugcucugcugacagagaaauucaccagcugcacuuggguaucugcaaaaaaagaaaaacggggagcaaugucaugcuggcugucugcaagcgcaugugcuuuaaggcaaccauagaagcaagcagaagagcccuacucauccgaagcauuaucaauaccacuuuuguaauaugcauccuaacauuagcaaucuguguuguuagcaccucugcaguagagauggaaaaucuuccagcaggcacuugggagagagaggaagaccugacaaauuucugccaucaggaaugccagguaaccgagacggaaugccucuguccauacgaagcucuugugcucaggaaaccucuuuucuuagacaguauaguuaaagguacgaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggauuugucacaaauguauuccccuguuuuugaguacuuaucaggagauagacagguugaagaauggcccaaggcaaccugcacaggugauugcccagaaagguguggcugcacaucaucaaccugcuugcauaaagaauggccucacucaagaaacuggagauguaaucccacuuggugcuggggaguaggaaccggcugcacaugcugcggaguggauguaaaagaccuuuuuacagaucacauguuuaucaaauggaagguugaauauauaaaaaccgaagccauaguauguguugagcucaccagccaagaaagacagugcagucugauugaggcagguacuagauucaacuuggguccugugacuaucacccugucugagccaaggaacauucagcagaagcuucccccugagaucauuacgcugcauccuaaaauugaagaaggcuucuuugacuuaaugcaugugcaaaaaguguuaucugcaaguacaguguguaaacugcagaguugcacacaugguauaccgggagaucuacaaauuuaccacauuggcaacuuguugaaaggggauagauuaaacgggcaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccacucuaaaagggucacagcacauggagacacaccacaauuagacuuaaaagcaaggccgaccuacggugcaggugagaucacugugcugguugagguugcugacauggaguugcauaccaagaaaguugagguaucaggcuugaaauuugcaagucuggcuugcacggguugcuaugcuuguagcucuggcaucuccuguaaagucagaauucauguagaugaaccggaugagcucacagugcauguaaagagcagugauccagaugugguugcagcuagcacaagccuuauggcaaggaagcuugaauuugggacagauagcacauucaaggcauuuucagcuaugcccaaaaccucuuugugcuuuuacauuguggagagggaauacugcaagagcugcagugaagaugauacaaaaaaauguguugacacaaaacuugagcagccacagagcauacuaauugagcacaaagggacgauaauuggaaagcagaaugauacuugcacagccaaggcaaguuguuggcuagagucagucaagaguuuuuuuuauggauugaagaauaugcuuggcaguguuuuugguaauuuuuucguaggcauuuuguuauuccuugccccuuuugucuuguuggugcuuuucuuuauauuuggauggaaaaucuuguuuugcuuuaaguguugcaggaggaccagaggcuuguuuaaguauagacaccucaaagaugaugaggaaacaggcuacagaaagauuauugaaagacugaacagcaaaaaaggaaaaaacagacugcuugauggugagagguuggcugauaggaaaauugcugagcuguucucuacaaaaacacacauuggcuaa

SEQ ID NO: 3665 - RNA, 5055 nt, Artificial Sequence
  derived and/or modified CDS sequence (wt) from CCHFV(C-68031)__DQ211629.1__GP
auguacacaccacuuuugugugcuguucuuugcuuacagcuguggaguuuagaagggucucauggacuguccaacaaaacccaacacaguaauacaagcaccacaaaggcgccugaaguaagccaggaauuuggauugccugugagcacaguaucgacuaucacgucagacccuccuuccaucacauccgcaguaucagucaguggaucagaaggcucaggagacacgaacaccucucccucggucaccacacaaggccugacuuugccagaaaccacgcuggaacuccuuacaacaaccgacacagaugcaucaagcacugucgucgucgaugucagcacacagacggucaaggacacccccauaucaacaacccacacaaguuugcccaguacuccuagcgcgccaacuacaccacaggguacacaccauacugcaaggggucuacugucagucaccagcacaaagccagaaggagcaucaacacaagcaaauccagaaaaaauaagcauggagaccaauagcccgcgccuagccaucagcgagacaccauccuucucuccaacaacucaggcuccuaccgaaaacagcaaccccaucacauccaaacagcucauacucucagcacaaccaguaaccccaaacccagugaccccuccaguacagccagcccucucucagagugacacguccacggccauccaggauauacaccccagcccaacaagcagaucuaagagaaaccuugagauggaaauaauuuugacuuuaucucaggguuugaagaaguacuacggcaagauacuaaaacuucuggaccuuacuuuggaagaagacacugaaggccugcuagaguggugcaagagaaaucuugguuuggucugugaugaugacuucuuucagaagagaauagaagaguuuuuuuugacuggggagggucacuucaaugaagucuuacaguucaaaacaccaagcacacuaagccccacgggaccagcccgaacugggucaccaacaguggaaccuuuuaaaucuuacuucgcuaaaggguuccuuucaauggacucaggcuacuucucugccaaguguuauccaagagcauccaauucaggacuucagcugaucaacgucacccaacauucaacuagaauaacagacacaccuggacccaaggucacuaaucugaagaccaucaauugcauaaacuuaaaggcaucagucuuuaaagagcauagagagauugaaaucaauguucuucucccucaagucgcaguuaaccucucgagcugccacguguugaucaaaucgcaugucugugacuacucuuuggacauugaugggccaguaaggcuaccccgcauccaccaugaaggaacuuucauaccaggaacuuacaaauuaguuauagacaaaaaaaacaaacaaaaugacagaugcacuuugaucaccaacuguguaauaaaaggaagggaaauucguaagggccagucaguguuaagacaauacaggacagaaaucaagauuggcaaggcaucuucugguuccagaagacuauuguccgaagagucuggugaugacugcauaucaagaacucagcuaucgaggacagagacugcggaaauucacagugauaacuauggugguccaggugacaagauaaccaucugcaaugguucaacuauuguagaucagagauugggcagugaacuaggguguuacacuaucaauagaguaaagucauuuaagcuuugcgagaacagugccacagguaaauccugugaaauagauagcaccccaauuaaaugcaggcaggguuuuuguuuaaaaauuacucaggagggaaggggccacgugaagcuaucaagagguucagaaguugucuuggacgccugugauucaagcugugagauaaugauaccaaagggcacuggagacauccuaguugacuguucagguggacagcaacauuucuuaaaagauaacuugauugaucugggaugcccaaacaucccacuauuagguaagauggcuaucuacauuuguagaaugucaaaucauccuaaaacgacuauggcuuuucuuuuuugguuuagcuuugguuaugugauaaccuguauacucuguaaggucaucuucuaccuauuaauaguuguggggacguugggaaaaaaguucaaacaguauagagaguugaaaccucagaccuguaccauaugcgaaacaacuccuguuaaugcaauagaugcugaaaugcacgaccucaacugcaguuacaauauauguccuuacugugcaucuagguuaaccucagacggucuugccagacauguaaugcagugcccuaagcggaaggaaaaaguagaagaaaccgaauuauacuuaaacuuagaaagaauccccuggguuguuaggaaauuacugcaggugucagaauccaccgguguggcacuaaagaggaguaguuggcugguugugcuacuuguguuacuuacaguuucauugucaccaguacaaucagcaccuaucggccauggaaagacaguugaaacauaucaaaccagagaaggguacacaagcauuugccuuuuuguacuaggaagcaucuuauuuauagucucuugccuaaugaagggguugguugacaguguugguaacaguuuuuucccugguuuguccauuuguaagacauguucuauuggcagcauaaauggcuuugagacugaaucucacaaauguuacuguagccuauuuuguugccccuacuguagacacugcucugccgauagagaaauacauaaguugcacuugagcaucugcaagaaaaggaagacugggaguaaugucauguuggccgucuguaagcgcaugugcuuuagggcaacuguggaaguaagcaacaaggcucuacuuauccgaaacaucaucaauaccacuuuuguugugugcauacugauauuagcaguuuguguugucagcaccuccgcaguggagauggaaagccugccagcuggcacuugggagagagaggaagaucugacaaauuucugucaucaagaaugccaagucacugagacugaaugccucuguccuuacgaagcucuugugcucaggaaacccuuguuuucagacaguauugucaaaggcaugaagaacuugcuaaauucaacaagcuuagaaacaagcuuaucaauugaggcaccauggggagcuauaaauguccaaucaaccuucaaaccuacuguguccgcugcgaacauagcucuuaguuggagcucaguggaacacagggguaauaagauuuugguuucagguagaucagagucaauuaugaagcuagaggaaaggacaggaaucagcugggaucuagggguagaagaugccucugagucuaaauugcuuacugucucuauuauggacuugucacagauguauucuccugucuuugaguaccuaucaggugauagacaaguggaggaauggcccaaggcaaccugcacaggagauugcccagaaagauguggcugcacaucaucaaccugccuacacaaagaauggccccauucaagaaacuggagaugcaaccccaccugguguuggggagucggcacuggauguaccugcugugggcuggauguaaaagaccuuuuuacagauuacauguuugucaaguggaaaguugaguacauuaaaacagaagcuauaguguguguugagcuuacuagccaagagagacaauguagcuugauugaggcaggcacaagauucaacuuagguccugugaccaucacauugucagagccaagaaacauucagcaaaagcucccuccagagauaguuacauugcaucccagaauugaagaagguuucuuugauuuaaugcauguaaaaaaagugcuaucagcaaguacaguauguaagcuacagaguugcacacauggugugccaggggaccuacaggucuaccacauaggaaacuuguuaaaaggagacaaggugaaugggcaccugauucacaaaauugaaccacacuucaacacuuccuggaugucuugggacggcugugaccuagacuacuacuguaauaugggggacuggccaucuugcucauauacuggaguaacccagcacaaucaugcugcauuuguaaacaugcucaacaucgaaacugauuauacaaaaaucuuccacuuucacucuaagagaguuacugcacauggagacacaccacaauuagauuugaaagcuagaccaacuuauggugcaggugaaaucacugugcuaguggaaguugcugacauggaguuacacacaaagaaaauugagauaucagguuuaaaguuugcaagcuuaacuugcacaggcuguuaugcuuguagcucugguaucuccuguaagguuagaauccauguagaugagccugaugagcuuacaguacaugugaagagugaagacccagacauaguugcugcuagcucaagucucauggcuagaaaacuugaauuugggacagauagcacauucaaagccuuuucagccaugcccaaaaccuccuugugcuuuuacauuguggagagagaauauuguaaaagcugcaguaaagaagauacacaaaaaugugucaacacaaagcuugagcaaccacagagcauuuuaauugagcacaaaggaacgauaauugguaagcaaaacgacaccugcacaucuaaagcaggcuguuggcuagagucagucaagagcuucuuuuaugggcuaaaaaacaugcuuaguggcauuuuuggcaauguuuucauagggauuuucuuauuccuugcuccuuuuauccuuuuaauacuuuucuuuauguuuggauggagaauccuguucugcuuuaaauguugcagaagaacuagaggccuauuuaaguacagacaccucaaggacgaugaagaaaccgguuacaggaaaaucauugagaggcugaacaacaaaaaagggaaaaacaaacugcuugauggugaaagauuagcugauaggaagauugcugagcuguucuccacaaagacacacauuggcuaa

SEQ ID NO: 3666 - RNA, 5052 nt, Artificial Sequence
  derived and/or modified CDS sequence (wt) from CCHFV(K340_6)__KX013475.1__GP
augcauacacuauuagugugcuucauucuuuaccuacagcugucggguuuaggaggagcucauguacagucaaacgcaacugaacacaauggaacaaacaccaccacagcacccggcacaagucaaagccccaagccacccgcgagcaccacucuaccacacacaccagaauccuccaccgucaaacccaccacaccaacaagcgaaacagaaggcucaggggaaacgaccccacccccaaacaccacccagggccugcccccaacagggaccacaccagaacgcuccgcaacaaccgccacaagcacgucaagcacagacaacaugaacuccaccacacaggugaccgacagcacccccacaucaacagucagcacaaguccauccagcagcuccagcaugccauccacaucacaaggcauacaucaucccguaaggagucuauugucagucucgagcccuaagacaguaacaacaccgacaccaaugagcccuggagagaugagcccggaaaccagcagucagcacucagccaugagcagaguaccaacccucuacacagcaacccaggucuccacugagaacaccgaccgcagcacaccuagacaaucugaguccucaguacagccggcaacccaaagcccaauaacuuccccagcgcaaacaauccuucugaugagugcugcuccuaaagcuauucaggacaugcaucccagcccaacaaacagguccaagaggaaccuugagguggaaauaauuuuaacucugucucaaggucuaaagaaauauuacgguaaaauacugaagcuucugcaccuuaccuuggaagaggauacugaaggccuguuagaaugguguaagagaaaccuugggucaaauugugaugaugacuucuuucaaaagagaauagaagaauucuucauaacuggugagggcuacuucaaugaaguccuacaauuuaaaacacuaagcacacuaagccccacggagccgucucaugucaggcuaccaacagcggagcccuucaaaucuuacuucgcuaagggcuuccuuucaauagauucggguuacuucucugccaaauguuauccaagaucauccacuucagggcuucagcugaucaaugucacccaacacccagcuaggauagcagaaacaccuggacccaaaacaacgagucugaaaaccaucaacuguaucaaccuaagagcaucagucuucaaagaacacagagaaguugagaucaaugugcuucuuccucagauugcagucaaccucucaaacugccauguugugaucaacucacaugucugugauuacucuuuagacacugacgggccagugaggcuuccucgcauucaccaugaagguacuuucauaccaggaacuuauaaaauagugauagacagaaaaaauaagcuaaaugaccgaugcucgcuagucacuaacugugugauaaaaggaagagagguucguaagggccaaucagugcugaggcaguacaaaacagaaauuaagauaggcaaggcaucaacaggcucuaggaaacuacuguccgaagagccaggugacgacugcauaucaagaacucagcuauugaagacagaaacagcagagauccaugacgacaacuauggugguccaggugacaaaauaacuaucugcaaugguucaaccauuguagaucagagacugggcagugaacuaggguguuauaccaucaacagggugaagucuuucaagcuaugcgaaaacaguaccacagggaaaaccugugagauagacagcacuccggucaagugcaggcaaggcuuuuguuugaaaaucacccaagagggaaggggccacguaaaauuauccaggggcucagagguuguuuuggaugcuugcgacucgagcugugaaauaaugauaccuaaaggcacuggagauauccuaguagacuguucagguggacagcaacauuucuuaaaagacaacuugauugaccuagggugcccucauaucccgccauuggguaaaauggccauuuacauuugcagaaugucaaaucaucccaggacaaccauggcuuuccucuucugguucaguuuuggcuauguaaucaccuguauauuuugcaaggcucuuuuuuauucauugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuggcuaggcaugugacacaaugcccuaagcgaaaggagaaaguugaggagacugaacuguauuugaaccuggaaagaauuccuuggauagucagaaagcuauugcaagugucagaguccacugguguggcauugaaacgaagcaguuggcugauugugcugcuuguguuacucacagucucauugucaccgguccaaucagcaccuguuggucaugguaagacaaucgaaacauaucagaccagagagggauucacaaguaucugucucuuuauguuaggaagcauccuauucauaguuucuugccugguaaaggggcugguugacagugucagugacagcuucuuccccggccugucugucuguaagacaugcucuauuggcaguauaaauggcuuugaaauugaaucgcauaaaugcuacuguaguuuauuuuguugccccuacuguaggcacugcucugcugacagagaaauucaccaguugcacuugaguaucugcaaaaaaagaaaaacggggagcaaugucaugcuggcugucugcaagcgcaugugcuuuaaggcaaccauagaagcaagcagaagagcccugcucauccgaagcauuaucaauaccacuuuuguaaugugcauucuaacauuagcaaucuguguuguuagcaccucugcaguagagauggaagaccuuccagcaggcacuugggagagagaggaagaccuaacaaauuucugccaucaggaaugccaggugaccgagacggaaugccucuguccauacgaagcucuugugcucaggaaaccccuuuccuuagacaguauaguuaaagguaugaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggauuugucacaaauguauuccccuguuuuugaguacuuaucaggagauagacagguugaagaauggcccaaggcaaccugcacaggugauugcccagaaagguguggcugcacaucaucaaccugcuugcauaaagaauggccucauucaagaaacuggagauguaaucccacuuggugcuggggaguaggaaccggcugcacaugcugcggaguggauguaaaagaccuuuuuacagaccacauguuuaucaaauggaagguugaauauauaaaaaccgaagccauaguauguguugagcucaccagccaagaaagacagugcagucugauugaggcagguacuagauucaacuuggguccugugacuaucacccugucugagccaagaaacauucagcagaagcuucccccugagaucauuacgcugcaucccaaaauugaagaaggcuucuuugacuugaugcaugugcaaaaaguguuaucugcaaguacaguguguaaacugcagaguugcacacaugguauaccaggagaucuacaaauuuaccacauuggcaacuuguugaaaggggauagaguaaacggccaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccacucuaaaagagucacagcacauggagacacaccacaauuagacuuaaaagcaaggccgaccuacggugcaggugagaucacugugcugguugagguuacugacauggaguugcauaccaaaaaaguugagauaucaggcuugaaauuugcaagucugacuuguacggguugcuaugcuuguagcucuggcaucuccuguaaagucagaauucauguagaugaaccagaugagcucacagugcauguaaagagcagugauccagaugugguugcagcuagcacaagccuuauggcaaggaagcuugaauuugggacagauagcacauucaaggcauuuucagcuaugcccaaaaccucuuuaugcuuuuacauuguggagagggaauacugcaagagcugcagugaagaugauacaaaaaaauguguugacacaaaacuugagcagccacagagcauacuaauugagcacaaagggacgauaauuggaaagcagaaugauacuugcacagccaaggcaaguuguuggcuagagucagucaagaguuuuuuuuauggauugaagaauaugcuuggcaguguuuuugguaguuuuuucguaggcauuuuguuauuccuugccccuuucgucuuguuggugcuuuucuuuauguuuggauggaaaaucuuguuuugcuuuaaguguugcaggaggaccagaggcuuguuuaaguauagacacuucaaagaugacgaggaaacaggcuacagaaggauuauugaaagacugaacagcaaaaaaggaaaaaacagacugcuugauggugagagguuggcugauaggaaaauugcugagcuguucucuacaaaaacacacauuggcuaa

SEQ ID NO: 3667 - RNA, 5055 nt, Artificial Sequence
  derived and/or modified CDS sequence (wt) from CCHFV(Hy13)__AY900145.1__GP
auguacacaccacuuuugugugcuguucuuugcuuacagcuguggaguuuagaagggucucauggacuguccaacaaaacccaacacaguaauacaagcaccacaaaggcgccugaaguaagccaggaauuuggauugccugugagcacaguaucgacuaucacgucagacccuccuuccaucacauccgcaguaucagucaguggaucagaaggcucaggagacacgaacaccucucccucggucaccacacaaggccugacuuugccagaaaccacgcuggaacuccuuacaacaaccgacacagaugcaucaagcacugucgucgucgaugucagcacacagacggucaaggacacccccauaucaacaacccacacaaguuugcccaguacuccuagcgcgacaacuacaccacaggguacacaccauacugcaaggggucuacugucagucaccagcacaaagccagaaggagcaucaacacaagcaaauccagaaaaaauaagcauggagaccaauagcccgcgccuagccaucagcgagacaccauccuucucuccaacaacucaggcuccuaccgaaaacagcaaccccaucacauccaaacagcucauauucucagcacaaccaguaaccccaaacccagugaccccuccaguacagccagcccucucucagagugacacguccacggccauccaggauauacaccccagcccaacaagcagaucuaagagaaaccuugagauggaaauaauuuugacuuuaucucaggguuugaagaaguacuacggcaagauacuaaaacuucuggaccuuacuuuggaagaagacacugaaggccugcuagaguggugcaagagaaaucuugguuuggucugugaugcugacuucuuucagaagagaauagaagaguuuuuuuugacuggggagggucacuucaaugaagucuuacaguucaaaacaccaagcacacuaagccccacgggaccagcccgaacugggucaccaacaguggaaccuuuuaaauccuacuucgcuaaaggguuucuuucaauggacucaggcuacuucucugccaaguguuauccaagagcauccaauucaggacuucagcugaucaacgucacccaacauucaacuagaauaacagacacaccuggacccaaggucacuaaucugaagaccaucaauugcauaaacuuaaaggcaucagucuuuaaagagcauagagagauugaaaucaauguucuucucccucaagucgcaguuaaccucucaagcugccacguguugaucaaaucgcaugucugugacuacucuuuggacauugaugggccaguaaggcuaccccgcauccaccaugaaggaacuuucauaccaggaacuuacaaauuaguuauagacaaaaaaaacaaacaaaaugacagaugcacuuugaucaccaacuguguaauaaaaggaagggaaauucguaagggccagucaguguuaagacaauacaggacagaaaucaagauuggcaaggcaucuucugguuccagaagacuauuguccgaagagucuggugaugacugcauaucaagaacucagcuaucgaggacagagacugcggaaauucacagugauaacuauggugguccaggugacaagauaaccaucugcaaugguucaacuauuguagaucagagauugggcagugaacuaggguguuacacuaucaauagaguaaagucauuuaagcuuugcgagaacagugccacagguaaauccugugaaauagauagcaccccaauuaaaugcaggcaggguuuuuguuuaaaaauuacucaggagggaaggggccacgugaagcuaucaagagguucagaaguugucuuggacgccugugauucaagcugugagauaaugauaccaaagggcacuggagacauccuaguugacuguucagguggacagcaacauuucuuaaaagauaacuugauugaucugggaugcccaaacaucccacuauuagguaagauggcuaucuacauuuguagaaugucaaaucauccuaaaacgacuauggcuuuucuuuuuugguuuagcuuugguuaugugauaaccuguauacucuguaaggucaucuucuaccuauuaauaguuguggggacguugggaaaaaaguucaaacaguauagagaguugaaaccucagaccuguaccauaugcgaaacaacuccuguuaaugcaauagaugcugaaaugcacgaccucaacugcaguuacaauauauguccuuacugugcaucuagguuaaccucagacggucuugccagacauguaaugcagugcccuaagcggaaggaaaaaguagaagaaaccgaauuauacuuaaacuuagaaagaauccccuggguuguuaggaaauuacugcagguaucagaauccaccgguguggcacuaaagaggaguaguuggcugguugugcuacuuguguuacuuacaguuucauugucaccaguacaaucagcaccuaucggccauggaaagacaguugaaacauaucaaaccagagaaggguacacaagcauuugccuuuuuguacuaggaagcaucuuauuuauagucucuugccuaaugaagggguugguugacaguguugguaacaguuuuuucccugguucguccauuuguaagacauguucuauuggcagcauaaauggcuuugagauugaaucucacaaauguuacuguagccuauuuuguugccccuacuguagacacugcucugccgauagagaaauacauaaguugcacuugagcaucugcaagaaaaggaagacugggaguaaugucauguuggccgucuguaagcgcaugugcuuuagggcaacuguggaaguaagcaacaaggcucuacuuauccgaaacaucaucaauaccacuuuuguugugugcauacugauauuagcaguuuguguugucagcaccuccgcaguggagauggaaagccugccagcuggcacuugggagagagaggaagaucugacaaauuucugucaucaagaaugccaagccacugagacugaaugccucuguccuuacgaagcucuugugcucaggaaacccuuguuuucagacaguauugucaaaggcaugaagaacuugcuaaauucaacaagcuuagaaacaagcuuaucaauugaggcaccauggggagcuauaaauguccaaucaaccuucaaaccuacuguguccgcugcgaacauagcucuuaguuggagcucaguggaacacagggguaauaagauuuugguuucagguagaucagagucaauuaugaagcuagaggaaaggacaggaaucagcugggaucuagggguagaagaugccucugagucuaaauugcuuacugucucuauuauggacuugucacagauguauucuccugucuuugaguaccuaucaggugauagacaaguggaggaauggcccaaggcaaccugcacaggagauugcccagaaagauguggcugcacaucaucaaccugccuacacaaagaauggccccauucaagaaacuggagaugcaaccccaccugguguuggggagucggcacuggauguaccugcugugggcuggauguaaaagaccuuuuuacagaucacauguuugucaaguggaaaguugaguacauuaaaacagaagcuauaguguguguugagcuuacuagccaagagagacaauguagcuugauugaggcaggcacaagauucaacuuagguccugugaccaucacauugucagagccaagaaacauucagcaaaagcucccuccagagauaguuacauugcaucccagaauugaagaagguuucuuugauuuaaugcauguaaaaaaagugcuaucagcaaguacaguauguaagcuacagaguugcacacauggugugccaggggaccuacaggucuaccacauaggaaacuuguuaaaaggagacaaggugaaugggcaccugauucacaaaauugaaccacacuucaacacuuccuggaugucuugggacggcugugaccuagacuacuacuguaauaugggagacuggccaucuugcucauauacuggaguaacccagcacaaucaugcugcauuuguaaacaugcucaacaucgaaacugauuauacaaaaaucuuccacuuucacucuaagagaguuacugcacauggagacacaccacaauuagauuugaaagcuagaccaacuuauggugcaggugaaaucacugugcuaguggaaguugcugacauggaguuacacacaaagaaaauugagauaucagguuuaaaguuugcaagcuuaacuugcacaggcuguuaugcuuguagcucugguaucuccuguaagguuagaauccauguagaugagccugaugagcuuacaguacaugugaagagugaagacccagacauaguugcugcuagcucaagucucauggcuagaaaacuugaauuugggacagauagcacauucaaagccuuuucagccaugcccaaaaccuccuugugcuuuuacauuguggagagagaauauuguaaaagcugcaguaaagaagauacacaaaaaugugucaacacaaagcuugagcaaccacagagcauuuuaauugagcacaaaggaacgauaauugguaagcaaaacgacaccugcacaucuaaagcaggcuguuggcuagagucagucaagagcuucuuuuaugggcuaaaaaacaugcuuaguggcauuuuuggcaauguuuucauagggauuuucuuauuccuugcuccuuuuauccuuuuaauacuuuucuuuauguuuggauggagaauccuguucugcuuuaaauguugcagaagaacuagaggcuuauuuaaguacagacaccucaaggacgaugaagaaaccgguuacaggaaaaucauugagaggcugaacaacaaaaaagggaaaaacaaacugcuugauggugaaagauuagcugauaggaagauugcugagcuguucuccacaaagacacacauuggcuaa

SEQ ID NO: 3668 - RNA, 5052 nt, Artificial Sequence
  derived and/or modified CDS sequence (wt) from CCHFV(4574-ST-2008)__KR814870.1__GP
augcauacacuauuagugugcuucauucuuuaccuacagcuguuggguccaggaggagcccauggacagccaaacgcaacugaacacaacagaacaaacaccaccacagcacccagcacaagccaaagccccaagccacccgugagcacagccccaccacacgcacuggaaucacccaccaucaaauccaccacaccaacaagcgaaacagaaggcucaggggaaacgaccucacccccaaacaccacccagggcccgucucuaccagagaccacaccaaaacgccccgcaacaacugccacaaguacgccaagcacagacaacacaaauuccaccacacaugugaccgacaacaacccuacaucaacaaucagcacaaguccauccagcagccccagcacgccauccacaccacgaggcauacaucauccugcaaggaaucuauugucagucucgagcccuaagacagcaacaacaccaacaccaacgagcccuggggagauaagcucagaaaccagcagucugcacucagccaugagcagaacaucaacccucuacacagcaacccaggccuccacugaaaaugccaaccacagcgcaccuagacagucugaguccccagcacagccgacaaccacaagccuaaugaccuccccagcacaaucaauccuuguaaugagugcugcuccuacagcuauucagaacauacaucccagcccaacgaauaggucuaagaggaaccuugagauggaaauaauuuuaacucugucucaaggucuaaagaaauacuacgguaagauacugaagcuucugcaccucaccuuggaagaggacacugaaggccuguuagaaugguguaagagaaaccuugggucaaacugugaggaugacuucuuucagaagagaauagaagaauucuucaugaccggugagggcuacuucaaugaagucuuacaauuuaaaacacuaagcacacuaagccccacggagccgucucaugccaggccaccaacaguggaacccuucaaaucuuacuucgcuaagggcuuccuuucaauagauucagguuacuucucugccaaauguuauccaagaucaucuacuucagggcuucagcugaucaauguuacccaacacccagcuagaauagcagaaacaccuggacccaagacaacgagucugaaaaccaucaacuguauaaaccuaagagcaucagucuucaaagaacacagagaaauugagaucaaugugcuucuuccucagauugcagucaaccucucaaauugccauguuguaaucaauucacaugucugugauuauucuuuagacacugaugggccagugaggcuuccucacauuuaccaugaaggaacuuucauaccaggaacuuacaaaauagugauagacaaaaaaaauaagcuaaaugaccgauguacacuggucaccaacugugugauaaaaggaagagagguucguaagggccaaucagugcugaggcaguacaaaacagaaaucaagauaggcaagguaucaacaggcucuaggaaacuacuguccgaagagucaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauaccaucaacagggugaagucauucaagcuaugcgaaaacagcgccacagggaaaaccugugagauagacagcacuccgguuaagugcaggcaagguuuuuguuuaaaaaucacccaagaaggaaggggccacguaaaauuaucuagaggcucagagguuguuuuggaugcuugcgacucaagcugcgaaguaaugauaccuaaaggcacuggagauaucuugguggacuguucagguggacagcaacauuucuuaaaagacaacuuaauugaccuagggugcccccauaucccgcuauuggguaaaauggccauuuacaucugcagaaugucaaaucauccuagaacaacuauggcuuuucucuucugguucagcuuuggcuaugugaucaccuguuuauuuugcaaggcucuuuuuuauucauugauaaucauugggacacuagggaaaaagaucaagcaauauagggaauugagaccucaaaccuguaccauaugugagacagcuccugucaaugcaauagaugcugaaaugcaugaccuuaacugcaguuacaauauauguccuuauugugcaucaagauugaccuccgaugggcuagcuaggcaugugccacaaugccccaagcggaaggaaaaaguugaggagacugagcuguacuugaaccuggaaagaauaccuuggauugucagaaagcuauugcaagugucagaguccacugguguggcauugaagcgaagcagcuggcugauuguacugcuuguguuacucacaguuucauugucaccgguucaaucagcaccuguuggucaugguaagacaaucgaaacauaucagaccagagaaggauucacaaguaucugucucuuuauguuaggaagcauccuguuuuuagucucuugcuuggugaaggggcugguugacagugucagugacagcuucuuccccggccugucugucuguaagacaugcuccauuggcaguauaaauggcuuugaaauugaaucgcauaaaugcuacuguagccuacuuugcugccccuacuguaggcacugcucugcugacagagaaauccaccaguuacacuugaguaucugcaaaaaaagaaaaacggguagcaaugucaugcuggcugucugcaaacgcaugugcuuuagggcaaccauagaagcaagcagaagagcccugcucauccgaagcauuauaaauaccacuuuuguaauaugcauuuuaacauuaacaaucuguguuguuagcaccucugcaguagagauggaaaaccuuccaucaggcacuugggagaaagaggaagaccugacaaauuucugucaucaggaaugccaggugaccgagacggagugccucuguccauacgaagcucuugugcucagaaaaccucuguucuuagacaguauaguuaaaggcaugaagaauuugcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguagaagaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcuggggaguaggaacuggcugcaccugcugcgggguggauguaaaagaccuuuuuacagaucacauguuugucaaguggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcauguacaaaaaguguugucugcaaguacaguguguaaacugcagaguugcacacaugguauaccaggagaucuacaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacauugaaacugauuacacgaaaaccuuccacuuccacucuaaaagaguuacagcacauggugacacaccacaauuagacuuaaaagcaaggccaaccuacggugcaggugagaucacugugcugguugagguugcugacauggaguugcauaccaagaaaguugagauaucaggccugaaauuugcaagucuggcuugcacggguugcuaugcuuguagcucuggcaucuccuguaaagucaggauucauguagaugagccagaugagcucacaguacauguaaagagcagugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaaugauacuugcacagccaaggcaagcuguuggcuagagucagucaagaguuuuuuuuauggauugaaaaauaugcuugguaguguauuuggcaacuuuuucauaggcauuuuguuauuccuugccccuuuuguccuguuggugcuuuucuuuauguuuggauggaaaaucuuguuuugcuucaaauguugcaggagggccagaggcuugcuuaaguauagacaccuaaaagacgaugaggaaacaggcuacagaaagauuauugaaaggcugaacaacaaaaaaggaaaaaacagacugcuugauggugaaagguuggcugauaggaaaauugcugagcuguucuccacaaaaacacacauugguuaa

SEQ ID NO: 3669 - RNA, 5052 nt, Artificial Sequence
  derived and/or modified CDS sequence (wt) from CCHFV(75-ST-2010)__KR814864.1__GP
augcauacacuauuagugugcuucauucuuuaccuacagcuguuggguccaggaggagcccauggacagccaaacgcaacugaacacaacagaacaaacaccaccacagcacccagcacaagccaaagccccaagccacccgugagcacagccccaccacacgcacuggaaucacccaccaucaaauccaccacaccaacaagcgaaacagaaggcucaggggaaacgaccccacccccaaacaccacccagggcccgucucuaccagagaccacaccagaacgccccgcaacaacugccacaaguacgccaagcacagacaacacaaauuccaccacacaugugaccgacaacaacccuacaucaacaaucagcacaaguccauccagcagccccagcacgccauccacaccacgaggcauacaucauccugcaaggaaucuauugucagucucgagcccuaagacagcaacaacaccaacaccaacgagcccuggggagauaagcucagaaaccagcagucugcacucagccaugagcagaacaucaacccucuacacagcaacccaggccuccacugaaaaugccaaccacagcgcaccuagacagucugaguccccagcacagccgacaaccacaagccuaaugaccuccccagcacaaucaauccuuguaaugagugcugcuccuacagcuauucagaacauacaucccagcccaacgaauaggucuaagaggaaccuugagauggaaauaauuuuaacucugucucaaggucuaaagaaauacuacgguaagauacugaagcuucugcaccucaccuuggaagaggacacugaaggccuguuagaaugguguaagagaaaccuugggucaaacugugaugaugacuucuuucagaagagaauagaagaauucuucaugaccggugagggcuacuucaaugaagucuuacaauuuaaaacacuaagcacacuaagccccacggagccgucucaugccaggccaccaacaguggaacccuucaaaucuuacuucgcuaagggcuuccuuucaauagauucagguuacuucucugccaaauguuauccaagaucaucuacuucagggcuucagcugaucaauguuacccaacacccagcuagaauagcagaaacaccuggacccaagacaacgagucugaaaaccaucaacuguauaaaccuaagagcaucagucuucaaagaacacagagaaauugagaucaaugugcuucuuccucagauugcagucaaccucucaaauugccauguuguaaucaauucacaugucugugauuauucuuuagacacugaugggccagugaggcuuccucacauuuaccaugaaggaacuuucauaccaggaacuuacaaaauagugauagacaaaaaaaauaagcuaaaugaccgauguacacuggucaccaacugugugauaaaaggaagagagguucguaagggccaaucagugcugaggcaguacaaaacagaaaucaagauaggcaagguaucaacaggcucuaggaaacuacuguccgaagagucaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauaccaucaacagggugaagucauucaagcuaugcgaaaacagcgccacagggaaaaccugugagauagacagcacuccgguuaagugcaggcaagguuuuuguuuaaaaaucacccaagaaggaaggggccacguaaaauuaucuagaggcucagagguuguuuuggaugcuugcgacucaagcugcgaaguaaugauaccuaaaggcacuggagauaucuugguggacuguucagguggacagcaacauuucuuaaaagacaacuuaauugaccuagggugcccccauaucccgcuauuggguaaaauggccauuuacaucugcagaaugucaaaucacccuagaacaacuauggcuuuucucuucugguucagcuuuggcuaugugaucaccuguuuauuuugcaaggcucuuuuuuauucauugauaaucauugggacacuagggaaaaagaucaagcaauauagggaauugagaccucaaaccuguaccauaugugagacagcuccugucaaugcaauagaugcugaaaugcaugaccuuaacugcaguuacaauauauguccuuauugugcaucaagauugaccuccgaugggcuagcuaggcaugugccacaaugccccaagcggaaggaaaaaguugaggagacugagcuguacuugaaccuggaaagaauaccuuggauugucagaaagcuauugcaagugucagaguccacugguguggcauugaaacgaagcagcuggcugauuguacugcuuguguuacucacaguuucauugucaccgguucaaucagcaccuguuggucaugguaagacaaucgaaacauaucagaccagagaaggauucacaaguaucugucucuuuauguuaggaagcauccuguuuuuagucucuugcuuggugaaggggcugguugacagugucagugacagcuucuuccccggccugucugucuguaagacaugcuccauuggcaguauaaauggcuuugaaauugaaucgcauaaaugcuacuguagccuacuuugcugccccuacuguaggcacugcucugcugacagagaaauccaccaguuacacuugaguaucugcaaaaaaagaaaaacggguagcaaugucaugcuggcugucugcaaacgcaugugcuuuagggcaaccauagaagcaagcagaagagcccugcucauccgaagcauuauaaauaccacuuuuguaauaugcauuuuaacauuaacaaucuguguuguuagcaccucugcaguagagauggaaaaccuuccaucaggcacuugggagaaagaggaagaccugacaaauuucugucaucaggaaugccaggugaccgagacggagugccucuguccauacgaagcucuugugcucagaaaaccucuguucuuagacaguauaguuaaaggcaugaagaauuugcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguagaagaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcuggggaguaggaacuggcugcaccugcugcgggguggauguaaaagaccuuuuuacagaucacauguuugucaaguggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcauguacaaaaaguguugucugcaaguacaguguguaaacugcagaguugcacacaugguauaccaggagaucuacaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacauugaaacugauuacacgaaaaccuuccacuuccacucuaaaagaguuacagcacauggugacacaccacaauuagacuuaaaagcaaggccaaccuacggugcaggugagaucacugugcugguugagguugcugacauggaguugcauaccaagaaaguugagauaucaggccugaaauuugcaagucuggcuugcacggguugcuaugcuuguagcucuggcaucuccuguaaagucaggauucauguagaugagccagaugagcucacaguacauguaaagagcagugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaaugauacuugcacagccaaggcaagcuguuggcuagagucagucaagaguuuuuuuuauggauugaaaaauaugcuugguaguguauuuggcaacuuuuucauaggcauuuuguuauuccuugccccuuuuguccuguuggugcuuuucuuuauguuuggauggaaaaucuuguuuugcuucaaauguugcaggagggccagaggcuugcuuaaguauagacaccuaaaagacgaugaggaaacaggcuacagaaagauuauugaaaggcugaacaacaaaaaaggaaaaaacagacugcuugauggugaaagguuggcugauaggaaaauugcugagcuguucuccacaaaaacacacauugguuaa

SEQ ID NO: 3670 - RNA, 5052 nt, Artificial Sequence
  derived and/or modified CDS sequence (wt) from CCHFV(37-R-2013)__KR814858.1__GP
augcauacgcuauuagugugcuucauucuuuaccuacagcuguugggucuaggaggagcucauagacagucaaacgcaacugaacacaacggaacaaacaccaccacagcacccagcacaagccaaagccccaagccaccugugagcacagccccaccacacgcaccagaaacauccaccaucaaacccaccacaccagcaagcgaaacagaaggcucaggggaaacgaccccacccccaaacaccacccagggcccgucuccaccagaggccacaccagaacgccccgcaacaacugucacaaguacgccaagcacagacaacacgaacuccaccacacacgcgaccgacaacaacccuacaucaacaaucagcacaaguccauccagcagccccagcacgccauccacaccacaaggcauacaucauccugcaaggaaucuauugucagucucgagcccuaagacagcaacaacaccaacaccaacgagcccuggggauauaagcucagaaaccagcagucugcacucagccaugagcagaacaccaacccuccacacagcaacccaggccuccacugaaaaugccaaccacagcgcaccuagacagucugaguccucagcacagcagacaaccacaagcccaaugacuuccccagcacaaccaauccuuguaaugagugcugcuccuacagcuauucagaacauacaucccagcccaacgaauaggucuaagaggaaccuugagauggaaauaauuuuaacucugucucaaggucuaaagaaauacuaugguaagauacugaagcuucugcaccucaccuuggaagaggacacugaaggccuguuagaaugguguaagagaaaccuugggucaaacugugaugaugacuucuuucagaagagaauagaagaauucuucaugaccggugagggcuacuucaaugaagucuuacaauuuaaaacacuaagcacacuaagccccacggagccgucucaugccaggccaccaacaguggaacccuucaaaucuuacuucgcuaagggcuuccuuucaauagauucagguuacuucucugccaaauguuauccaagauuaacuacuucagggcuucagcugaucaaugucacccaacacccagcuagaauagcagaaacaccuggacccaagacaacaagucugaaaaccaucaacuguauaaaccuaagagcaucagucuucaaagaacacagagaaauugagaucaaugugcuccuuccucagauugcagucaaccucucaaauugccauguuguaaucaauucacaugucugugauuauucuuuagacacugaugggccagugaggcuuccucacauuuaccaugaagggacuuucauaccaggaacuuauaaaauagugauagacaaaaaaaauaagcuaaaugaccgauguacacuggucaccaacugugugauaaaaggaagagagguucguaagggccaaucagugcugaggcaguacaaaacagaaaucaagauaggcaaggcaucaacaggcucuaggaaacuacuguccgaggagccaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauaccaucaacagggugaagucauucaagcuaugcgaaaacagcgccacagggaaaaccugugagauagacagcacuccgguuaagugcaggcaagguuuuuguuuaaaaaucacccaagagggaaggggccacguaaaauuaucuagaggcucagagguuguuuuggaugcuugcgacacaagcugcgaaguaaugauaccuaaaggcacuggagauauccugguggacuguucagguggacagcaacauuucuuaaaagacaauuuaauugaccuagggugcccccauaucccgcuauuggguaaaauggccauuuacaucugcagaaugucaaaucauccuagaacaacuauggcuuuucucuucugguucagcuuuggcuaugugaucaccuguauauuuugcaaggcucuuuuuuauucauugauaauuauugggacacuagggaaaaagaucaagcaauauagggaauugaaaccucaaacuuguaccauaugugagacagcuccugucaaugcaauagacgcugaaaugcaugaccuuaacugcaguuacaauauaugcccuuauugugcaucaagauugaccuccgaugggcuagcuaggcaugugccacaaugccccaagcggaaggaaaaaguugaggagacugagcuguacuugaaccuggaaagaauuccuuggauugucagaaagcuauugcaagugucagaguccacugguguggcauugaaacgaagcagcuggcugauuguacugcuuguguuacucacaguuucauugucaccgguucaaucagcaccuguuggucaugguaagacaaucgaaacauaucagaccagagaaggauucacaagugucugucucuuuauguuaggaagcauccuguuuuuagucucuugcuuggugaaggggcugguugacagugucagugacagcuucuuccccggccugucugucuguaagacaugcucuauuggcaguauaaauggcuuugaaauugaaucgcauaaaugcuacuguagccuauuuugcugccccuacuguaggcacugcucugcugacagagaaauucaucaguuacacuugaguaucugcaaaaaaagaaaaauggguagcaaugucaugcuggcugucugcaaacgcaugugcuuuagggcaaccauagaagcaagcagaagagcccugcucauccgaagcauuauaaauaccacuuuuguaauaugcauuuuaacauugacaaucuguguuguuagcaccucugcaguagagauggaaaaccuuccaucaggcacuugggagagagaggaagaccugacaaauuucugucaucaggaaugccagguaaccgagacggagugccucuguccauacgaagcucuugugcucagaaaaccucuguucuuagacaguauaguuaaaggcaugaagaauuugcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguagaugaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaacuugcuugcauaaagaauggccucacucaagaaacuggagauguaaucccacuuggugcuggggaguaggaacuggcugcaccugcugcgggguggauguaaaagaccuuuuuacagaucacauguuugucaaauggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcaugugcaaaaaguguugucugcaaguacaguguguaaacugcagaguugcacacaugguauaccaggagaucuacaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaauaucgaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcauaccaagaaaguugagauaucaggcuuaaaauuugcaagucuggcuugcacggguugcuaugcuuguagcucuggcaucuccuguaaagucaggauucauguagaugagccagaugagcucacaguacauguaaagagcaaugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaauguuacuugcacagccaaggcaagcuguuggcuagagucagucaagaguuuuuuuuauggauugaaaaauaugcuugguaguguauuugguaacuuuuucauaggcauuuuguuauuccuugccccuuuuguccuguuggugcuuuucuuuauguuuggauggaaaaucuuguuuugcuucaaauguugcaggaggaccagaggcuuacuuaaguauagacuccucaaagacgaugaggaaacaggcuacagaaggauuauugaaagacugaacaacaaaaaaggaaaaaacagacugcuugauggugaaagguuggcugauaggaaaauugcugagcuguucuccacaaaaacacacauugguuaa

SEQ ID NO: 3671 - RNA, 5052 nt, Artificial Sequence
  derived and/or modified CDS sequence (wt) from CCHFV(Kashmanov)__DQ211631.1__GP
augcauacacuauuagugugcuucauucuuuaccuacagcuguugggucuaggaggagcucauggacagucaaacgcaacugaacacaacggaacaaacaccaccacagcacccagcacaagucaaagccccaagccacuugugagcacagccccaccacacgcacuggaaucauccaccaucaaacccaccacaccagcaagcgaaacagaaggcucaggggaaacgaccccacccccaaacaccacccagggcccgucuccaccagagaccacaccagaacgccccgcaacaacugccacaaguacgccaagcacagacaacacgaauuccaccacacaugugaccgacaacaacccuacaucaacaaucagcacaaguccauccagcagccccagcacgccauccacaccacaaggcauacaucauccugcaaggaaucuauugucagucucgagcccuaagacagcaacaacaccaacaccaacgagcccuggggagauaagcucagaagccagcagucugcacucagccaugagcagaacaucaacccucuacacagcaacccaggucuccacugaaaaugccaaccacagcgcaccuagacagucugaguccucagcacagccgacaaccacaagcccaaugacuuccccagcacaaucaauccuuguaaugagugcugcuccuauagcuauucagaacauacaucccagcccaacgaauaggucuaagaggaaccuugagauggaaauaauuuuaacucugucucaaggucuaaagaaauacuacgguaagauacugaagcuucugcaccucaccuuggaagaggacacugaaggccuguuagaaugguguaagagaaaccuugggucaaacugugaugaugacuucuuucagaagagaauagaagaauucuucaugaccggugagggcuacuucaaugaagucuuacaauuuaaaacacuaagcacacuaagccccacggagccgucucaugccgggccaccaacaguggaacccuucaaaucuuacuucgcuaagggcuuccuuucaauagauucagguuacuucucugccaaauguuauccaagaucaucuacuucagggcuucagcugaucaauguuacccaacacccagcuagaauagcagaaacaccuggacccaagacaacaagucugaaaaccaucaacuguauaaaccuaagagcaucagucuucaaagaacacagagaaauugagaucaaugugcuucuuccucagauugcagucaaccucucaaauugccauguuguaaucaauucacaugucugugauuauucuuuagacacugaugggccagugaggcuuccucacauuuaccaugaagggacuuucauaccaggaacuuauaaaauagugauagacaaaaaaaauaagcuaaaugaccgauguacacuggucaccaacugugugauaaaaggaagagagguucguaagggccaaucagugcugaggcaguacaaaacagaaaucaagauaggcaaggcaucaacaggcucuaggaaacuacuguccgaggagccaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauaccaucaacagggugaagucauucaagcuaugcgaaaacagcgccacagggaaaaccugugagauagacagcacuccgguuaagugcaggcaagguuuuuguuuaaaaaucacccaagagggaaggggccacguaaaauuaucuagaggcucagagguuguuuuggaugcuugcgacucaagcugcgaaguaaugauaccuaaaggcacuggagauauccugguggacuguucagguggacagcaacauuucuuaaaagacaacuuaauugaccuagggugcccccauaucccgcuauuggguaaaauggccauuuacaucugcagaaugucaaaucauccuagaacaacuauggcuuuucucuucugguucagcuuuggcuaugugaucaccuguauauuuugcaaggcucuuuuuuauucauugauaauuauugggacacuagggaaaaagaucaagcaauauagggaauugaaaccucaaacuuguacuauaugugagacagcuccugucaaugcaauagacgcugaaaugcaugaccuuaacugcaguuacaauauaugcccuuauugugcaucaagauugaccuccgaugggcuagcuaggcaugugccacaaugccccaagcggaaggaaaaaguugaggagacugagcuguacuugaaccuggaaagaauuccuuggauugucagaaagcuauugcaagugucagaguccacugguguggcauugaaacgaagcagcuggcugauuguacugcuuguguuacucacaguuucauugucaccgguucaaucagcaccuguuggucaugguaagacaaucgaaacauaucagaccagagaaggauucacaaguaucugucucuuuauguuaggaagcauccuguuuuuagucucuugcuuggugaaggggcugguugacagugucagugacagcuucuuccccggccugucugucuguaagacaugcacuauuggcaguauaaauggcuuugaaauugaaucgcauaaaugcuacuguagccuauuuugcugccccuacuguaggcacugcucugcugacagagaaauucaccaguuacacuugaguaucugcaaaaaaagaaaaacggguagcaaugucaugcuggcugucugcaaacgcaugugcuuuagggcaaccauagaagcaagcagaagagcccugcucauccgaagcauuauaaauaccacuuuuguaauaugcauuuuaacauugacaaucuguguuguuagcaccucugcaguagagauggaaaaccuuccaucaggcacuugggagagagaggaagaccugacaaauuucugucaucaggaaugccagguaaccgagacggagugccucuguccauacgaagcucuugugcucagaaaaccucuguucuuagacaguauaguuaaaggcaugaagaauucgcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguagaagaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcuggggaguaggaacuggcugcaccugcugcgggguggauguaaaagaccuuuuuacagaucacauguuugucaaauggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcaugugcaaaaaguguugucugcaaguacaguguguaaacugcagaguugcacacaugguauaccaggagaucuacaaguuuaccacauuggcaacuugcugaaaggggauaggauaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacauugaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcauaccaagaaaguugagauaucaggcuugaaauuugcaagucuggcuugcacggguugcuaugcuuguagcucuggcaucuccuguaaagucaggauucauguagaugagccagaugagcucacaguacauguaaagagcagugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaaugauacuugcacagccaaggcaagcuguuggcuagagucagucaagaguuuuuuuuauggauugaaaaauaugcuugguaguguauuugguaacuuuuucauaggcauuuuguuauuccuugccccuuuuguccuguuggugcuuuucuuuauguuuggauggaaaaucuuguuuugcuucaaauguugcaggaggaccagaggcuuacuuaaguauagacaccucaaagacgaugaggaaacaggcuacagaaggauuauugaaagacugaacaacaaaaaaggaaaaaacagacugcuugauggugaaagguuggcugauaggaaaauugcugagcuguucuccacaaaaacacacauugguuaa

SEQ ID NO: 3672 - RNA, 5052 nt, Artificial Sequence
  derived and/or modified CDS sequence (wt) from CCHFV(Haskovo-V46/13)__KR092379.1__GP
augcauacacuauuagugugcuucauucuuuaccuacagcuguugggucuaggaggagcucauggacagucaaacacaacugaacacaauggaacaaacaacaccacagcacccggcacaagccaaagccccaagccacacaugagcacaaccccaccacacgcaccggaaucauccaccaucaaacccaccacgccaacaagcgaaacagaaggcucaggggaaacgaccccacccucaaauaccacccagggcccguccccaccagagaccacaucggaacgcccugcaacaaccgccauaagcacgucaagcacagacaacaugaaccccaccucacagaugacugacaacacccccacaucaacagucagcauaagcccauccagcagccccagcacgccauccacaccacaaggcaugcaucauccugcaaggagucuauugucagucucgagcccuaagacagcaacaacaccaacaccaacgagcccuguagaggugggcucggaaaccagcagucagcacucagccaugagcaguacaccaaccccccacacagcaacucaggucuccacugagaacaccaaccacagcacaccuagacaaucugagcccucagcacagcagacaaccccaagcccaaugccuuccccagcgcaaucgacccuucuaaugagugcugccccuacagcuguucagaacacacaucccagcccaacgaacaggucuaagaggaaccuugagauggaaauaauuuuaacucugucacaaggucuaaagaaauacuacgguaagauacugaagcuucugcaucucaccuuagaagaggacaccgaaggccuguuggaaugguguaagagaaaccuugggucaaacugugaugaugacuucuuucaaaagagaauagaagaauucuucaugacuggugagggcuacuuuaaugaagucuuacaauuuaaaacacuaagcacacuaagccccauggagccgucucaugcugagcuaccaacagcagaacccuucaaaucuuacuucgcuaagggcuuccuuucaauagauucgggcuacuucucugccaaauguuauccaagaucaucuacuucagggcuucagcugaucaauguuacccaacacccagcuaggauagcagaaacaccuggacccaagacaacgagucugaaagccaucaacuguauaaaccuaagagcaucagucuucaaagaacacagagaaauugagaucaaugugcuucuuccucagauugcagucaaccucucaaacugccauguugugaucaauucacaugucugugauuacucuuuagacacugaugggccagugaggcuuccucacauuuaucaugaagggaccuucauaccaggaacuuauaaaauagugauagacaaaaaaaauaagcuaaaugaccgauguacacuggucaccaacugugugauaaagggaagagagguucgcaagggccaaucggugcugaggcaguacaaaacagaaaucaagauaggcaaggcaucaacaggcucuaggaaacuacuguccgaagagcuaggugaugacuguauaucaagaacucagcuauugaggacagaaacagcagagauacaugaugacaacuauggugguccaggugauaaaauaacuaucugcaaugguucaaccauuguagaucagagacugggcagugaacuaggauguuauaccaucaacagggggaagucauucaagcuaugcgaaaacagcgcuacagggaaaaccugugagauagacagcacuccgguuaagugcaggcaagguuuuuguuuaaaaaucacccaagagggaaggggccacguaaaauuaucuagaggcucagagguuguccuggaugcuugcgacucaagcugugaaguaaugauaccuaaaggcacuggagauauccuaguggacuguucaggugggcagcaacauuucuuaaaagacaacuuaauugaccuagggugcccccauaucccgcuauuggguaagauggcuauuuacauuugcagaaugucuaaucauccuagaacaaccauggcuuuucucuucugguuuagcuuuggcuaugugaucacuuguauauuuugcaaggcucuuuuuuauucauugauaauuauugggacacuagggaaaaaaaucaagcaauauagggaacugaaaccucaaaccugcaccauaugugagacaacuccugucaaugcaauagaugcugaaaugcaugaccucaacuguaguuacaauauaugcccuuauugugcaucaagauugaccuccgaugggcuagccaggcauguaacacaaugccccaagcggaaagagaaaguugaggagacugaacuguaccugaaccuggaaagaauuccuuggauugucagaaagcuauugcaggugucagaguccaccgguguggcauugaaacgaagcagcuggcugauuguacugcuuguguuacucccaguuucauugucgccgguucaaucagcaccuguuggucauggaaagacaaucgaaacauaucagaccagagaaggauucacaagcaucugucucuuuauguuaggaagcauucuauuuauaguuucuugcuuggugaaagggcugguugacaguguuggugacagcuucuuccccggccugucugucuguaagacaugcucuauuggcaguauaaauggcuuugaaauugaaucgcauaaaugcuacuguagccuauuuugcugccccuacuguaggcacugcucugcugacagagaaauucaccagcuacacuugaguaucugcaaaaaaaggaaaacggggagcaaugucaugcuggcugucugcaaacgcaugugcuuuagggcaaccauagaagcaagcagaagagccuugcucauccgaagcauuaucaauaccacuuuugcaaugugcauucuaacauugacaaucuguguuguuagcaccucugcaguagagauggaaaaccuuccagcagguacuugggagagagaggaagaccugacaaauuucugucaucaggaaugccagguaacugagacggagugccucuguccauacgaagcucuugugcucagaaagccccuuuucuuagacaguauaguuaaagguaugaaaaauuugcuaaacucaacaagcuuggaaacaagcuuaucaauugaggcaccauggggagcaauaaauguccagucaaccuuuaaaccaacaguaucgacugcaaacauagcacucaguuggagcucaguggagcacagaggcaacaagaucuuagucacaggcaggucugaaucaaucaugaaacuagaggaaaggacaggagucagcugggaucuaggcguagaagaugccucagaauccaaauuacuuaccguuucuaucauggauuuaucacaaauguauuccccuguuuuugaguacuugucaggggacagacagguugaagaauggccaaaagcaacuuguacaggugauugcccagaaagguguggcugcacaucaucaaccugcuuacauaaagaauggccucacucaagaaacuggagaugcaaucccacuuggugcuggggaguaggaaccggcugcaccuguugcgggguggauguaaaagaccuuuuuacggaucacauguucgucaaauggaaaguugaauacauaaaaacugaagccauaguauguguugagcucaccagccaagaaagacagugcagucugauugaggcagguacuagauucaacuugggcccugugacuauuacccugucugagccaagaaacauucagcagaagcuucccccugaaauuaucacguugcaucccaaaauugaagaaggcuucuuugacuugaugcauguacaaaaaguguugucugcaaguacaguguguaaacugcagaguugcacacaugguauaccaggagaucuacaaguuuaccacauuggcaacuuguugaaaggggauagaguaaacgggcaucuaauucacaaaauugaaccacauuucaacaccucuuggauguccugggaugguugugauuuagauuacuacugcaacaugggggauuggccuucuugcacauacacaggagugacccagcauaaccaugcugcauuuguaaacuugcuuaacauugaaacugauuacacgaaaaccuuccacuuccacucuaaaagaguuacagcacauggugacacaccacaauuggacuuaaaagcaaggccgaccuacggugcaggugagaucacugugcugguugagguugcugacauggaguugcauaccaagaaaguugaaauaucaggcuugaaauuugcaaguuugacuugcacggguugcuaugcuuguagcucuggcaucuccugcaaaguuaggauucauguagaugaaccagaugagcuuacaguacauguaaagagcagugauccugaugugguugcagcuggcacaagucuuauggcgaggaagcuugaauuuggaacagacagcacauucaaggccuuuucagcuaugcccaaaaccucuuuauguuuuuacauuguggagagagaauacugcaagagcugcagugaagaugauacacaaaaauguguugacacaaaacuugagcagccacagagcauacuaauugagcacaaaggaacaauaauuggaaagcagaaugauacuugcacagccagggcaagcuguuggcuagagucagucaagaguuuuuuuuauggauugaagaauaugcuuggcaguguuuuugguaauuuuuuaauaggcauuuuguuauuccuugccccuuuuguccuguuggugcuuuucuuuauguuuggguggaaaaucuuguuuugcuuuaaauguugcaggaggaccagaggcuuauucaaauauagacaccucaaagacgaugaggaaacaggcuacagaaggauuauugaaagacugaacagcaaaaaagggaaaaacagacugcuugauggugaaaggcuggcugauaggaaaauugcugagcuguucuccacaaaaacacacauuggcuaa

SEQ ID NO: 3673 - RNA, 5052 nt, Artificial Sequence
  derived and/or modified CDS sequence (wt) from CCHFV(Min)__KX013481.1__GP
augcauacacuauuagugugcuucauucuuuaccuacagcuguugggucuaggaggagcucauggacagucaaacgcaacugaacacaacggaacaaacaccaccacagcacccagcacaagucaaagccccaagccacuugugagcacagccccaccacacgcacuggaaucauccaccaucaaacccaccacaccagcaagcgaaacagaaggcucaggggaaacgaccccacccccaaacaccacccagggcccgucuccaccagagaccacaccagaacgccccgcaacaacugccacaaguacgccaagcacagacaacacgaauuccaccacacaugugaccgacaacaacccuacaucaacaaucagcacaaguccauccagcagccccagcacgccauccacaccacaaggcauacaucauccugcaaggaaucuauugucagucucgagccuuaagacagcaacaacaccaacaccaacgagcccuggggagauaagcucagaaaccagcagucugcacucagccaugagcagaacaucaacccucuacacagcaacccaggucuccacugaaaaugccaaccacagcgcaccuagacagucugaguccucagcacagccgacaaccacaaguccaaugacuuccccagcacaaucaauccuuguaaugagugcugcuccuauagcuauucagaacauacaucccagcccaacgaauaggucuaagaggaaccuugagauggaaauaauuuuaacucugucucaaggucuaaagaaauacuacgguaagauacugaagcuucugcaccucaccuuggaagaggacacugaaggccuguuagaaugguguaagagaaaccuugggucaaacugugaugaugacuucuuucagaagagaauagaagaauucuucaugaccggugagggcuacuucaaugaagucuuacaauuuaaaacacuaagcacacuaagccccacggagccgucucaugccaggccaccaacaguggaacccuucaaaucuuacuucgcuaagggcuuccuuucaauagauucagguuacuucucugccaaauguuauccaagaucaucuacuucagggcuucagcugaucaauguuacccaacacccagcuagaauagcagaaacaccuggacccaagacaacgagucugaaaaccaucaacuguauaaaccuaagagcaucagucuucaaagaacacagagaaauugagaucaaugugcuucuuccucagauugcagucaaccucucaaauugccauguuguaaucaauucacaugucugugauuauucuuuagacacugaugggccagugaggcuuccucacauuuaccaugaagggacuuucauaccaggaacuuauaaaauagugauagacaaaaaaaauaagcuaaaugaccgauguacacuggucaccaacugugugauaaaaggaagagagguucguaagggccaaucagugcugaggcaguacaaaacagaaaucaagauaggcaaggcaucaacaggcucuaggaaacuacuguccgaggagccaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauaccaucaacagggugaagucguucaagcuaugcgaaaacagcgccacagggaaaaccugugagauagacagcacuccgguuaagugcaggcaagguuuuuguuuaaaaaucacccaagagggaaggggccacguaaaauuaucuagaggcucagagguuguuuuggaugcuugcgacucaagcugcgaaguaaugauaccuaaaggcacuggagauauccugguggacuguucagguggacagcaacauuucuuaaaagacaacuuaauugaccuagggugcccccauaucccgcuauuggguaaaauggccauuuacaucugcagaaugucaaaucauccuagaacaacuauggcuuuucucuucugguucagcuuuggcuaugugaucaccuguauauuuugcaaggcucuuuuuuauucauugauaauuauugggacacuagggaaaaagaucaagcaauauagggaauugaaaccucaaacuuguacuauaugugagacagcuccugucaaugcaauagacgcugaaaugcaugaccuuaacugcaguuacaauauaugcccuuauugugcaucaagauugaccuccgaugggcuagcuaggcaugugccacaaugccccaagcggaaggaaaaaguugaggagacugagcuguacuugaaccuggaaagaauuccuuggauugucagaaagcuauugcaagugucagaguccacugguguggcauugaaacgaagcagcuggcugauuguacugcuuguguuacucacaguuucauugucaccgguucaaucagcaccuguuggucaugguaagacaaucgaaacauaucagaccagagaaggauucacaaguaucugucucuuuauguuaggaagcauccuguuuuuagucucuugcuuggugaaggggcugguugacagugucagugacagcuucuuccccggccugucugucuguaagacaugcacuauuggcaguauaaauggcuuugaaauugaaucgcauaaaugcuacuguagccuauuuugcugccccuacuguaggcacugcucugcugacagagaaauucaccaguuacacuugaguaucugcaaaaaaagaaaaacggguagcaaugucaugcuggcugucugcaaacgcaugugcuuuagggcaaccauagaagcaagcagaagagcccugcucauccgaagcauuauaaauaccacuuuuguaauaugcauuuuaacauugacaaucuguguuguuagcaccucugcaguagagauggaaaaccuuccaucaggcacuugggagagagaggaagaccugacaaauuucugucaucaggaaugccagguaaccgagacggagugccucuguccauacgaagcucuugugcucagaaaaccucuguucuuagacaguauaguuaaaggcacgaagaauuugcuaaacucaacaagcuuagaaacaagcuuaucaauugaggcaccauggggagcaauaaauguccagucaaccuuuaaaccaacagugucgacugcaaacauagcacucaguuggagcucaguggagcacaggggcaacaagaucuuagucacaggcaggucugaaucaauuaugaaacuggaggaaaggacaggagucagcugggaucuaggcguagaagaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaauccuacuuggugcuggggaguaggaacuggcugcaccugcugcgggguggauguaaaagaccuuuuuacagaucacauguuugucaaauggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcaugugcaaaaaguguugucugcaaguacaguguguaaacugcagaguugcacacaugguauaccaggagaucuacaaguuuaccacauuggcaacuugcugaaaggggauaggauaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacauugaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcauaccaagaaaguugagauaucaggcuugaaauuugcaagucuggcuugcacggguugcuaugcuuguagcucuggcaucuccuguaaagucaggauucauguagaugagccagaugagcucacaguacauguaaagagcagugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaaugauacuugcacagccaaggcaagcuguuggcuagagucagucaagaguuuuuuuuauggauugaaaaauaugcuugguaguguauuugguaacuuuuucauaggcauuuuguuauuccuugccccuuuuguccuguuggugcuuuucuuuauguuuggauggaaaaucuuguuuugcuucaaauguugcaggaggaccagaggcuuacuuaaguauagacaccucaaagacgaugaggaaacaggcuacagaaggauuauugaaagacugaacaacaaaaaaggaaaaaacagacugcuugauggugaaagguuggcugauaggaaaauugcugagcuguucuccacaaaaacacacauugguuaa

SEQ ID NO: 3674 - RNA, 5052 nt, Artificial Sequence
  derived and/or modified CDS sequence (wt) from CCHFV(Kosovo/9553/2001)__AY675511.1__GP
augcauacacuauuagugugcuucauucuuuaccuacagcuguugggucuaggaggagcucauggacagucaaacgcaacugaacacaauggaacaaacaccaccacagcacccggcacaagucaaagccccaagccacccgcgagcacaaccccaucacacgcaccggaaucauccaccaucaaacucaccacaccaacaagcgaaacagaaggcucaggggaaacgaccccacccacaagcaccacccagggcucgcccccacuagagaccacaccagaacgcucuacaacaaccgccacaagcacaucaggcacagacaacaugaacuccaccacacagaugaccgacaacacccccacacuaacagccagcacaaguccauccagcagccccagcacgccauccacaucacaaggccugcauuauccgguaaggagucuauugucagucucgagcccuaagacaguaacaacaccaacaccaaugagcccuggagagaugagcucggaaaccagcagucagcacucagccaugagcagaacaccaaccccccacacagcaacccaggucuccacugagaacgccaaccgcagcacauccagacagucugaguccucagcacagccggcaacccaaagcccagugacuuccccagcgcaaucaauccuuuugaugagugcuacucccacaaccauucagaacauacaucccagcccaacaaacagguccaagaggaaccuugagauggaaauaauuuuaacucugucucaaggucugaagaaauacuaugguaaaauacugaagcuucugcaccuuacccuggaagaggacacugaaggcuuguuggaaugguguaagagaaaccuugggucgaacugugaugaugacuucuuucaaaagaggauagaagaauucuucauaacuggugagggcuacuucaaugaaguccuacaguuuaaaacacuaagcacaccaagccccacggagccgucucaugccaggcuaccaacagcggaacccuucaaaucuuacuucgcuaagggcuuccucucaauagauucggguuacuuuucugccaaauguuauccaagaucauccacuucagggcuucagcugaucaauguuacucaacacccugcuaggauagcagagacaccugggcccaaaaucacgagucugaaaaccaucaacugcaucaaucuaagagcaucugucuucaaagaacacagagaaguugaaaucaaugugcuucuuccucaaauugcagucaaccucucaaacugccauguugugaucaauucacaugucugugauuacucuuuagacacugaugggccagugaggcuuccucgcauuuaccaugaagggacuuucaugccaggaacuuauaaaauagugauagacaggaaaaauaagcuaaaugaccgauguacgcuagucaccaacugugugauaaaggggagagaaguucguaagggccaaucagugcugaggcaguacaaaacagaaauuaaaauaggcaaggcaccaacaggcucuaggaaacuacuguccgaagagccaggugaugacugcauaucaaggacucagcuauugaggacagaaacagcagagauccaugacgauaacuauggugguccaggugacaaaauaacuaucugcaaugguucgaccauuguagaucagagacugggcagugaacuaggguguuauaccaucaacagggugaagucauucaagcuaugcgaaaacagcgccacagggaaaaccugugagauagacagcacuccaguuaagugcaggcaagguuuuuguuuaaaaaucacccaagagggaaggggccacguaaaauuaucuagaggcucagagguugucuuggacgcuugcgacucaagcugugaaguaaugauacccaaaggcacuggagauauccuaguagacugcucugguggacagcagcauuucuuaaaagacaacuugauugaccuagggugcccucauaucccacuauuggguaagauggccauuuacauugccagaaugucaaaucauccuaaaacaaccauggcuuuucucuucugguucaguuugggcuaugugaucaccuguauacuuugcaaggcucuuuuuuauucauugauaauuauugggacacuagggaaaaaaaucaagcaauauagggaacugaaaccucaaacuugcaccauaugugagacagcuccugucaaugcaauagaugcugaaaugcaugaccucaacuguaguuacaauauaugccccuauugugcaucaagauugaccucugaugggcuagcuaggcauguaaagcagugcccuaagcgaaaggagaaagucgaggagacugagcuguaccugaaccuggaaagaauuccuugggucgucagaaagcuauugcaagugucagaguccacugguguggcauugaaacgaagcaguuggcugauugugcugcuuguguuacucacaguuucauugucaccgguucaaucagcacccguuggucaugguaagacaaucgaaacauaucagaccagagaaggauucacaaguauuugucucuuuauguuaggaagcauccuauucauagucuccugcuuggugaaagggcugguugacagugucagugacagcuucuucccuggccugucugucuguaaaacaugcuccauuggcaguauaaauggcuuugaaauugaaucgcauaaaugcuacuguagcuuguucugcugccccuauuguagacacugcucugcugacagagaaauucaccaauugcacuugaguaucugcaaaaaaagaaaaacagggagcaaugucaugcuagcugucugcaagcgcaugugcuuuagagcaaccauagaagcaagcagaagagcccugcucauccgaaguauuaucaauaccacuuuuguaauaugcauucuaacauuaacaaucuguguugcuaguaccucugcaguagagauggaaacccuuccagcagccaccugggagagagaggaagaccugacaaauuucugucaucaggaaugccagguacccgagacggaaugccuuugcccauacgaagcucuugugcucaggaaaccucuuuucuuagacaguauagucaaagguaugaaaaauuugcuaaacucaacaagcuuggaaacaagcuuaucaauugaggcaccauggggagcaauaaauguccagucaaccuuuaaaccaacaguaucgacugcgaacauagcacucaguuggagcucaguggagcacagaggcaacaagaucuuagucacaggcaggucugaaucaauuaugaaacuagaggaaaggacaggagucagcugggaucuagggguagaagaugccucugaauccaaauuacuuaccgucucuaucauggauuugucacagauguauuccccaguuuuugaguacuugucuggagacagacagguugaagaauggcccaaagcaacuuguacaggugacugcccagaaagguguggcugcacaucaucaaccugcuugcauaaagaauggccucauucaagaaacuggagauguaaucccacuuggugcuggggagugggaaccggcugcaccugcugcgggguggauguaaaagaccuuuuuacagaucacauguuugucaaauggaagguugaauauauaaaaacugaagccauaguguguguugagcucaccagccaagaaagacagugcagucugauugaggcagguacuagauucaacuugggcccugugacuauuacccugucugagccaagaaacauucagcagaagcuucccccugagaucauuacguugcaucccaaaauugaggaaggcuucuuugacuugaugcauguacaaaaaguguuguccgcaaguacaguguguaaacugcagaguugcacacaugguauaccaggagaucuacaaguuuaccacauuggcaacuuguugaaaggggauagaguaaacgggcaucuaauucacaaaauugaaccacauuucaacaccucuuggauguccugggaugguugugacuuagacuacuacugcaacaugggggacuggccuucuuguacauacacaggagugacccagcauaaucaugcugcauuuguaaacuugcuuaacauugaaacugauuacacgaaaaccuuccacuuccacucuaaaagagucacagcacauggugacacaccacaauuggacuuaaaagcaaggccgaccuacggugcaggagagaucacugugcugguugagguugcugacauggaguugcauaccaagaaaguugagauaucgggcuugaaauuugcaagucuggcuugcacagguugcuaugccuguagcucuggcaucuccuguaaagucaggauucauguagaugaaccagaugagcucacagugcauguaaagagcagugacccagauguuguugcagcuagcacaagccucauggcaaggaagcuugaauuugggacagacagcacauucaaggccuuuucagcuaugcccaaaaccucuuuauguuuuuacauuguggagaaagaauacugcaagagcugcagugaagaugauacaaaaaaauguguugacacaaaacuugagcagccacagagcauacuaauugagcacagagggacgauaauuggaaagccgaaugauacuugcccagccaagacaagcuguuggcuagaguccgucaagagcuuuuuuuauggauugaagaauaugcuuggcagugucuuugguaauuuuuucauaggcauuuuguuauuccuugccccuuuuuuccuguggaugcuuuccuuuauguuuggauggaaaaucuuguucugcuuuaaauguugcaggaggaccagaggccuguuuaaguauagacaccucaaagacgaugaggaaacaggcuacagaaggauuauugaaaggcugaacaacaaaaaagggaaaaauagacugcuugauggugaaagguuggcugauaggaaaauugccgagcuguuuucuacaaaaacacacauuggcuaa

SEQ ID NO: 3675 - RNA, 5052 nt, Artificial Sequence
  derived and/or modified CDS sequence (wt) from CCHFV(4495-ST-2008)__KR814869.1__GP
augcauacacuauuagugugcuucauucuuuaccuacagcugcuggguccaggaggagcccauggacagccaaacgcaacugaacacaacagaacaaacaccaccacagcacccagcacaagccaaagccccaagccacccgugagcacagccccaccacacgcacuggaaucacccaccaucaaauccaccacaccaacaagcgaaacagaaggcucaggggaaacgaccccacccccaaacaccacccagggcccgucuccaccagagaccacaccagaacgccccgcaacaacugccacaaguacgccaagcacagacaacacgaauuccaccacacaugugaccgacaacaacccuacaucaacaaucagcacaaguccauccagcagccccagcacgccauccacaccacgaggcauacaucauccugcaaggaaucuauugucagucucgagcccuaagacagcaacaacaccaacaccaacgagcccuggggagauaagcucagaaaccagcagucugcacucagccaugagcagaacaucaacccucuacacagcaacccaggccuccacugaaaaugccaaccacagcacaccuagacagucugaguccccagcacagccgacaaccacaagccuaaugaccuccccagcacaaucaauccuuguaaugagugcugcuccuacagcuauucagaacauacaucccagcccaacgaauaggucuaagaggaaccuugagauggaaauaauuuuaacucugucucaaggucuaaagaaauacuacgguaagauacugaagcuucugcaccucaccuuggaagaggacacugaaggccuguuagaaugguguaagagaaaccuugggucaaacugugaugaugacuucuuucagaagagaauagaagaauucuucaugaccggugagggcuacuucaaugaagucuuacaauuuaaaacacuaagcacacuaagccccacggagccgucucaugccaggccaccaacaguggaacccuucaaaucuuacuucgcuaagggcuuccuuucaauagauucagguuacuucucugccaaauguuauccaagaucaucuacuucagggcuucagcugaucaauguuacccaacacccagcuagaauagcagaaacaccuggacccaagacaacgagucugaaaaccaucaacuguauaaaccuaagagcaucagucuucaaagaacacagagaaauugagaucaaugugcuucuuccucagauugcagucaaccucucaaauugccauguuguaaucaauucacaugucugugauuauucuuuagacacugaugggccagugaggcuuccucacauuuaccaugaaggaacuuucauaccaggaacuuacaaaauagugauagacaaaaaaaauaagcuaaaugaccgauguacacuggucaccaacugugugauaaaaggaagagagguucguaagggccaaucagugcugaggcaguacaaaacagaaaucaagauaggcaagguaucaacaggcucuaggaaacuacuguccgaagagucaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauaccaucaacagggugaagucauucaagcuaugcgaaaacagcgccacagggaaaaccugugagauagacagcacuccgguuaagugcaggcaagguuuuuguuuaaaaaucacccaagaaggaaggggccacguaaaauuaucuagaggcucagagguuguuuuggaugcuugcgacucaagcugcgaaguaaugauaccuaaaggcacuggagauaucuugguggacuguucagguggacagcaacauuucuuaaaagacaacuuaauugaccuagggugcccccauaucccgcuauuggguaaaauggccauuuacaucugcagaaugucaaaucauccuagaacaacuauggcuuuucucuucugguucagcuuuggcuauguaaucaccuguuuauuuugcaaggcucuuuuuuauucauugauaaucauugggacacuagggaaaaagaucaagcaauauagggaauugagaccucaaacuuguaccauaugugagacagcuccugucaaugcaauagaugcugaaaugcaugaccuuaacugcaguuacaauauaugcccuuauugugcaucaagauugaccuccgaugggcuagcuaggcaugugccacaaugccccaagcggaaggaaaaaguugaggagacugagcuguacuugaaccuggaaagaauuccuuggauugucagaaagcuauugcaagugucagaguccacugguguggcauugaaacgaagcagcuggcugauuguacugcuuguguuacucacaguuucauugucaccgguucaaucagcaccuguuggucaugguaagacaaucgaaacauaucagaccagagaaggauucacaaguaucugucucuuuauguuaggaagcauccuguuuuuagucucuugcuuggugaaggggcugguugacagugucagugacagcuucuuccccggccugucugucuguaagacaugcucuauuggcaguauaaauggcuuugaaauugaaucgcauaaaugcuacuguagccuacuuugcugccccuacuguaggcacugcucugcugacagagaaauccaccaguuacacuugaguaucugcaaaaaaagaaaaacggguagcaaugucaugcuggcugucugcaaacgcaugugcuuuagggcaaccauagaagcaagcagaagagcccugcucauccgaagcauuauaaauaccacuuuuguaauaugcauuuuaacauuaacaaucuguguuguuagcaccucugcaguagagauggaaaaccuuccaucaggcacuugggagaaagaggaagaccugacaaauuucugucaucaggaaugccaggugaccgagacggagugccucuguccauacgaagcucuugugcucagaaaaccucuguucuuagacaguauaguuaaaggcaugaagaauuugcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggaaucagcugggaucuaggcguagaagaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcuggggaguaggaacuggcugcaccugcugcgggguggauguaaaagaccuuuuuacagaucacauguuugucaaguggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcauguacaaaaaguguugucugcaaguacaguguguaaacugcagaguugcacacaugguauaccaggagaucuacaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacauugaaacugauuacacgaaaaccuuccacuuccacucuaaaagaguuacagcacauggugacacaccacaauuagacuuaaaagcaaggccaaccuacggugcaggugagaucacugugcugguugagguugcugacauggaguugcauaccaagaaaguugagauaucaggccugaaauuugcaagucuggcuugcacggguugcuaugcuuguagcucuggcaucuccuguaaagucaggauucauguagaugagccagaugagcucacaguacauguaaagagcagugauccagaugugguugcagcuagcacaagucucauggcgaggaagcuugaauuugggacagacaguacauucaaggccuuuucagcuaugcccaaaaccucuuuauguuuuuacauuguggagagggaauacugcaagagcugcagugaagaggacacacaaagauguguugacacaaaacuugagcagccacagagcauacuaauugagcacaaaggaacgauaauuggaaagcagaaugauacuugcacagccaaggcaagcuguuggcuagagucagucaagaguuuuuuuuauggauugaaaaauaugcuugguaguguauuuggcaacuuuuucauaggcauuuuguuauuccuugccccuuuuguccuguuggugcuuuucuuuauguuuggauggaaaaucuuguuuugcuucaaauguugcaggagggccagaggcuugcuuaaguauagacaccuaaaagacgaugaggaaacaggcuacagaaagauuauugaaaggcugaacaacaaaaaaggaaaaaacagacugcuugauggugaaagguuggcugauaggaaaauugcugagcuguucuccacaaaaacacacauugguuaa

SEQ ID NO: 3676 - RNA, 5052 nt, Artificial Sequence
  derived and/or modified CDS sequence (wt) from CCHFV(Mamon)__KX013478.1__GP
augcauacacuauuagugugcuucauucuuuaccuacagcuguugggucuaggaggagcucauggacagucaaacacaacugaacacaacggaacaaacaccaccacagcacccagcacaagucaaagccccaagccacuugugagcacagccccaccacacgcacuggaaucauccaccaucaaacccaccacaccagcaagcgaaacagaaggcucaggggaaacgaccccacccccaaacaucacccagggcccgucuccaccagagaccacaccagaacgccccgcaacaacugccacaaguacgccaagcacagacaacacgaauuccaccacacaugugaccgacaacaacccuacaucaacaaucagcacaaguccauccagcagccccagcacgccauccacaccacaaggcauacaucauccugcaaggaauuuauugucagucucgagcccuaagacagcaacaacaccaacaccaacgagcccuggggagauaagcucaaaaaccagcagucugcacucagccaugagcagaacaucaacccucuacacagcaacccaggucuccacugaaaaugccaaccacagcgcaccuagacagucugaguccucagcacagccgacaaccacaagcccaaugacuuccccagcacaaucaauccuuguaaugagugcugcuccuacagcuauucagaacauacaucccagcccaacgaauagaucuaagaggaaccuugagauggaaauaauuuuaacucugucucaaggucuaaagaaauacuaugguaagauacugaagcuucugcaccucaccuuggaagaggacacugaaggccuguuagaaugguguaagagaaaccuugggucaaacugugaugaugacuucuuucagaagagaauagaagaauucuucaugaccggugagggcuacuucaaugaagucuuacaauuuaaaacacuaagcacacuaagccccacggagccgucucaugccaggccaccaacaguggaacccuucaaaucuuacuucgcuaagggcuuccuuucaauagauucagguuacuucucugccaaauguuauccaagaucaucuacuucagggcuucagcugaucaaugugacccaacacccagcuagaauagcagaaacaccuggacccaagacaacgagucugaaaaccaucaacuguauaaaccuaagagcaucagucuucaaagaacacagagaaauugagaucaaugugcuucuuccucagauugcagucaaccucucaaauugccauguuguaaucaauucacaugucugugauuauucuuuagacacugaugggccagugaggcuuccucacauuuaccaugaagggacuuucauaccaggaacuuauaaaauagugauagacaaaaaaaauaagcuaaaugaccgauguacacuggucaccaacugugugauaaaaggaagagagguucguaagggccaaucagugcugaggcaguacaaaacagaaaucaagauaggcaaggcaucaacaggcucuaggaaacuacuguccgaggagccaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauaccaucaacagggugaagucauucaagcuaugcgaaaacagcgccacagggaaaaccugugagauagacagcacuccgguuaagugcaggcaagguuuuuguuuaaaaaucacccaagagggaaggggccacguaaaauuaucuagaggcucagagguuguuucggaugcuugcgacucaagcugcgaaguaaugauaccuaaaggcacuggagauauccugguggacuguucagguggacagcaacauuucuuaaaagacaacuuaauugaccuagggugcccccauaucccgcuauuggguaaaauggccauuuacaucugcagaaugucaaaucauccuagaacaacuguggcuuuucucuucugguucagcuuuggcuaugugaucaccuguauauuuugcaaggcucuuuuuuauucauugauaauuauugggacacuagggaaaaagaucaagcaauauagggaauugaaaccucaaacuuguaccauaugugagacagcuccugucaaugcaauagacgcugaaaugcaugaccuuaacugcaguuacaauauaugcccuuauugugcaucaagauugaccuccgaugggcuagcuaggcaugugccacaaugccccaagcggaaggaaaaaguugaggagacugagcuguacuugaaccuggaaagaauuccuuggauugucagaaagcuauugcaagugucagaguccacugguguggcauuaaaacgaagcagcuggcugauuguacugcuuguguuacucacaguuucauugucaccgguucaaucagcaccuguuggucacgguaagacaaucgaaacauaucagaccagagaaggauucacaaguaucugucucuuuauguuaggaagcauccuguuuuuagucucuugcuuggugaaggggcugguugacagugucagugacagcuucuuccccggccugucugucuguaagacaugcucuauuggcaguauaaauggcuuugaaauugaaucgcauaaaugcuacuguagccuauuuugcugccccuacuguaggcacugcucugcugacagagaaauucaccaguuacacuugaguaucugcaaaaaaagaaaaacggguagcaaugucaugcuggcugucugcaaacgcaugugcuuuagggcaaccauagaagcaagcagaagagcccugcucauccgaagcauuauaaauaccacuuuuguaauaugcauuuuaacauugacaaucuguguuguuagcaccucugcaguagagauggaaaaccuuccaucaggcacuugggagagagaggaagaccugacaaauuucugucaucaggaaugccagguaaccgagacggagugccucuguccauacgaagcucuugugcucagaaaaccucuguucuuagacaguauaguuaaaggcaugaagaauuugcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguagaagaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcuggggaguaggaacuggcugcaccugcugcgggguggauguaaaagaccuuuuuacagaucacauguuugucaaauggaagguugaauauauaaaaacugaagccauaguguguguugagcucaccagccaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcaugugcaaaaaguguugucugcaaguacaguguguaaacugcagaguugcacacaugguauaccaggagaucuacaaguuuaccacauuggcaacuugcugaaaggugauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacauugaaacugauuacacgaaaaccuuccacuuccacucuaaaagaguuacagcacauggugacacaccacaauuagacuuaaaagcaaggccgaccuacggugcaggugagaucacugugcucguugagguugcugacauggaguugcauaccaagaaaguugagauaucaggcuuaaaauuugcaagucuggcuugcacggguugcuaugcuuguagcucuggcaucuccuguaaagucaggauucauguagaugagccagaugagcucacaguacauguaaagagcagugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaaugauacuugcacagccaagacaagcuguuggcuagagucagucaagaguuuuuuuuauggauugaaaaauaugcuugguaguguauuugguaacuuuuucauaggcauuuuguuauuccuugccccuuuuguccuguuggugcuuuucuuuauguuuggauggaaaaucuuguuuugcuucaaauguugcaggaggaccagaggcuuacuuaaguauagacaccucaaagacgaugaggaaacaggcuacagaaggauuauugaaagacugaacaacaaaaaaggaaaaaacagacugcuugauggugaaagguuggcugauaggaaaauugcugagcuguucuccacaaaaacacacauugguuaa

SEQ ID NO: 3677 - RNA, 5052 nt, Artificial Sequence
  derived and/or modified CDS sequence (wt) from CCHFV(81-R-2014)__KR814865.1__GP
augcauacacuauuagugugcuucauucuuuaccuacagcuguugggucuaggaggagcucauggacagucaaacgcaacugaacacaauggaacaaacaccaccacaguacccagcacaagucaaagccccaagccacuugugagcacaaccccaccacacgcacuggaaucaucaaccaucaaacccaccacaccaacaagcgaaacagaaggcucaggggaaacggccccacucccaaacaccacccagggcccgccuccaccagagaccacaccagaacgccccgcaacaacugucacaaguacgccaaguacagacaacacgaauuccaccauacaugugaccgacaacaaccccacaucaacaaucagcacaaguccauccagcagccccagcacgccauccacaccacaaggcauacaucauccugcaaggagucuauugucagucucgagcccuaagacagcaacaacaccaacaccgacgagcccuggggagauaaacucagaaaccagcagucugcacucagccaugagcagaacaccaacccuccacacagcaacccaggucuccacugaaaaugccaaccacagcgcaccuagacagucugaguccucagcacagccaacaaccacaagccuaaugacuuccccagcacagucaauccuucuaaugagugcugcuccuacagcuauucagaacacacaucccagcccaacaaauaggucuaagaggaaccuugagauggaaauaauuuuaacucugucucaaggucuaaagaaauacuacgguaagauacugaagcuacuacaccucaccuuggaagaggacacugaaggccuguuagaaugguguaagagaaaccuugggucaaacugugaugaugacuucuuucaaaagagaauaggagaauucuucaugacuggugagggcuacuucaaugaagucuuacaauuuaaaacacuaagcacacuaagccccacggagccgucucaugccaggcuaccaacaguggaacccuucaaaucuuacuucgcuaagggcuuccuuucaauagauucagguuacuucucugccaaauguuauccaagaucaucuacuucagggcuccagcugaucaauguuacccaacacccagcuaggauagcagaaacacccggacccaagacaacgagucugaaaaccaucaacuguauaaaccuaagagcaucagucuucaaagaacacagagaaauugagaucaaugugcuucuuccucagauugcagucaaccucucaaauugccauguugugaucaauucacaugucugugauuacucuuuagacacugaugggccagugaggcuuccucacauuuaccaugaagggacuuucauaccaggaacuuauaaaauagugauagacaagaaaaauaagcuaaaugaccgauguacacuagucaccaacugugugauaaaaggaagagagguucguaagggccaaucagugcugaggcaguacaaaacagaaaucaagauaggcaaggcaucaacaggcucuaggaaacuacuguccgaagagccaggugaugacugcauaucaagaacucagcuauugaggacagaaacagcagagauccaugaugacaacuauggugguccaggugauaaaauaacuaucugcaacgguucaaccauuguagaucagagacugggcagugaacuaggguguuauaccaucaacagagugaagucauucaagcuaugcgaaaacagcgccacagggaaaaccugugagauagacagcacuccgguuaagugcaggcaaggcuuuuguuuaaaaaucacccaagagggaaggggccacguaaaauuaucuagaggcucagagguugucuuggaugccugcgacucaagcugcgaaguaaugauaccuaaaggcacuggagauauccugguggacuguucagguggacagcaacauuucuuaaaagacaacuuaauugaccuagggugcccccauaucccgcuauuggguaaaauggccauuuacaucugcagaaugucaaaucauccuagaacaacuauggcuuuucucuucugguucagcuuuggcuaugugaucaccuguauauuuugcaaggcucuuuuuuauucauugauaauuauugggacacuagggaaaaagaucaagcaauauagggaacugaaaccucaaacuuguaccauaugugagacagcuccugucaaugcaauagaugcugaaaugcaugaccuuaacugcaguuacaauauaugcccuuauugugcaucaagauugaccuccgaugggcuagcuaggcaugugccacagugccccaagcgaaaggaaaaaguugaggagacugagcuguacuugaaccuggaaagaauuccuuggaucgucagaaagcuauugcaagugucagaauccacugguguggcauugaaacgaagcagcuggcugauuguacugcuuguguuacucacaguuucauugucaccgguucaaucagcaccuguuggucaugguaagacaaucgaaacauaucagaccagagaaggauucacaaguaucugucucuuuauguuaggaagcauccuauuuuuagucucuugcuuggugaaggggcugguugacagugucagugacagcuucuuccccggccugucugucuguaagacaugcucuauuggcaguauaaauggcuuugaaauugaaucgcauaaaugcuacuguagccuauuuugcugccccuacuguaggcacugcucugcugacagagaaauucaccaguuacacuugagcaucugcaaaaaaagaaaaacggguagcaaugucaugcuggcugucugcaaacgcaugugcuuuagagcaaccauagaggcaagcagaagagcccugcucauccgaagcauuaucaauaccacuuuuguaauaugcauucuaacauugacaaucuguguuguuagcaccucugcaguagagauggaaaaccuuccagcaggcacuugggagagagaggaagaccugacaaauuucugucaucaggaaugccagguaaccgagacggagugccucuguccauacgaagcucuugugcucagaaaaccucuguucuuagacaguauaguuaaaggcaugaaaaauuugcuaaacucaacaagcuuagaaacaagcuuaucaaucgaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguagaggaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcuggggaguaggaacuggcugcaccugcugcgggguggauguaaaagaccuuuuuacagaucacauguuugucaaguggaagguugaauauauaaaaacugaagccauaguauguguugagcucaccagccaagaaagacagugcagucugauugaggcagguaccagauucaacuugggcccugugacuauuacccugucugagccaagaaacauacagcagaagcuucccccugagauuaucacguugcaucccaaaguugaagagggcuucuuugacuugaugcaugugcaaaaaguguugucugcaaguacaguguguaaacugcagaguugcacacacggcauaccaggagaucuacaaguuuaccacauuggcaacuugcugaaaggagauaggauaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacauugaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcacaccaaaaaaguugagauaucaggcuugaaauuugcaagucuggcuugcacggguugcuaugcuuguagcucuggcaucuccuguaaagucaggauucauguagaugagccagaugagcucacaguacauguaaagagcagugauccagaugugguugcagccagcacaagucucauggcgaggaagcuugaguuugggacagacaguaccuucaaggccuuuucagcuaugcccaaaaccucuuuauguuuuuacauuguggagagagaauacuguaagagcugcagugaagaggacacacaaaaauguguugacacaagacuugagcagccgcagagcauacuaauugagcacaaaggaacgauaauugggaagcagaaugauacuugcacagccaaggcaagcuguugguuagagucagucaagaguuuuuuuuauggauugaagaauaugcuugguagugucuuugguaauuuuuucauaggcauucuguuauuccuugccccuuuuguccuguuggugcuuuucuuuauguuuggguggaaaaucuuguuuugcuuuaaauguugcaggaggaccagaggcuuacuuaaguauagacaccucaaagacgaugaggaaacaggcuacagaaggauuauugaaagacugaacaacaaaaaagggaaaaacagacugcuugauggugaaagguuggcugauaggaaaauugcugagcuguucuccacaaaaacacacauugguuaa

SEQ ID NO: 3678 - RNA, 5052 nt, Artificial Sequence
  derived and/or modified CDS sequence (wt) from CCHFV(5180-R-2011)__KR814874.1__GP
augcauacgcuauuagugugcuucauucuuuaccuacagcuguugggucuaggaggagcucauagacagucaaacgcaacugaacacaacggaacaaacaccaccacagcacccagcacaagccaaagccccaagccaccugugagcacagccccaccauacgcaccggaaucauccaccaucaaacccaccacaccagcaagcgaaacagaaggcucaggggaaacgaccccacccccaaacaccacccagggcccgucuccaccagaggccacaccagaacgccccgcaacaacugccacaaguacgccaagcacagacaacacgaacuccaccacacacgcgaccgacaacaacccuacaucaacaaucagcacaaguccauccagcagccccagcacgccauccacaccacaaggcauacaucauccugcaaggaaucuauugucagucucgagcccuaagacagcaacaacaccaacaccaacgagcccuggggauauaagcucagaaaccagcagucugcacucagccaugagcagaacaccaacccuccacacagcaacccaggccuccacugaaaaugccaaccacagcgcaccuagacagucugaguccucagcacagcagacaaccacaagcccaaugacuuccccagcacaaccaauccuuguaaugagugcugcuccuacagcuauucagaacauacaucccagcccaacgaauaggucuaagaggaaccuugagauggaaauaauuuuaacucugucucaaggucuaaagaaauacuaugguaagauacugaagcuucugcaccucaccuuggaagaggacacugaaggccuguuagaaugguguaagagaaaccuugggucaaacugugaugaugacuucuuucagaagagaauagaagaauucuucaugaccggugagggcuacuucaaugaagucuuacaauuuaaaacacuaagcacacuaagccccacggagccgucucaugccaggccaccaacaguggaacccuucaaaucuuacuucgcuaagggcuuccuuucaauagauucagguuacuucucugccaaauguuauccaagauuaucuacuucagggcuucagcugaucaaugucacccaacacccagcuagaauagcagaaacaccuggacccaagacaacaagucugaaaaccaucaacuguauaaaccuaagagcaucagucuucaaagaacacagagaaauugagaucaaugugcuccuuccucagauugcagucaaccucucaaauugccauguuguaaucaauucacaugucugugauuauucuuuagacacugaugggccaguaaggcuuccucacauuuaccaugaagggacuuucauaccaggaacuuauaaaauagugauagacaaaaaaaauaagcuaaaugaccgauguacacuggucaccaacugugugauaaaaggaagagagauucguaagggccaaucagugcugaggcaguacaaaacagaaaucaagauaggcaaggcaucaacaggcucuaggaaacuacuguccgaggagccaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauaccaucaacagggugaagucauucaagcuaugcgaaaacagcgccacagggaaaaccugugagauagacagcacuccgguuaagugcaggcaagguuuuuguuuaaaaaucacccaagagggaaggggccacguaaaauuaucuagaggcucagagguuguuuuggaugcuugcgacacaagcugcgaaguaaugauaccuaaaggcacuggagauauccugguggacuguucagguggacagcaacauuucuuaaaagacaauuuaauugaccuagggugcccccauaucccgcuauuggguaaaauggccauuuacaucugcagaaugucaaaucauccuagaacaacuauggcuuuucucuucugguucagcuuuggcuaugugaucaccuguauauuuugcaaggcucuuuuuuauucauugauaauuauugggacacuagggaaaaagaucaagcaauauagggaauugaaaccucaaacuuguaccauaugugagacagcuccugucaaugcaauagacgcugaaaugcaugaccuuaacugcaguuacaauauaugcccuuauugugcaucaagauugaccuccgaugggcuagcuaggcaugugccacaaugccccaagcggaaggaaaaaguugaggagacugagcuguacuugaaccuggaaagaauuccuuggauugucagaaagcuauugcaagugucagaguccacugguguggcauugaaacgaagcagcuggcugauuguacugcuuguguuacucacaguuucauugucaccgguucaaucagcaccuguuggucaugguaagacaaucgaaacauaucagaccagagaaggauucacaagugucugucucuuuauguuaggaagcauccuguuuuuagucucuugcuuggugaaggggcuaguugacagugucagugacagcuucuuccccggccugucugucuguaagacaugcucuauuggcaguauaaauggcuuugaaauugaaucgcauaaaugcuacuguagccuauuuugcugccccuacuguaggcacugcucugcugacagagaaauucaucaguuacacuugaguaucugcaaaaaaagaaaaauggguagcaaugucaugcuggcugucugcaaacgcaugugcuuuagggcaaccauagaagcaagcagaagagcccugcucauccgaagcauuauaaauaccacuuuuguaauaugcauuuuaacauugacaaucuguguuguuagcaccucugcaguagagauggaaaaccuuccaucaggcacuugggagagagaggaagaccugacaaauuucugucaucaggaaugccagguaaccgagacggagugccucuguccauacgaagcucuugugcucagaaaaccucuguucuuagacaguauaguuaaaggcaugaagaauuugcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguagaagaugccucugaauccaaauuacuuaccgucuccaucauggauuugucacaaauguauuccccuguuuuugaguacuugucaggagacagacagguugaagaauggcccaaagcaacuugcacaggugacugcccagaaaggugugguugcacaucaucaacuugcuugcauaaagaauggccucacucaagaaacuggagauguaaucccacuuggugcuggggaguaggaacuggcugcaccugcugcgggguggauguaaaagaccuuuuuacagaucacauguuugucaaauggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcaugugcaaaaaguguugucugcaaguacaguguguaaacugcagaguugcacacaugguauaccaggagaucuacaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaauaucgaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcauaccaagaaaguugagauaucaggcuuaaaauuugcaagucuggcuugcacggguugcuaugcuuguagcucuggcaucuccuguaaagucaggauucauguagaugagccagaugagcucacaguacauguaaagagcaaugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaaugauacuugcacagccaaggcaagcuguuggcuagagucagucaagaguuuuuuuuauggauugaaaaauaugcuugguaguguauuugguaacuuuuucauaggcauuuuguuauuccuugccccuuuuguccuguuggugcuuuucuuuauguucggauggaaaaucuuguuuugcuucaaauguugcaggaggaccagaggcuuacuuaaguauagacuccucaaagacgaugaggaaacaggcuacagaaggauuauugaaagacugaacaacaaaaaaggaaaaaacagacugcuugauggugaaagguuggcugauaggaaaauugcugagcuguucuccacaaaaacacacauugguuaa

SEQ ID NO: 3679 - RNA, 5052 nt, Artificial Sequence
  derived and/or modified CDS sequence (wt) from CCHFV(24-R-2012)__KR814856.1__GP
augcauacgcuauuagugugcuucauucuuuaccuacagcuguugggucuaggaggagcucauagacagucaaacgcaacugaacacaacggaacaaacaccaccacagcacccagcacaagccaaagccccaagccaccugugagcacagccccaccacacgcaccggaaucauccaccaucaaacccaccacaccagcaagcgaaacagaaggcucaggggaaacgaccccacccccaaacaccacccagggcccgucuccaccagaggccacaccagaacgcaccgcaacaacugccacaaguacgccaagcacagacaacacgaacuccaccacacacgcgaccgacaacaacccuacaucaacaaucagcacaaguccauccagcagccccagcacgccauccacaccacaaggcauacaucauccugcaaggaaucuauugucagucucgagcccuaagacagcaacaacaccaacaccaacgagcccuggggauauaagcucagaaaccagcagucugcacucagccaugagcagaacaccaacccuccacacagcaacccaggccuccacugaaaaugccaaccacagcgcaccuagacagucugaguccucagcacagcagacaaccacaagcccaaugacuuccccagcacaaccaauccuuguaaugagugcugcuccuacagcuauucagaacauacaucccagcccaacgaauaggucuaagaggaaccuugagauggaaauaauuuuaacucugucucaaggucuaaagaaauacuaugguaagauacugaagcuucugcaccucaccuuggaagaggacacugaaggccuguuagaaugguguaagagaaaccuugggucaaacugugaugaugacuucuuucagaagagaauagaagaauucuucaugaccggugagggcuacuucaaugaagucuuacaauuuaaaacacuaagcacacuaagccccacggagccgucucaugccaggccaccaacaguggaacccuucaaaucuuacuucgcuaagggcuuccuuucaauagauucagguuacuucucugccaaauguuauccaagauuaucuacuucagggcuucagcugaucaaugucacccaacacccagcuagaauagcagaaacaccuggacccaagacaacaagucugaaaaccaucaacuguauaaaccuaagagcaucagucuucaaagaacacagagaaauugagaucaaugugcuccuuccucagauugcagucaaccucucaaauugccauguuguaaucaauucacaugucugugauuauucuuuagacacugaugggccagugaggcuuccucacauuuaccaugaagggacuuucauaccaggaacuuauaaaauagugauagacaaaaaaaauaagcuaaaugaccgauguacacuggucaccaacugugugauaaaaggaagagagguucguaagggccaaucagugcugaggcaguacaaaacagaaaucaagauaggcaaggcaucaacaggcucuaggaaacuacuguccgaggagccaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauaccaucaacagggugaagucauucaagcuaugcgaaaacagcgccacagggaaaaccugugagauagacagcacuccgguuaagugcaggcaagguuuuuguuuaaaaaucacccaagagggaaggggccacguaaaauuaucuagaggcucagagguuguuuuggaugcuugcgacacaagcugcgaaguaaugauaccuaaaggcacuggagauauccugguggacuguucagguggacagcaacauuucuuaaaagacaauuuaauugaccuagggugcccccauaucccgcuauuggguaaaauggccauuuacaucugcagaaugucaaaucauccuagaacaacuauggcuuuucucuucugguucagcuuuggcuaugugaucaccuguauauuuugcaaggcucuuuuuuauucauugauaauuauugggacacuagggaaaaagaucaagcaauauagggaauugaaaccucaaacuuguaccauaugugagacagcuccugucaaugcaauagacgcugaaaugcaugaccuuaacugcaguuacaauauaugcccuuauugugcaucaagauugaccuccgaugggcuagcuaggcaugugccacaaugccccaagcggaaggaaaaaguugaggagacugagcuguacuugaaccuggaaagaauuccuuggauugucagaaagcuauugcaagugucagaguccacugguguggcauugaaacgaagcagcuggcugauuguacugcuuguguuacucacaguuucauugucaccgguucaaucagcaccuguuggucaugguaagacaaucgaaacauaucagaccagagaaggauucacaagugucugucucuuuauguuaggaagcauccuguuuuuagucucuugcuuggugaaggggcugguugacagugucagugacagcuucuucccuggccugucugucuguaagacaugcucuauuggcaguauaaauggcuuugaaauugaaucgcauaaaugcuacuguagccuauuuugcugccccuacuguaggcacugcucugcugacagagaaauucaucaguuacacuugaguaucugcaaaaaaagaaaaauggguagcaaugucaugcuggcugucugcaaacgcaugugcuuuagggcaaccauagaagcaagcagaagagcccugcucauccgaagcauuauaaauaccacuuuuguaauaugcauuuuaacauugacaaucuguguuguuagcaccucugcaguagagauggaaaaccuuccaucaggcacuugggagagagaggaagaccugacaaauuucugucaucaggaaugccagguaaccgagacggagugccucuguccauacgaagcucuugugcucagaaaaccucuguucuuagacaguauaguuaaaggcaugaagaauuugcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguagaagaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaacuugcuugcauaaagaauggccucacucaagaaacuggagauguaaucccacuuggugcuggggaguaggaacuggcugcaccugcugcgggguggauguaaaagaccuuuuuacagaucacauguuugucaaauggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcaugugcaaaaaguguugucugcaaguacaguguguaaacugcagaguugcacacaugguauaccaggagaucuacaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaauaucgaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcauaccaagaaaguugagauaucaggcuuaaaauuugcaagucuggcuugcacggguugcuaugcuuguagcucuggcaucuccuguaaagucaggauucauguagaugagccagaugagcucacaguacauguaaagagcaaugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaaugauacuugcacagccaaggcaagcuguuggcuagagucagucaagaguuuuuuuuauggauugaaaaauaugcuugguaguguauuugguaacuuuuucauaggcauuuuguuauuccuugccccuuuuguccuguuggugcuuuucuuuauguuuggauggaaaaucuuguuuugcuucaaauguugcaggaggaccagaggcuuacuuaaguauagacuccucaaagacgaugaggaaacaggcuacagaaggauuauugaaagacugaacaacaaaaaaggaaaaaacagacugcuugauggugaaagguuggcugauaggaaaauugcugagcuguucuccacaaaaacacacauugguuaa

SEQ ID NO: 3680 - RNA, 5052 nt, Artificial Sequence
  derived and/or modified CDS sequence (wt) from CCHFV(46-ST-2012)__KR814860.1__GP
augcauacacuauuagugugcuucauucuuuaccuacagcuguugggucuaggaggagcucauggacagucaaacgcaacugaacacaauggaacaaacaccaccacaguacccagcacaagucaaagccccaagccacuugugagcacaaccccaccacaugcacuggaaucaucaaccaucaaacccaccacaccaacaagcgaaacagaaggcucaggggaaacggccccacucccaaacaccacccagggcccgccuccaccagagaccacaccagaacgccccgcaacaacugucacaaguacgccaaguacagacaacacgaguuccaccauacaugugaccgacaacaaccccacaucaacaaucagcacaaguccauccagcagccccagcacgccauccacaccacaaggcauacaucauccugcaaggagucuauugucagucucgagcccuaagacagcaacaacaccaacaccgacgagcccuggggagauaaacucagaaaccagcagucugcacucagccaugagcagaacaccaacccuccacacagcaacccaggucuccacugaaaaugccaaccacagcgcaccuagacagucugaguccucagcacagccaacaaccacaagccuaaugacuuccccagcacaaucaauccuucuaaugagugcugcuccuacagcuauucagaacauacaucccagcccaacaaauaggucuaagaggaaccuugagauggaaauaauuuuaacucugucucagggucuaaagaaauacuacgguaagauacugaagcuacuacaccucaccuuggaagaggacacugaaggccuguuagaaugguguaagagaaaccuugggucaaacugugaugaugacuucuuucaaaagagaauagaagaauucuucaugacuggugagggcuacuucaaugaagucuuacaauuuaaaacacuaagcacacuaagccccacggagccgucucaugccaggcuaccaacaguggaacccuucaaaucuuacuucgcuaagggcuuccuuucaguagauucagguuacuucucugccaaauguuauccaagaucaucuacuucagggcuccagcugaucaauguuacccaacacccagcuaggauagcagaaacacccggacccaagacaacgagucugaaaaccaucaacuguauaaaccuaagagcaucugucuucaaagaacacagagaaauugagaucaaugugcuucuuccucagauugcagucaaccucucaaauugccauguugugaucaauucacaugucugugauuacucuuuagacacugaugggccagugaggcuuccucacauuuaccaugaagggacuuucauaccaggaacuuauaaaauagugauagacaagaaaaauaagcuaaaugaccgauguacacuagucaccaacugugugauaaaaggaagagagguucguaagggccaaucagugcugaggcaguacaaaacagaaaucaagauaggcaaggcaucaacaggcucuaggaaacuacuguccgaagagccaggugaugacugcauaucaagaacucagcuauugaggacagaaacagcggagauccaugaugacaacuauggugguccaggugauaaaauaacuaucugcaacgguucaaccauuguagaucagagacugggcagugaacuaggguguuauaccaucaacagagugaagucauucaagcuaugcgaaaacagcgccacagggaaaaccugugagauagacagcacuccgguuaagugcaggcaaggcuuuuguuuaaaaaucacccaagagggaaggggccacguaaaauuaucuagaggcucagagguugucuuggaugccugcgacucaagcugcgaaguaaugauaccuaaaggcacuggagauauccugguggacuguucagguggacagcaacauuucuuaaaagacaacuuaauugaccuagggugcccccauaucccgcuauuggguaaaauggccauuuacaucugcagaaugucaaaucauccuagaacaacuauggcuuuucucuucugguucagcuuuggcuaugugaucaccuguauauuuugcaaggcucuuuuuuauucauugauaauuauugggacacuagggaaaaagaucaagcaauauagggaacugaaaccucaaacuuguaccauaugugagacagcuccugucaaugcaauagaugcugaaaugcaugaccuuaacugcaguuacaauauaugcccuuauugugcaucaagauugaccuccgaugggcuagcuaggcaugugccacagugccccaagcgaaaggaaaaaguugaggagacugagcuguacuugaaccuggaaagaauuccuuggaucgucagaaagcuauugcaagugucagaauccacugguguggcauugaaacgaagcagcuggcugauuguacugcuuguguuacucacaguuucauugucaccgguucaaucagcaccuguuggucaugguaagacaaucgaaacauaucagaccagagaaggauucacaaguaucugucucuuuauguuaggaagcauccuauuuuuagucucuugcuuggugaaggggcugguugacagugucagugacagcuucuuccccggccugucugucuguaagacaugcucuauuggcaguauaaauggcuuugaaauugaaucgcauaaaugcuacuguagccuauuuugcugccccuacuguaggcacugcucugcugacagagaaauucaccaguuacacuugagcaucugcaaaaaaagaaaaacggguagcaaugucaugcuggcugucugcaaacgcaugugcuuuagagcaaccauagaggcaagcagaagagcccugcucauccgaagcauuaucaaugccacuuuuguaauaugcauucuaacauugacaaucuguguuguuagcaccucugcaguagagauggaaagccuuccagcaggcacuugggagagagaggaagaccugacaaauuucugucaucaggaaugccagguaaccgagacggagugccucuguccauacgaagcucuugugcucagaaaaccucuguucuuagacaguauaguuaaaggcaugaaaaauuugcuaaacucaacaagcuuagaaacaagcuuaucaaucgaggcaccauggggagcaauaaauguccagucaaccuuuaaaccaacaguaucgacugcaaacauagcacucaguuggagcucaguggagcacagaggcaacaagaucuuagucacaggcaggucugaaucaauuaugaaacuggaggaaaggacaggagucagcugggaucuaggcguagaggaugccucugaauccaaauuacuuaccgucucuaucauggaucugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcuggggaguaggaacuggcugcaccugcugcgggguggauguaaaagaccuuuuuacagaucacauguuugucaaguggaagguugaauauauaaaaacugaagccauaguauguguugagcucaccagccaagaaagacagugcagucugauugaggcagguaccagauucaacuugggcccugugacuauuacccugucugagccaagaaacauacagcagaagcuucccccugagauuaucacauugcaucccaaaguugaagagggcuucuuugacuugaugcaugugcaaaaaguguugucugcaaguacaguguguaaacugcagaguugcacacacgguauaccaggagaucuacaaguuuaccacauuggcaacuuacugaaaggagauaggauaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacauugaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcacaccaaaaaaguugagauaucaggcuugaaauuugcaagucuggcuugcacggguugcuaugcuuguagcucuggcaucuccuguaaagucaggauucauguagaugagccagaugagcucacaguacauguaaagagcagugauccagaugugguugcagccagcacaagucucauggcgaggaagcuugaguuugggacagacaguaccuucaaggccuuuucagcuaugcccaaaaccucuuuauguuuuuacauuguggagagagaauacuguaagagcugcagugaagaggacacacaaaaauguguugacacaagacuugagcagccgcagagcauacuaauugagcacaaaggaacgauaauuggaaagcagaaugauacuugcacagccaaggcaagcuguugguuagagucagucaagaguuuuuuuuauggauugaagaauaugcuugguagugucuuugguaauuuuuucauaggcauucuguuauuccuugccccuuuuguccuguuggugcuuuucuuuauguuuggguggaaaaucuuguuuugcuuuaaauguugcaggaggaccagaggcuuacuuaaguauagacaccucaaagacgaugaggaaacaggcuacagaaggauuauugaaagacugaacaacaaaaaagggaaaaacagacugcuugauggugaaagguuggcugauaggaagauugcugagcuguucuccacaaaaacacacauugguuaa

SEQ ID NO: 3681 - RNA, 5052 nt, Artificial Sequence
  derived and/or modified CDS sequence (wt) from CCHFV(ROS/HUVLV-100)__DQ206448.1__GP
augcauacacuauuagugugcuucauucuuuaccuacagcuguugggucuaggaggagcucauagacagucaaacgcaacugaacacaacggaacaaacaccaccacagcacccagcacaagucaaagccccaagccucuugugagcacagccccaccacacgcacuggaaucauccaccaucaaacccaccacaccaguaagcgaaacagaaggcucaggggaaacgaccccacccccaaacaccacccagggcccgucuccaccagaggccacaccagaacgccccacaacaacugccacaaguacgccaagcacagacaacacgaauuccaccacacaugugaccgacaacaacccuacaucaacaaucagcacaaguccauccagcagccccagcacgccauccacaccacaaggcauacaucauccugcaaggaaucuauugucagucucgagcccuaagacagcaacaacaccaacaccaacgagcccuggggagauaagcucagaaaccagcagucugcacucagccaugagcagaacaucaacccucuacacagcaacccaggucuccacugaaaaugccaaccacagcgcaccuagacagucugaguccucagcacagcagacaaccacaaguccaaugacuuccccagcacaaucaauccuuguaaugagugcugcuccuacagcuauucagaacauacaucccagcccaacgaauaggucuaagaggaaccuugagauggaaauaauuuuaacucugucucaaggucuaaagaaauacuaugguaagauacugaagcuucugcaccucaccuuggaagaggacacugaaggccuguuagaaugguguaagagaaaccuugggucaaacugugaugaugacuucuuucagaagagaauagaagaauucuucaugaccggugagggcuacuucaaugaagucuuacaauuuaaaacacuaagcacacuaagccccacggagccgucucaugccaggccaccaacaguggaacccuucaaaucuuacuucgcuaagggcuuccuuucaauagauucagguuacuucucugccaaauguuauccaagauuaucuacuucagggcuucagcugaucaaugucacccaacacccagcuagaauagcagaaacaccuggacccaagacaacgagucugaaaaccaucaacuguauaaaccuaagagcaucagucuucaaagaacacagagaaauugagaucaaugugcuucuuccucagauugcagucaaccucucaaauugccauguuguaaucaauucacaugucugugauuauucuuuagacacugaugggccagugaggcuuccucacauuuaccaugaagggacuuucauaccaggaacuuauaaaauagugauagacaaaaaaaauaagcuaaaugaccgauguacacuggucaccaacugugugauaaaaggaagagagguucguaagggccaaucagugcugaggcaguacaaaacagaaaucaagauaggcaaggcaucaacaggcucuaggaaacuacuguccgaggagccaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauaccaucaacagggugaagucauucaagcuaugcgaaaacagcgccacagggaaaaccugugagauagacagcacuccgguuaagugcaggcaagguuuuuguuuaaaaaucacccaagagggaaggggccacguaaaauuaucuagaggcucagagguuguuuuggaugcuugcgacucaagcugcgaaguaaugauaccuaaaggcacuggagauauccugguggacuguucagguggacagcaacauuucuuaaaagacaacuuaauugaccuagggugcccccauaucccgcuauuggguaaaauggccauuuacaucugcagaaugucaaaucauccuagaacaacuauggcuuuucucuucugguucagcuuuggcuaugugaucaccuguauauuuugcaaggcucuuuuuuauucauugauaauuauugggacacuagggaaaaagaucaagcaauauagggaauugaaaccucaaacuuguaccauaugugagacagccccugucaaugcaauagacgcugaaaugcaugaccuuaacugcaguuacaauauaugcccuuauugugcaucaagauugaccuccgaugggcuagcuaggcaugugccacaaugccccaagcggaaggaaaaaguugaggagacugagcuguacuugaaccuggaaagaauuccuuggauugucagaaagcuauugcaagugucagaguccacugguguggcauugaaacgaagcagcuggcugauuguacugcuuguguuacucacaguuucauugucaccgguucaaucagcaccuguuggucaugguaagacaaucgaaacauaucagaccagagaaggauucacaaguaucugucucuuuauguuaggaagcauccuguuuuuagucucuugcuuggugaaggggcugguugacagugucagugacagcuucuuccccggccugucugucuguaagacaugcucuauuggcaguauaaauggcuuugaaauugaaucgcauaaaugcuacuguagccuauuuugcugccccuacuguaggcacugcucugcugacagagaaauucaucaguuacacuugaguaucugcaaaaaaagaaaaacggguagcaaugucaugcuggcugucugcaaacgcaugugcuuuagggcaaccauagaagcaagcagaagagccuugcucauccgaagcauuauaaauaccacuuuuguaauaugcauuuuaacauugacaaucuguguuguuagcaccucugcaguagagauggaaaaccuuccaucaggcacuugggagagagaggaagaccugacaaauuucugucaucaggaaugccagguaaccgagacggagugccucuguccauacgaagcucuugugcucagaaaaccucuguucuuagacaguauaguuaaaggcaugaagaauuugcuaaacucaacaagcuuagaaacaagccuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguagaagaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcuggggaguaggaacuggcugcaccugcugcgggguggauguaaaagaccuuuuuacagaucacauguuugucaaauggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacauugcaucccaaaguugaagagggcuucuuugacuugaugcaugugcaaaaagugcugucugcaaguacaguguguaaacugcagaguugcacacaugguauaccaggagaucuacaaguuuaccauauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacaucgaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcauaccaagaaaguugagauaucaggcuuaaaauuugcaagucuggcuugcacggguugcuaugcuuguagcucuggcaucuccuguaaagucaggauucauguagaugagccagaugagcucacaguacauguaaagagcagugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaaugauacuugcacagccaaggcaagcuguuggcuagagucagucaagaguuuuuuuuauggauugaaaaauaugcuugguaguguauuugguaauuuuuucauaggcauuuuguuauuccuugccccuuuuguccuguuggugcuuuucuuuauguuuggauggaaaaucuuguuuugcuucaaauguugcaggaggaccagaggcuuacuuaaguauagacuccucaaagacgaugaggaaacaggcuacagaaggauuauugaaagacugaacaacaaaaagggaaaaaacagacugcuugauggugaaagguuggcugauaggaaaauugcugagcuguucuccacaaaaacacacauugguuga

SEQ ID NO: 3682 - RNA, 5052 nt, Artificial Sequence
  derived and/or modified CDS sequence (wt) from CCHFV(Saf)__KX013487.1__GP
augcauacacuauuagugugcuucauucuuuaccuacagcuguugggucuaggaggagcucauggacagucaaacgcaacugaacacaacggaacaaacaccaccacagcacccagcacaagucaaagccccaagccacuugugagcacagccccaccacacgcacuggaaucauccaccaucaaacccaccacaccagcaagcgaaacagaaggcucaggggaaacgaccccacccccaaacaccacccagggcccgucuccaccagagaccacaccagaacgccccgcaacaacugccacaaguacgccaagcacagacaacacgaauuccaccacacaugugaccgacaacaacccuacaucaacaaucagcacaaguccauccagcagccccagcacgccauccacaccacaaggcauacaucauccugcaaggaaucuauugucagucucgagcccuaagacagcaacaacaccaacaccaacgagcccuggggagauaagcucagaaaccagcagucugcacucagccaugagcagaacaucaacccucuacacagcaacccaggucuccacugaaaaugccaaccacagcgcaccuagacagucugaguccucagcacagccgacaaccacaagcccaaugacuuccccagcacaaucaauccuuguaaugagugcugccccuacagcuauucagaacauacaucccagcccaacgaauaggucuaagaggaaccuugagauggaaauaauuuuaacucugucucaaggucuaaagaaauacuacgguaagauacugaagcuucugcaccucaccuuggaagaggacacugaaggccuguuagaaugguguaagagaaaccuugggucaaacugugaugaugacuucuuucagaagagaauagaagaauucuucaugaccggugagggcuacuucaaugaagucuuacaauuuaaaacacuaagcacacuaagccccacggagccgucucaugccaggccaccaacaguggaacccuucaaaucuuacuucgcuaagggcuuccuuucaauagauucagguuacuucucugccaaauguuauccaagaucaucuacuucagggcuucagcugaucaauguuacccaacacccagcuagaauagcagaaacaccuggacccaagacaacgagucugaaaaccaucaacuguauaaaccuaagagcaucagucuucaaagaacacagagaaauugagaucaaugugcuucuuccucagauugcagucaaccucucaaauugccauguuguaaucaauucacaugucugugauuauucuuuagacacugaugggccagugaggcuuccucacauucaccaugaagggacuuucauaccaggaacuuauaaaauagugauagacaaagaaaauaagcuaaaugaccgauguacacuggucaccaacugugugauaaaaggaagagagguucguaagggccaaucagugcugaggcaguacaaaacagaaaucaagauaggcaaggcaucaacaggcucuaggaaacuacuguccgaggagccaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauaccaucaacagggugaagucauucaagcuaugcgaaaacagcgccacagggaaaaccugugagauagacagcacuccgguuaagugcaggcaagguuuuuguuuaaaaaucacccaagagggaaggggccacguaaaauuaucuagaggcucagagguuguuuuggaugcuugcgacucaagcugcgaaguaaugauaccuaaaggcacuggagauauccugguggacuguucagguggacagcaacauuacuuaaaagacaacuuaauugaccuagggugcccccauaucccgcuauuggguaaaauggccauuuacaucugcagaaugucaaaucauccuagaacaacuauggcuuuucucuucugguucagcuuuggcuaugugaucaccuguauauuuugcaaggcucuuuuuuauucauugauaauuauugggacacuagggaaaaagaucaagcaauauagggaauugaaaccucaaacuuguaccauaugugagacggcuccugucaaugcaauagacgcugaaaugcaugaccuuaacugcaguuacaauauaugcccuuauugugcaucaagauugaccuccgaugggcuagcuaggcaugugccacaaugccccaagcggaaggaaaaaguugaggagacugagcuguacuugaaccuggaaagaauuccuuggauugucagaaagcuauugcaagugucagaguccacugguguggcauugaaacgaagcagcuggcugauuguacugcuuguguuacucacaguuucauugucaccgguucaaucagcaccuguuggucaugguaagacaaucgaaacauaucagaccagagaaggauucacaaguaucugucucuuuauguuaggaagcauccuguuuuuagucucuugcuuggugaaggggcugguugacagugucagugacagcuucuuccccggccugucugucuguaagacaugcucuauuggcaguauaaauggcuuugaaauugaaucgcauaaaugcuacuguagccuauuuugcugccccuacuguaggcacugcucugcugacagagaaauucaccaguuacacuugaguaucugcaaaaaaagaaaaacggguagcaaugucaugcuggcugucugcaaacgcaugugcuuuagggcaaccauagaagcaagcagaagagcccugcucauccgaagcauuauaaauaccacuuuuguaauaugcauuuuaacauugacaaucuguguuguuagcaccucugcaguagagauggaaaaccuuccaucaggcacuugggagagagaggaagaccugacaaauuucugucaucaggaaugccagguaaccgagacggagugccucuguccauacgaagcucuugugcucagaaaaccucuguucucagacaguauaguuaaaggcaugaagaauuugcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguagaagaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcuggggaguaggaacuggcugcaccugcugcgggguggauguaaaagaccuuuuuacagaucacauguuugucaaauggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcaugugcaaaaaguguugucugcaaguacaguguguaaacugcagaguugcacacaugguauaccaggagaucuacaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacauugagacugauuacaugaaaaccuuccacuuccacucuaaaagaguuacagcacauggugacacaccacaauuagacuuaaaagcaaggccgaccuacggugcaggugagaucacugugcugguugagguugcugacauggaguugcauaccaagaaaguugagauaucaggcuugaaauuuguaagucuggcuugcacggguugcuaugcuuguagcucuggcaucuccuguaaagucaggauucauguagaugagccagaugagcucacaguacauguaaagagcagugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaaugauacuugcacagccaaggcaagcuguuggcuagagucagucaagaguuuuuuuuauggauugaaaaauaugcuugguaguguauuugguaacuuuuucauaggcauuuuguuauuccuugccccuuuuguccuguuggugcuuuucuuuauguuuggauggaaaaucuuguuuugcuucaaauguugcaggaggaccagaggcuuacuuaaguauagacaccucaaagacgaugaggaaacaggcuacagaaggauuauugaaagacugaacaacaaaaaaggaaaaaacagacugcuugauggugaaagguuggcugauaggaaaauugcugagcuguucuccacaaaaacacacauugguuaa

SEQ ID NO: 3683 - RNA, 5052 nt, Artificial Sequence
  derived and/or modified CDS sequence (wt) from CCHFV(52-R-2014)__KR814862.1__GP
augcauacgcuauuagugugcuucauucuuuaccuacagcuguugggucuaggaggagcucauagacagucaaacgcaacugaacacaacggaacaaacaccaccacagcacccagcacaagccaaagccccaagccaccugugagcacagccccaccacacgcaccagaaucauccaccaucaaacccaccacaccagcaagcgaaacagaaggcucaggggaaacgaccccacccccaaacaccacccagggcccgucuccaccagaggccacaccagaacgccccgcaacaacugccacaaguacgccaagcacagacaacacgaacuccaccacacacgcgaccgacaacaacccuacaucaacaaucagcacaaguccauccagcagccccagcacgccauccacaccacaaggcauacaucauccugcaaggaaucuauugucagucucgagcccuaagacagcaacaacaccaacaccaacgagcccuggggauauaagcucagaaaccagcagucugcacucagccaugagcagaacaccaacccuccacacagcaacccaggccuccacugaaaaugccaaccacagcgcaccuagacagucugaguccucagcacagcagacaaccacaagcccaaugacuuccccagcacaaccaauccuuguaaugagugcugcuccuacagcuauucagaacauacaucccagcccaacgaauaggucuaagaggaaccuugagauggaaauaauuuuaacucugucucaaggucuaaagaaauacuaugguaagauacugaagcuucugcaccucaccuuggaagaggacacugaaggccuguuagaaugguguaagagaaaccuugggucaaacugugaugaugacuucuuucagaagagaauagaagaauucuucaugaccggugagggcuacuucaaugaagucuuacaauuuaaaacacuaagcacacuaagccccacggagccgucucaugccaggccaccaacaguggaacccuucaaaucuuacuucgcuaagggcuuccuuucaauagauucagguuacuucucugccaaauguuauccaagauuaucuacuucagggcuucagcugaucaaugucacccaacacccagcuagaauagcagaaacaccuggacccaagacaacaagucugaaaaccaucaacuguauaaaccuaagagcaucagucuucaaagaacacagagaaauugagaucaaugugcuccuuccucagauugcagucaaccucucaaauugccauguuguaaucaauucacaugucugugauuauucuuuagacacugaugggccagugaggcuuccucacauuuaccaugaagggacuuucauaccaggaacuuauaaaauagugauagacaaaaaaaauaagcuaaaugaccgauguacacuggucaccaacugugugauaaaaggaagagagguucguaagggccaaucagugcugaggcaguacaaaacagaaaucaagauaggcaaggcaucaacaggcucuaggaaacuacuguccgaggagccaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauacuaucaacagggugaagucauucaagcuaugcgaaaacagcgccacagggaaaaccugugagauagacagcacuccgguuaagugcaggcaagguuuuuguuuaaaaaucacccaagagggaagaggccacguaaaauuaucuagaggcucagagguuguuuuggaugcuugcgacacaagcugcgaaguaaugauaccuaaaggcacuggagauauccugguggacuguucagguggacagcaacauuucuuaaaagacaauuuaauugaccuagggugcccccaugucccgcuauuggguaaaauggccauuuacaucugcagaaugucaaaucauccuagaacaacuauggcuuuucucuucugguucagcuuuggcuaugugaucaccuguauauuuugcaaggcucuuuuuuauucauugauaauuauugggacacuagggaaaaagaucaagcaauauagggaauugaaaccucaaacuuguaccauaugugagacagcuccugucaaugcaauagacgcugaaaugcaugaccuuaacugcaguuacaauauaugcccuuauugugcaucaagauugaccuccgaugggcuagcuaggcaugugccacaaugccccaagcggaaggaaaaaguugaggagacugagcuguacuugaaccuggaaagaauuccuuggauugucagaaagcuauugcaagugucagaguccacugguguggcauugaaacgaagcagcuggcugauuguacugcuuguguuacucacaguuucauugucaccgguucaaucagcaccuguuggucaugguaagacaaucgaaacauaucagaccagagaaggauucacaagugucugucucuuuauguuaggaagcauccuguuuuuagucucuugcuuggugaaggggcugguugacagugucagugacagcuucuuccccggccugucugucuguaagacaugcucuauuggcaguauaaauggcuuugaaauugaaucgcauaaaugcuacuguagccuauuuugcugccccuacuguaggcacugcucugcugacagagaaauucaucaguuacacuugaguaucugcaaaaaaagaaaaauggguagcaaugucaugcuggcugucugcaaacgcaugugcuuuagggcaaccauagaagcaagcagaagagcccugcucauccgaagcauuauaaauaccacuuuuguaauaugcauuuuaacauugacaaucuguguuguuagcaccucugcaguagagauggaaaaccuuccaucaggcacuugggagagagaggaagaccugacaaauuucugucaucaggaaugccagguaaccgagacggagugccucuguccauacgaagcucuugugcucagaaaaccucuguucuuagacaguauaguuaaaggcaugaagaauuugcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguagaugaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaacuugcuugcauaaagaauggccucacucaagaaacuggagauguaaucccacuuggugcuggggaguaggaacuggcugcaccugcugcgggguggauguaaaagaccuuuuuacagaucacauguuugucaaauggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcaugugcaaaaaguguugucugcaaguacaguguguaaacugcagaguugcacacaugguauaccaggagaucuacaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaauaucgaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcauaccaagaaaguugagauaucaggcuuaaaauuugcaagucuggcuugcacggguugcuaugcuuguagcucuggcaucuccuguaaagucaggauucauguagaugagccagaugagcucacaguacauguaaagagcaaugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaaugauacuugcacagccaaggcaggcuguuggcuagagucagucaagaguuuuuuuuauggauugaaaaauaugcuugguaguguauuugguaacuuuuucauaggcauuuugcuauuccuugccccuuuuguccuguuggugcuuuucuuuauguuuggauggaaaaucuuguuuugcuucaaauguugcaggaggaccagaggcuuacuuaaguauagacuccucaaagacgaugaggaaacaggcuacagaaggauuauugaaagacugaacaacaaaaaaggaaaaaacagacugcuugauggugaaagguuggcugauaggaaaauugcugaacuguucuccacaaaaacacacauugguuaa

SEQ ID NO: 3684 - RNA, 5052 nt, Artificial Sequence
  derived and/or modified CDS sequence (wt) from CCHFV(Turkey-Kelkit06)__GQ337054.1__GP
augcauacaccauuagugugcuucauucuuuaccuacagcuguugugucuaggaggagcucaugggcaguuaaacgcaacugaacacaauggaacaaacaacaccacagcaccuggcgcaagccaaagccccaagccacccaugagcacaaccccaccacacgcaccggaaucauccaccaucaaacccaccacaccaauaagcgaagcagaaggcucaggggaaacgaccucacccccaaacaccacccagggccuguccucgccagagaccacaucagaacgcccugcaacaaccuccaucagcacgucaagcacagacagcacgaaccccaccacacagaugaccgacaacacccccacaccaacagucagcacaagcccauccagcagccccagcacgccauccacaccacaaggcauacaucauccugcaaggagucuguugucagucucgagccccaagacaguaacaacaccaacaccaacgagcccuggagagaugagcucggaaaccagcagucagcacucagccaugagcagaauaccaaccccccacacagcaacccgggucuccacugagaucaccaaccaccgcacaccuagacaaucugaauccucagcacagcagacaaccccaagcccaaugacuuccccagcgcaaucgauccuucuaaugagugcugcuccuacagcuguucaagacauacaucccagcccaacaaacaggucuaagaggaaccuugagacggaaauaauuuuaacucuaucucaaggucuaaagaaauacuacgguaagauacugaagcuucugcaccucaccuuagaacaggacaccgaaggccugcuagaaugguguaagggaaaccuugggucaaacugugaugaugacuucuuucaaaagagaauagaagaauucuucaugacuggugagugcuacuucaaugaagucuuacaauuuaaaacacuaagcacacuaagccccacggagccgucucaugccaggcuaccaacagcagaacccuucaaaucuuacuuugcuaagggcuuccuuucaauagauucagguuacuucucugccaaauguuauccaagaucaucugcuucagggcuucagcugaucaauguuacccaacacccagcuaggauagcagaaacaccuggacccaagacaacaagucugaaaaccaucaacuguauaaaccuaagagcaucagucuucaaagaacacagagaaguugagaucaaugugcuucuuccucagauugcagucaaccucucaaacugccauguugugaucaauucacaugucugugauuacucuuuagacacugaugggccagugaggcuuccucgcauuuaucaugaagggacuuucauaccaggaacuuauaaaauagugauagacaaaaaaaauaagcuaaaugaccguuguacacuggucaccaacugugugauaaagggaagagagguucguaaggggcaaucagugcugaggcaguacaaaacagaaaucaagauaggcaaggcaucaacaggcuuuaggaaacuacuguccgaagagccaggugaugacugcauaucaagaacucagcuauugaggacagaaacagcagagauccaugaugacaacuauggugguccaggugauaaaauaacuaucugcaacgguucaaccauuguagaucagagacugggcagugaacuaggguguuauaccaucaacagggugaagucauucaagcuaugcaaaaacagcgccacagggaaaaccugugagguagacagcacuccgguuaagugcaggcaagguuuuuguuuaaaaaucacccaagagggaaggggccacguaaaauuaucuagaggcucagagguuguccuggaugcuugcgacucaagcugugaaguaaugauaccuaaaggcacuggggauauccuaguggacuguucaggugggcagcaacauuucuuaaaagacaacuuaauugaccuagggugcccccauaucccgcuauuggguaggauggcuauuuacauuugcagaaugucaaaucauccuagaacaaccauggcuuuucucuucugguucagcuuuggcuauguuaucacuuguauauuuugcaaggcucuuuuuuauucauugauaauuauuggaacacuaggaaaaaagaucaagcaauauagggaacugaaaccucaaaccugcaccauaugugagacagcuccugucaaugcaauagaugcugaaaugcaugaccucaacuguaguuacaauauaugcccuuauugugcaucaagauugaccuccgaugggcuagccaggcauguaacgcaaugccccaagcggaaagagaaaguugaggagacugaacuguaccugaaccuggaaagaauuccuuggauugucagaaagcuauugcaggugucagaguccacugguguggcauugaaacgaagcagcuggcugauuguacugcuuguguuacugacaguuucguugucgccgguucagucagcaccuguuggucauggaaagacaaucgaaauauaucagaccagggaaggauucgcaagcaucugucucuuuauguuaggaagcauucuauuuauagucucuugcuuggugaaagggcuaguugacagugucagugaaagcuucuuccccggccuaucugucuguaagacaugcucuauuggcaguguaaauggcuuugaaauugaaucgcacaaaugcuacuguagccuauuuugcugccccuacuguaggcacugcucugcugacagagaaauucaccaguuacacuugaguaucugcaaaaaaaggaaaacggggagcaaugucaugcuggccgucugcaaacgcaugugcuuuagggcaaccauagaagcaagcagaagagcccugcucauccgaagcauuaucaauaccacuuuuguaauaugcauucuaacauugacaaucuguguuguuagcaccucugcaguggagauggaaaaccuuccagcaggaacuugggagagggaggaagaucugacaaauuucugucaucaggaaugccaggugacugagacagaaugccucuguccauacgaagcucuugugcucagaaaaccucuuuucuuggacaguauaguuaaagguaugaaaaauuugcuaaacucaacaagcuuggaaacaagcuuaucaauugaggcaccauggggagcaauaaauguccaaucaaccuuuaaaccaacuguaucgacugcaaacauagcacucaguuggagcucaguggugcacagaggcaacaagaucuuggucacaggcaggucugaaucaauuaugaaacuggaggaaaggacaggagucagcugggaucuaggcguagaagaugccucugaauccaaauuacuuaccguuucuaucauggauuugucacaaauguauucuccuguuuuugaguacuugucaggagacagacagguugaagaauggcccaaagcaacuuguacaggugauugcccggaaaggugugguugcacaucaucaaccugcuuacauaaagaauggucucacucaagaaacuggagauguaaucccacuuggugcuggggaguaggaaccggcugcaccugcugcgggguggauguaaaagaucuuuuuaccgaucacauguuugucaaauggaaaguugaauacauaaaaacugaagcuauaguauguguugcgcucaccagccaagaaagacagugcagucugauugaggcagguacuagauucaacuugggcccugugacuauuacccugucugagccaagaaacauucagcagaagcuuccuccugagauuaucacguugcaucccaaaauugaagaaggcuucuuugacuugaugcauguacaaaaaguguugucugcaaguacaguguguaaacugcagaguugcacacaugguauaccaggagaucuacaaguuuaccacauuggcaacuuguugaaaggggauagaguaaacgggcaucuaauucacaaaauugaaucacauuucaacaccucuuggauguccugggaugguugugacuuagacuacuacugcaacaugggggauuggccaucuugcacauacacaggagugacccagcauaaccaugcugcauuuguaaacuugcuuaacauugaaacugauuacacgaaaaccuuccacuuccacucuaaaagagucacagcacauggugacacaccacaauuggacuuaaaagcaaggccgaccuacggugcaggugggaucacugugcugguugagguugcugacauggaguugcauaccaagaaaguugaaauaucaggcuugaaauuugcaagucuggcuugcacggguugcuaugcuuguagcucuggcaucuccuguaaaguuaggauucauguagaugaaccagaugagcucacaguacauguaaagagcagugauccagaugugguugcagcuagcacaagucucauggcgaggaagcuugaauuugggacagacagcacauucaaggccuuuucagcuaugcccaaaaccucucuauguuuuuacauuguggagagagaauacugcaagagcugcagugaagaugauacacaaaaauguguugacacaagacuugagcagccacagagcauacuaauugagcacaaaggaacgauaauuggaaagcagaaugauacuugcacagccaaggcaagcuguuggcuagagucagucaagaguuuuuuuuauggauugaagaauaugcuuggcaguguuuuugguaaucuuuucauaggcauuuuguuauuccuugccccuuuuguccuguuggugcuuuucuuuauguuuggguggaaaaucuuguuuugcuuuaaauguugcaggaggaccagaggcuuauuuaaguauagacaccucaaagacgaugaggaaacaggcuacagaaggauuauugaaagacugaacagcaaaaaagggaaaaacaggcugcuugauggugauagacuggcugauaggaaaauugcugagcuguucuccacaaaaacacacauuggcuaa

SEQ ID NO: 3685 - RNA, 5052 nt, Artificial Sequence
  derived and/or modified CDS sequence (wt) from CCHFV(V42/81)__GU477490.1__GP
augcauacacuauuagugugcuucauucuuuaccuacaacuguugggucuaggaggagcucauguacagccaaacgcaacugaacacaauagaacaaacaccaccacagcacccggcacaagccauagccucaagccacuugugagcacaaccccaccacaagcaccggaaucauccaccauuaaacccacuacaccaacaagcgaaacagaaggcucaggggaagcgaccccacuuucaaacaccauccaggccccguccucaccagagaccacaucagaacgccccgcaacagcugucauaagcacgucaggcacagacagcacgaacuccaccacacagacgaccgauaauaaccccacaacaacagucggcacaaguccauccagcagccccaguacgccauccacaccacaaggcauacaccaucaugcaaggagucuauugucagucacgagcccugagacaguaacaacaccaaaaccaacgagcccuagggagaugagcucggaaaccagcaaucaacacucagccaugagcaggacaccaacccaccacacaguaacccaggucuccacugagaacaccagccacagcacacccagacagccugaguccucagcacagccgacauccucaagcccaaugacuuccccagcgcaaucaacccuucuaaugagugcugcuccuacagcuguccagagcauacaucccagcccaacgaacaggucuaagaggaaccuugagacggaaauaauuuuaacucuaucccagggucuaaagaaauacuacggcaaaauacuaaaacuucugcaccuuaccuuggaagaggacacugaaggccuguuagaaugguguaagagaaaccuugggucaaacugugaugaugacuucuuucaaaagagaauagaagaauucuucaugacuggugagggcuacuucaaugaagucuuacaauuuaaaacaccaagcacaguaagccccacggagccaucucaugccagacuaccaacagcagaacccuucaaaucuuacuucgcuaaggguuuccuuucaauagauucggguuacuucucugccaaauguuacucgagaucaucuacuucagggcuucagcugaucaauguuacccaacacccagcuaggauagcagaaacaccuggacccaaaacaacgagucugaaaaccaucaacuguauaaaccugagagcaucagucuucaaagaaaacagagaaauugagaucagugugcuucuuccucagauagcagucaaccucucaaacugccauguugugauuaauucacaugucugugauuacucuuuagacacugaugggccagugaggcuuccucgcauuaaccaugaagggacuuucauaccaggaacuuauaaaauagugauagacaaaaaaaauaagcuaaaugaccgauguacacuggucacuaacugugugauaaagggaagagagguucguaagggccaaucagugcugaggcaguacaaaacagaaauuaagauaggcaaggcaucaacaggcucuaggaaacuacuguccaaagagccaggugaugacuguauaucaagaacucagcuaaugaggacagaaacagcagagauccaugaugacaacuauggugguccaggugauaaaauaacuaucugcaaugguucaaccauuguggaucagagacugggcagugaacuaggguguuauaccaucaacagggugaagucauucaagcuaugugaaaacagcgccacagggaaagccugugaaguggacagcacuccgguuaagugcaggcaggguuuuuguuuaaaaaucacccaagagggaaggggccauguaaaguuaucuagaggcucagagguugucuuggaugcuugcgacucaagcugugaaguaaugauaccuaaaggcacuggagauauccuaguggacuguucagguggacagcaacauuucuuaaaggacaacuuaauugaccuagagugcccucauaucccgcuauuagguaaguuggccauuuacauuugcagaaugucaaaucauccuagaacaacuauggcuuuucucuucugguucggcuuuggcuaugugaucaccuguauacucugcaaggcucuuuuuuauucauugauaauuauugggacacuagggaaaaagaucaagcaauauagggaacugaaaccucaaacuugcaccauaugugagacagcuccugucaaugcaauagaugcugaaaugcaugaccuuaacuguaguuacaauauaugcccuuauugugcaucaagauugaccuccgaugggcuagcuaggcauguaacgcaaugccccaagcgaaaagagaaaguugaggagacugaacuguacuugaaucuggagagaauuccuuggauugucaggaagcuccugcaagugucggaguccacuggcgugguauugaaacgaagcaguuggcugauugugcugcuuguguuacucacaguuucauugucaccaguucagucagcaccuguuggucaugguaagacaauugaaacauaucagaccagagaaggauucacaagcaucugucucuuuauguuaggaagcauccuauuuauagucucuugcauagugaaggggcugguugacagugucagugacagcuucuuccccggccugucugucuguaagacaugcucuaucagcaguauaaauggcuuugaaauugaaucgcauaaaugcuacuguagcuuauuuugcugccccuacuguaggcacugcucugcugacagagaaauucaccaguuacacuugaguaucugcaggaaaagaagaacggggagcaaugucaugcuggcugucugcaaacgcaugugcuuuagggcaaccauagaaguaagcagaagagcccugcucauccgaagcaucaucaauaccacuuuuguaauauguauucuaacauuaacaaucuguguuguuagcacuucugcaguagagauggaaaaccucccagcaggcacuugggagagagaggaagaccuaacaaauuucugucaucaggaaugccagguaaccgagacggagugccucuguccauacgaagcucuugugcucagaaaaccucuuuucuuagacaguauaguuaaagguaagaaaaauuuguuaaacucaacaaguuuggaaacaagcuuaucaauugaagcaccauggggagcaauaaauauccagucaaccuuuaaaccaacaguaucggcugcaaacauagcacucaguuggagcucaguggagcacagaggcaacaagaucuuagucucaggcaggucugaaucaauuaugaaacuagaggaaagaacaggagucagcuggaaucuagguguagaagaugccucugaauccaaauuacuuaccgucucuaucauggauuugucacaaauguauuccccuguuuuugaguacuugucaggagacagacagguugaagaauggccuaaagcaacuuguacaggugacugcccagaaaggugugguugcacaucaucaaccugcuugcauaaagaauggccucacucaagaaacuggagaugcaauccuacuuggugcugggggguaggaaccggcugcaccugcugcggaguggauguaaaagaccuuuuuauagaucacauguuuguuaaauggaagguugaauauauaaaaacugaagccauaguauguguugagcucaccagccaagaaagacagugcagucugauugaggcagguacuagauucaacuugggcccugugacuauuacccuauccgagccaagaaacauucagcagaagcuucccccugagauuaucacguugcaccccaaaauugaagaaggcuucuuugacuugaugcauguacaaaaaguguugucugccaguacaguguguaaacugcaaaguugcacacaugguauaccaggagaucugcaagucuaccacauuggcaaccuauugaaaggggauagaguaaacgggcaucuaauucacaaaaucgaaccacauuuuaacaccucuuggauguccugggaugguugugaccuagacuacuacugcaacaugggggauuggccuucuugcacauacacaggagugacccagcacaaucaugcugcauuuguaaacuugcuuaacauugaaacugauuacacgaaaacuuuccacuuccacucuaaaagaguuacagcacauggugaaacaccacaauuagacuuaaaagcaaggccggcauacggugcaggugagaucacugugcugguugagguugcugacauggaguugcauaccaagaaaguugagauaucaggcuugaaauuugcaagucuggcuugcacggguugcuaugcuuguagcucuggcaucuccuguaaagucaggauucauguagaugaaccagaugagcucacaguacaugugaagagcaaugauccagaugugguugcagcuagcacaagucucauggcaaggaagcuugaaucugggacagacagcacauuuaaggccuuuucagcuaugcccaaaaccucuuuauguuuuuacauuguggagagagaauacugcaagagcugcagugaagaugauacacagaaauguguugaaacaaaacuugaacagccacaaagcauacuaauugaacacaaaggaacgauaauuggaaagcagaaugauacuugcacagccaaggcaagcuguuggcuggaaucagucaagaguuuuuuuuauggauugaagaacaugcuuggcaguguuuuugguaauuuuuucauaggcauuuuguuauuccuugcccccuuuguccuguuaguacuuuucuuuauguuuggauggaaaaucuuguuuugcuuuaaauguugcaggaggaccagaggcuuguuuaaguauagacaccucaaagaagaugaggaaacaggcuacagaaggauuauugagagacugaacagcaaaaaagggaaaaacagacugcuugauggugaaagguuggcugauaggaaaauugcugagcuguucucuacaaaaacacacauuggcuaa

SEQ ID NO: 3686 - RNA, 5052 nt, Artificial Sequence
  derived and/or modified CDS sequence (wt) from CCHFV(75-R-2012)__KR814863.1__GP
augcauacacuauuagugugcuucauucuuuaccuacagcuguugggucuaggaggagcucauagacagucaaacgcaacuggacacaacggaacaaacaccaccacagcacccagcacaagucaaagccccaagccacuugugagcacagccccaccacacgcacuggaaucauccaucaucaaacacaccacaccaguaagcgaaacagaaggcucaggggaaacgaccccacccccaaacaccacccagggcccgucuccacuagagaccacaccagaacgccccgcaacaacugccacaaguacgccaagcacagacaacacgaauuccaccacacaugugaccgacaacaacccuacaucaacaaucagcacaaguccauccagcagccccagcacgccauccacaccacaaggcauacaucauccugcaaggaaucuauugucagucucgagccuuaagacagcaacaacaccaacaccaacgagcccaggggagauaagcucagaaaccagcagucugcacucagccaugagcagaacaucaacccucuacacagcaacccaggucuccacugaaaaugccaaccacagcgcaccuagacagucugaguccucagcacagcagacaaccacaagcccaaugacuuccccagcacaaucaauccuuguaaugagugcugcuccuacagcuauucagaacacacaucccagcccaacgaauaggucuaagaggaaccuugagauggaaauaauuuuaacucugucucaaggucuaaagaaauauuaugguaagauacugaagcuucugcaccucaccuuggaagaggacacugaaggccuguuagaaugguguaagagaaaccuuggaucaaacugugaugaugacuucuuucagaagagaauagaagaauucuucaugaccggugagggcuacuucaaugaagucuuacaauuuaaaacacuaagcacacaaagccccacggagccgucucaugccaggccaccaacaguggagcccuucaaaucuuacuucgcuaagggcuuccuuucaauagauucagguuacuucucugccaaauguuauccaagauuaucuacuucagggcuucagcugaucaaugucacccaacacccagcuagaauagcagaaacaccuggacccaagacaacgagucugaaaaccaucaacuguauaaaccuaagagcaucagucuucaaagaacacagagaaauugagaucaaugugcuucuuccucagauugcagucaaccucucaaauugccauguuguaaucaauucacaugucugugauuauucuuuagacacugaugggccagugaggcuuccucacauuuaccaugaagggacuuucauaccaggaacuuauaaaauagugauagacaaaaaaaauaagcuaaaugaccgauguacacuggucaccaacugugugauaaaaggaagagagguucguaagggccaaucagugcugaggcaguacaagacagaaaucaagauaggcaaggcaucaacaggcucuagaaaacuacuguccgaggagccaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauaccaucaacagggugaagucauucaagcuaugcgaaaacagcgccacagggaaaaccugugagauagacagcgcuccgguuaagugcaggcaagguuuuuguuuaaaaaucacccaagagggaaggggccacguaaaauuaucuagaggcucagagguuguuuuggaugcuugcgacucaagcugcgaaguaaugauaccuaaaggcacuggagauauccugguggacuguucagguggacagcaacauuucuuaaaagacaacuuaauugaccuagggugcccacauaucccgcuauuggguaaaauggccauuuacaucugcagaaugucaaaucauccuagaacaacuauggcuuuucucuucugguucagcuuuggcuaugugaucaccuguauauuuugcaaggcucuuuuuuauucauugauaauuauugggacacuagggaaaaagaucaagcaauauagggaauugaaaccucaaacuuguaccauaugugagacagccccugucaaugcaauagacgcugaaaugcaugaccuuaacugcaguuacaauauaugcccuuauugugcaucaagauugaccuccgaugggcuagcuaggcaugugccacaaugccccaagcggaaggaaaaaguugaggagacugagcuguacuugaaccuagaaagaauuccuuggauugucagaaagcuauugcaagugucagaguccacugguguggcauugaagcgaagcagcuggcugauuguacugcuuguguuacucacaguuucauugucaccgguucaaucagcaccuguuggucaugguaagacaaucgaaacauaucagaccagagaaggauucacaaguaucugucucuuuauguuaggaagcauccuguuuuuagucucuugcuuggugaaggggcugguuaacagugucagugacagcuucuuccccggccugucuguuuguaagacaugcucuauuggcaguauaaauggcuuugaaauugaaucgcauaaaugcuacuguagccuauuuugcugccccuacuguaggcacugcucugcugacagagaaauucaucaguuacacuugaguauuugcaaaaaaagaaaaacggguagcaaugucaugcuggcugucugcaaacgcaugugcuuuagggcaaccauagaagcaagcagaagagcccugcucauccgaagcauuauaaauaccacuuuuguaauaugcauuuuaacauugacaaucuguguuguuagcaccucugcaguagagauggaaaaccuuccaucaggcacuugggagagagaggaagaccugacaaauuucugucaucaggaaugccagguaaccgagacggagugccucuguccauacgaagcucuugugcucagaaaaccucuguucuuagacaguauaguuaaaggcaugaagaauuugcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcagguccgaaucaauuaugaaacuggaggaaaggacaggagucagcugggaucuaggcguagaagaugccucugaguccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcuggggaguagguacuggcugcaccugcugcgggguggauguaaaagaccuuuuuacagaucacauguuugucaaauggaagguugaauauauaaaaacugaagccauaguauguguugagcucaccagucaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcaugugcaaaaaguguugucugcaaguacaguguguaaacugcagaguugcacacaugguauaccaggagaucuacaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacauugaaacugauuacacgaaaaccuuccacuuccacucuaaaagaguuacagcacauggugacacaccacaauuagacuuaaaagcaaggccgaccuacggugcaggugagaucaccgugcugguugagguugcugacauggaguugcauaccaagaaaguugagauaucaggcuuaaaauuugcaagucuggcuugcacggguugcuaugcuuguagcucuggcaucuccuguaaagucaggauucauguagaugagccagaugagcucacaguacauguaaagagcagugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaaugauacuugcacagccaaggcaagcuguuggcuagagucagucaagaguuuucuuuauggauugaaaaauaugcuugguaguguauuugguaacuuuuucauaggcauuuuguuauuccuugccccuuuuguccuguuggugcuuuucuuuauguuuggauggaaaaucuuguucugcuucaaauguugcaggaggaccagaggcuuacuuaaguauagacuccucaaagacgaugaggaaacaggcuacagaaggauuauugaaagacugaacaacaaaaaaggaaaaaacagacugcuugauggugaaagguuggcugauaggaaaauugcugagcuguucuccacaaaaacacacauugguuaa

SEQ ID NO: 3687 - RNA, 5052 nt, Artificial Sequence
  derived and/or modified CDS sequence (wt) from CCHFV(VLG/TI29414)__AY179961.1__GP
augcauacgcuauuagugugcuucauucuuuaccuacagcuguugggucuaggaggagcucauauacagucaaacgcaacugaacacaacggaacaaacaccaccacagcacccagcacaagucaaagccccaagccacuugugagcacagccccaccacacgcacuggaaucauccaccaucaaacccaccacaccaguaagcgaaacagaaggcucagggggaacgaccccacccccaaacaccacccagggcccgucuccaccagaggccacaccagaacgccccgcaacaacugccacaaguacgccaagcacagacaacacgaauuccaccacacaugugaccgacaacaacccuacaucaacaaucagcacaaguccauccagcagccccagcacgccauccacaccacaaggcauacaucauccugcaaggaaucuauugucagucucgagcccuaagacagcaacaacaccaacaccaacgagcccuggggauauaagcucagaaaccagcagucugcacucagccaugagcagaacaucaacccucuacacagcaacccaggucuccacugaaaaugccaaccacagcgcaccuagacagucugaguccucagcacagcagacaaccacaagcccaaugacuuccccagcacaaccaauccuuguaaugagugcugcuccuacagcuauucagaacauacaucccagcccaacgaauaggucuaagaggaaccuugagauggaaauaauuuuaacucugucucaaggucuaaagaaauacuaugguaagauacugaagcuucugcaccucaccuuggaagaggacacugaaggccuguuagaaugguguaagagaagccuugggucaaacugugaugaugacuucuuucagaagagaauagaagaauucuucaugaccggugagggcuacuucaaugaagucuuacaauuuaaaacacuaagcacacuaagccccacggagccgucucaugccaggccaccaacaguggaacccuucaaaucuuacuucgcuaagggcuuccuuucaauagauucagguuacuucucugccaaauguuauccaagauuaucuacuucagggcuucagcugaucaaugucacccaacacccagcuagaauagcagaaacaccuggacccaagacaacaagucugaaaaccaucaacuguauaaaccuaagagcaucagucuucaaagaacacagagaaauugagaucaaugugcuccuuccucagauugcagucaaccucucaaauugccauguuguaaucaauucacaugucugugauuauucuuuagacacugaugggccagugaggcuuccucacauuuaccaugaagggacuuucauaccaggaacuuauaaaauagugauagacaaaaaaaauaagcuaaaugaccgauguacacuggucaccaacugugugauaaaaggaagagagguucguaagggccaaucagugcugaggcaguacaaaacagaaaucaagauaggcaaggcaucaacaggcucuaggaaacuacuguccgaggagccaggugaugacugcauaucaagaacucagcuauugagggcagaaccagcagagauccaugaugacaacuauggugguccaggugauaaaauaacuaucugcaaugguucaaccauuguagaucagagacugggcagugaacuaggguguuauaccaucaacagggugaagucauucaagcuaugcgaaaacagcgccacagggaaaaccugugagauagacagcacuccgguuaagugcaggcaagguuuuuguuuaaaaaucacccaagagggaaggggccacguaaaauuaucuagaggcucagagguuguuuuggaugcuugcgacucaagcugcgaaguaaugauaccuaaaggcacuggagauauccugguggacuguucagguggacagcaacauuucuuaaaagacaauuuaauugaccuagggugcccccauaucccgcuauuggguaaaauggccauuuacaucugcagaaugucaaaucauccuagaacaacuauggcuuuucucuucugguucagcuuuggcuaugugaucaccuguauauuuugcaaggcucuuuuuuauucauugauaauuauugggacacuagggaaaaagaucaagcaauauagggaauugaaaccucaaacuuguaccauaugugagacagccccugucaaugcaauagacgcugaaaugcaugaccuuaacugcaguuacaauauaugcccuuauugugcaucaagauugaccuccgaugggcuagcuaggcaugugccacaaugccccaagcggaaggaaaaaguugaagagacugagcuguacuugaaccuggaaagaauuccuuggaaugucagaaagcuauugcaagugucagaguccacugguguggcauugaaacgaagcagcuggcugauuguacugcuuguguuacucacaguuucauugucaccgguucaaucagcaccuguuggucaugguaagacaaucgaaacauaucagaccagagaaggauucacaaguaucugucucuuuauguuaggaagcauccuguuuuuagucucuugcuuggugaaggggcugguugacagugucagugacagcuucuuccccggccugucugucuguaagacaugcucuauuggcaguauaaauggcuuugaaauugaaucgcauaaaugcuacuguagccuauuuugcugccccuacuguaggcacugcucugcugacagagaaauucaucaguuacacuugaguaucugcaaaaaaagaaaaauggguagcaaugucaugcuggccgucugcaagcgcaugugcuuuagggcaaccauagaagcaagcagaagagcccugcucauccgaagcauuauaaauaccacuuuuguaauaugcauuuuaacauugacaaucuguguuguuagcaccucugcaguagagauggaaaaccuuccaucaggcacuugggagagagaggaagaccugacaaauuucugucaucaggaaugccagguaaccgagacggagugccucuguccauacgaagcucuugugcucagaaaaccucuguucuuagacaguauaguuaaaggcaugaagaauuuacuaaacucaacaaacuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguagaagaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcugggaaguaggaacuggcugcaccugcugcggguggaauguaaaagaccuuuuuacagaucacauguuugucaaauggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacgcugcaucccaaaguugaagagggcuucuuugacuugaugcaugugcaaaaaguguugucugcaaguacaguguguaaacugcagaguugcacacaugguauaccaggagaucuacaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggaaugacccagcauaaccaugcugcauuuguaaacuugcuuaauaucgaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcauaccaagaaaguugagauaucaggcuuaaaauuugcaagucuggcuugcacggguugcuaugcuuguagcucuggcaucuccuguaaagucaggauucauguagaugagccagaugagcucacaguacauguaaagagcaaugauccagaugugauugcagcuagcacaagucucauggcgaggaagcuugaauuugggacagacaguacauucaaggccuuuucagcuaugcccaaaaccucuuuauguuuuuacauugcggagagagaauacugcaagagcugcagugaagaggacacacaaaaauguguugacacaaaacuugagcagccacagagcauacuaauugagcacaaaggaacgauaauuggaaagcagaaugauacuugcacagccaaggcaagcuguuggcuagagucagucaagaguuuuuuuuauggauugaaaaauaugcuugguaguguauuugguaacuuuuucauaggcauuuuguuauuccuugccccuuuuguccuguuggugcuuuucuuuauguuuggauggaaaaucuuguuuugcuucaaauguugcaggaggaccagaggcuuacuuaaguauagacuccucaaagacgaugaggaaacaggcuacagaaggauuauugaaagacugaacaacaaaaaaggaaaaaacagacugcuugauggugaaagguuggcugauaggaaaauugcugagcuguucuccacgaaaacacacauugguuaa

SEQ ID NO: 3688 - RNA, 5055 nt, Artificial Sequence
  derived and/or modified CDS sequence (wt) from CCHFV__KJ648916.1__GP
augcauauaucauuaauguaugcaauccuuugccuacagcuguguggucugggagagacucauggaucacacaaugaaacuagacacaauaaaacagacaccaugacaacacccggugauaacccgagcucugaaccgccagugagcacggccuugucuauuacacuugaccccuccacugucacacccacaacaccagccaguggauuagaaggcucaggggaagucuacacauccccuccgaucaccaccgggagcuugccccugucggagacaacaccagaacucccuguuacaaccggcacagacaccuuaagcgcaggugaugucgaucccagcacgcagacagccggaggcaccuccgcaccaacaguccgcacaagucuacccaacagcccuagcacaccaucuacaccacaagacacacaccauccugugagaaaucuacuuucagucacgaguccugggccagaugaaacaucaacacccucgggaacaggcaaagagagcucagcaaccaguagcccucauccagucuccaacagaccaccaaccccuccugcaacagcccagggacccacugaaaaugacagucacaacgccacugaacacccugagucccugacacagucagcaaccccaggccuaaugaccucuccaacacagauaguccacccacaaagugccacccccauaaccguucaagacacacaucccaguccaacgaacgccucuaaagccaaccuuaagauggaaauaaucuugacuuuaucucaggguuuaaaaaaguacuaugggaaaauauuaaggcuucugcaacucaccuuagaggaggacacugaaggucuacuggaaugguguaagagaaaucuuggucuugauugugaugacacuuucuuucaaaagagaauugaagaauucuuuauaacuggugagggccauuuuaaugaaguuuuacaauuuagaacgccaggcacguugagcaccacagagucaacaccugcugggcugccaacagcugaaccuuuuaaguccuacuucgccaaaggauuccucucgauagauucagguuacuacucagccaaauguuacucaggaacauccaauucagggcuucaauugauuaacauuacccgacauucaacuagaauaguugacacaccugggccuaagaucacuaaccuaaagaccaucaacugcauaaacuugaaggcaucgaucuucaaagaacauagagagguugaaaucaaugugcuucucccccaaguugcaguuaaucucucaaacugucacguuguaaucaaaucacaugucugugacuacucuuuagacauugacggugcggugaggcuuccucacauuuaccaugaaggaguuuucaucccaggaacuuacaaaauagugauagauaaaaaaaauaaguugaaugacagaugcaccuuauuuaccgacugugugauaaaaggaagggagguucguaaaggacagucaguuuugaggcaguacaagacggaaaucaggauuggcaaggcaucaaccggcucuagaagauugcuuucagaagaacccagugaugacuguauaucaagaacucaacuauuaaggacagagacugcagagauccacggcgacaacuaugguggcccgggugacaaaauaaccaucugcaauggcucaacuauuguagaccaaagacugggcagugaacuaggaugcuacaccaucaauagagugaggucauucaagcuaugcgaaaacagugccacagggaagaauugugaaauagacagugucccaguuaaaugcaggcaggguuauugccuaagaaucacucaggaagggaggggccacguaaaauuaucuaggggcucagagguugucuuagaugcaugcgauacaagcugugaaauaaugauaccuaagggcacuggugacauccuaguugacuguucaggugggcagcaacauuuucuaaaggacaauuugauagaucuaggaugccccaaaauuccauuauugggcaaaauggcuauuuacauuugcagaaugucaaaccaccccaaaacaaccauggcuuuccucuucugguucagcuuuggcuauguaauaaccugcauacuuugcaaggccauuuuuuacuuguuaauaauuguuggaacacuagggaaaaggcucaagcaguauagagaguugaaaccucagacuugcaccauaugugagacaacuccuguaaaugcaauagaugcugagaugcaugaccucaauugcaguuacaacauuugucccuacugugcaucuagacuaaccucagaugggcuugcuaggcaugugauacaaugcccuaagcggaaggagaaaguggaagaaacugaacuguacuugaacuuagaaagaauuccuuggguuguaagaaagcuguugcaggugucagagucaacugguguggcauugaaaagaagcaguuggcugauugugcugcuugugcuauucacuguuucauuaucaccaguucaaucagcacccauuggucaagggaagacaauugaggcauaccgggccagggaaggguacacaaguauaugccucuuuguacuaggaaguauccuauuuauaguuucuugccuaaugaaagggcugguugacaguguuggcaacuccuucuucccuggacuguccauuugcaaaacgugcuccauaagcagcauuaauggcuuugaaauugagucccauaagugcuauugcagcuuauucuguugccccuauuguaggcacugcucuaccgauaaagaaauucauaagcugcacuugagcaucugcaaaaaaaggaaaaaaggaaguaaugucauguuggcugucugcaagcucauguguuucagggccaccauggaaguaaguaacagagcccuguuuauccguagcaucaucaacaccacuuuuguuuugugcauacugauacuagcaguuuguguuguuagcaccucagcaguggagauggaaaaccuaccagcagggaccugggaaagagaagaagaccuaacaaauuucugucaucaggaaugccagguuacagagacugaaugccucugcccuuaugaagcucuaguacucagaaagccuuuauuccuagauaguacagcuaaaggcaugaaaaaucugcuaaauucaacaaguuuagaaacgaguuuaucaauugaggcaccauggggagcaauaaauguucagucaaccuacaaaccaacugugucaacugcaaacauagcacucaguuggagcucaguggaacacagaggcaauaagaucuugguuucaggcagaucagaaucaauuaugaagcuggaagaaaggacaggaaucagcugggaucucgguguagaagaugccucugaaucuaaacugcuuacaguaucugucauggacuugucucagauguacucuccugucuucgaguacuuaucaggggacagacaggugggagaguggcccaaagcaacuugcacaggugacugcccagaaagauguggcugcacaucaucaaccuguuugcacaaagaauggccucacucaagaaauuggagaugcaaucccacuuggugcugggguguagggacuggcugcaccuguuguggauuagaugugaaagaccuuuuuacagauuauauguuugucaaguggaaaguugaauacaucaagacagaggccauaguguguguagaacuuacuagucaggaaaggcaguguagcuugauugaagcgggcacaagguucaauuuagguccugugaccaucacacugucagaaccaagaaacauccaacaaaaacucccuccugaaauaaucacacugcauccuaggaucgaagaagguuuuuuugaccugaugcaugugcaaaagguguuaucggcaagcacaguguguaaguugcagaguugcacacauggugugccaggagaccuacaggucuaccacaucggaaauuuauuaaaaggggauaagguaaauggacaucuaauucauaaaauugagccacacuucaacaccuccuggauguccugggaugguugugaccuagacuacuacugcaacaugggagauuggccuucuugcacauacacaggggucacccaacacaaucaugcuucauuuguaaacuuacucaacauugaaacugauuacacaaagaacuuccacuuucacucuaaaagggucacugcacacggagauacaccacaacuagaucuuaaggcaagaccaaccuauggugcaggcgagaucacuguucugguagaaguugcugacauggaguuacauacaaagaagauugaaauaucaggcuuaaaauuugcaagcuuagcuugcacagguuguuaugcuuguagcucuggcaucucaugcaaaguuagaauucauguggaugaaccagaugaacuuacaguacauguuaaaagugaugauccagaugugguugcagcuagcucaagucucauggcaaggaagcuugaauuuggaacagacaguacauuuaaagcuuucucggccaugccuaaaacuucucuauguuucuacauuguugaaagagaacacuguaagagcugcagugaagaagacacaaaaaaauguguuaacacaaaacuugagcaaccacaaagcauuuugaucgaacacaagggaacuauaaucggaaagcaaaacagcacuugcacggcuaaggcaaguugcugguuagagucagucaagaguuuuuuuuauggccuaaagaacaugcuuaguggcauuuuuggcaaugucuuuaugggcauuuucuuguuccuugcccccuucauccuguuaauacuauucuuuauguuuggguggaggauccuauucugcuuuaaauguuguagaagaaccagaggccuguucaaguauagacaccucaaagacgaugaagaaacugguuauagaaggauuauugaaaaacuaaacaauaaaaaaggaaaaaacaaacugcuugauggugaaagacuugcugauagaagaauugccgaacuguucucuacaaaaacacacauuggcuag

SEQ ID NO: 3689 - RNA, 3495 nt, Artificial Sequence
  derived and/or modified CDS sequence (wt) from CCHVF(CCHVF 10200)__U39455.2__Gn-NSm-Gc
ucagaagaacccagugaugacuguguaucaagaacucaacuauuaaggacagagacugcagagauccacggcgacaacuaugguggcccgggugacaaaauaaccaucugcaauggcucaacuauuguagaccaaagacugggcagugaacuaggaugcuacaccaucaauagagugaggucauucaagcuaugcgaaaacagugccacagggaagaauugugaaauagacagugucccaguuaaaugcaggcaggguuauugccuaagaaucacucaggaagggaggggccacguaaaauuaucuaggggcucagagguugucuuagaugcaugcgauacaagcugugaaauaaugauaccuaagggcacuggugacauccuaguugacuguucaggugggcagcaacauuuucuaaaggacaauuugauagaucuaggaugccccaaaauuccauuauugggcaaaauggcuauuuacauuugcagaaugucaaaccaccccaaaacaaccauggcuuuccucuucugguucagcuuuggcuauguaauaaccugcauacuuugcaaggcuauuuuuuacuuguuaauaauuguuggaacacuagggagaaggcucaagcaguauagagaguugaaaccucagacuugcaccauaugugagacaacuccuguaaaugcaauagaugcugagaugcaugaccucaauugcaguuacaacauuugucccuacugugcaucuagacuaaccucagaugggcuugcuaggcaugugauacaaugcccuaagcggaaggagaaaguggaagaaacugaacuguacuugaacuuagaaagaauuccuuggguuguaagaaagcuguugcaggugucagagucaacugguguggcauugaaaagaagcaguuggcugauugugcugcuugugcuauucacuguuucauuaucaccaguucaaucagcacccauuggucaagggaagacaauugaggcauaccgggccagggaaggguacacaaguauaugccucuuuguacuaggaaguauccuauuuauaguuucuugccuaaugaaagggcugguugacaguguuggcaacuccuucuucccuggacuguccauuugcaaaacgugcuccauaagcagcauuaauggcuuugaaauugagucccauaagugcuauugcagcuuauucuguugccccuauuguaggcacugcucuaccgauaaagaaauucauaagcugcacuugagcaucugcaaaaaaaggaaaacaggaaguaaugucauguuggcugucugcaagcucauguguuucagggccaccauggaaguaaguaacagagcccuguuuauccguagcaucaucaacaccacuuuuguuuugugcauacugauacuagcaguuuguguuguuagcaccucagcaguggagauggaaaaccuaccagcagggaccugggaaagagaagaagaccuaacaaauuucugucaucaggaaugccagguuacagagacugaaugccucugcccuuaugaagcucuaguacucagaaagccuuuauuccuagauaguacagcuaaaggcaugaaaaaucugcuaaauucaacaaguuuagaaacgaguuuaucaauugaggcaccauggggagcaauaaauguucagucaaccuacaaaccaacugugucaacugcaaacauagcacucaguuggagcucaguggaacacagaggcaauaagaucuugguuucaggcagaucagaaucaauuaugaagcuggaagaaaggacaggaaucagcugggaucucgguguagaagaugccucugaaucuaaacugcuuacaguaucugucauggacuugucucagauguacucuccugucuucgaguacuuaucaggggacagacagguggaagaguggcccaaagcaacuugcacaggugacugcccagaaagauguggcugcacaucaucaaccuguuugcacaaagaauggccucacucaagaaauuggagaugcaaucccacuuggugcugggguguagggacuggcugcaccuguuguggauuagaugugaaagaccuuuuuacagauuauauguuugucaaguggaaaguugaauacaucaagacagaggccauaguguguguagaacuuacuagucaggaaaggcaguguagcuugauugaagcgggcacaagguucaauuuagguccugugaccaucacacugucagaaccaagaaacauccaacaaaaacucccuccugaaauaaucacacugcauccuaggaucgaagaagguuuuuuugaccugaugcaugugcaaaagguguuaucggcaagcacaguguguaaguugcagaguugcacacauggugugccaggagaccuacaggucuaccacaucggaaauuuauuaaaaggggauaagguaaauggacaucuaauucauaaaauugagccacacuucaacaccuccuggauguccugggaugguugugaccuagacuacuacugcaacaugggagauuggccuucuugcacauacacaggggucacccaacacaaucaugcuucauuuguaaacuuacucaacauugaaacugauuacacaaagaacuuccacuuucacucuaaaagggucacugcacacggagauacaccacaacuagaucuuaaggcaagaccaaccuauggugcaggcgagaucacuguucugguagaaguugcugacauggaguuacauacaaagaagauugaaauaucaggcuuaaaauuugcaagcuuagcuugcacagguuguuaugcuuguagcucuagcaucucaugcaaaguuagaauucauguggaugaaccagaugaacuuacaguacauguuaaaagugaugauccagaugugguugcagcuagcucaagucucauggcaaggaagcuugaauuuggaacagacaguacauuuaaagcuuucucggccaugccuaaaacuucucuauguuucuacauuguugaaagagaacacuguaagagcugcagugaagaagacacaaaaaaauguguuaacacaaaacuugagcaaccacaaagcauuuugaucgaacacaagggaacuauaaucggaaagcaaaacagcacuugcacggcuaaggcaaguugcugguuagagucagucaagaguuuuuuuuauggccuaaagaacaugcuuaguggcauuuuuggcaaugucuuuaugggcauuuucuuguuccuugcccccuucauccuguuaauacuauucuuuauguuuggguggaggauccuauucugcuuuaaauguuguagaagaaccagaggccuguucaaguauagacaccucaaagacgaugaagaaacugguuauagaaggauuauugaaaaacuaaacaauaaaaaaggaaaaaacaaacugcuugauggugaaagacuugcugauggaagaauugccgaacuguucucuacaaaaacacacauuggc

SEQ ID NO: 3690 - RNA, 3495 nt, Artificial Sequence
  derived and/or modified CDS sequence (wt) from CCHVF(CCHVF IbAr10200)__AF467768.2__Gn-NSm-Gc
ucagaagaacccagugaugacuguauaucaagaacucaacuauuaaggacagagacugcagagauccacggcgacaacuaugguggcccgggugacaaaauaaccaucugcaauggcucaacuauuguagaccaaagacugggcagugaacuaggaugcuacaccaucaauagagugaggucauucaagcuaugcgaaaacagugccacagggaagaauugugaaauagacagugucccaguuaaaugcaggcaggguuauugccuaagaaucacucaggaagggaggggccacguaaaauuaucuaggggcucagagguugucuuagaugcaugcgauacaagcugugaaauaaugauaccuaagggcacuggugacauccuaguugacuguucaggugggcagcaacauuuucuaaaggacaauuugauagaucuaggaugccccaaaauuccauuauugggcaaaauggcuauuuacauuugcagaaugucaaaccaccccaaaacaaccauggcuuuccucuucugguucagcuuuggcuauguaauaaccugcauacuuugcaaggccauuuuuuacuuguuaauaauuguuggaacacuagggaaaaggcucaagcaguauagagaguugaaaccucagacuugcaccauaugugagacaacuccuguaaaugcaauagaugcugagaugcaugaccucaauugcaguuacaacauuugucccuacugugcaucuagacuaaccucagaugggcuugcuaggcaugugauacaaugcccuaagcggaaggagaaaguggaagaaacugaacuguacuugaacuuagaaagaauuccuuggguuguaagaaagcuguugcaggugucagagucaacugguguggcauugaaaagaagcaguuggcugauugugcugcuugugcuauucacuguuucauuaucaccaguucaaucagcacccauuggucaagggaagacaauugaggcauaccgggccagggaaggguacacaaguauaugccucuuuguacuaggaaguauccuauuuauaguuucuugccuaaugaaagggcugguugacaguguuggcaacuccuucuucccuggacuguccauuugcaaaacgugcuccauaagcagcauuaauggcuuugaaauugagucccauaagugcuauugcagcuuauucuguugccccuauuguaggcacugcucuaccgauaaagaaauucauaagcugcacuugagcaucugcaaaaaaaggaaaaaaggaaguaaugucauguuggcugucugcaagcucauguguuucagggccaccauggaaguaaguaacagagcccuguuuauccguagcaucaucaacaccacuuuuguuuugugcauacugauacuagcaguuuguguuguuagcaccucagcaguggagauggaaaaccuaccagcagggaccugggaaagagaagaagaccuaacaaauuucugucaucaggaaugccagguuacagagacugaaugccucugcccuuaugaagcucuaguacucagaaagccuuuauuccuagauaguacagcuaaaggcaugaaaaaucugcuaaauucaacaaguuuagaaacgaguuuaucaauugaggcaccauggggagcaauaaauguucagucaaccuacaaaccaacugugucaacugcaaacauagcacucaguuggagcucaguggaacacagaggcaauaagaucuugguuucaggcagaucagaaucaauuaugaagcuggaagaaaggacaggaaucagcugggaucucgguguagaagaugccucugaaucuaaacugcuuacaguaucugucauggacuugucucagauguacucuccugucuucgaguacuuaucaggggacagacaggugggagaguggcccaaagcaacuugcacaggugacugcccagaaagauguggcugcacaucaucaaccuguuugcacaaagaauggccucacucaagaaauuggagaugcaaucccacuuggugcugggguguagggacuggcugcaccuguuguggauuagaugugaaagaccuuuuuacagauuauauguuugucaaguggaaaguugaauacaucaagacagaggccauaguguguguagaacuuacuagucaggaaaggcaguguagcuugauugaagcgggcacaagguucaauuuagguccugugaccaucacacugucagaaccaagaaacauccaacaaaaacucccuccugaaauaaucacacugcauccuaggaucgaagaagguuuuuuugaccugaugcaugugcaaaagguguuaucggcaagcacaguguguaaguugcagaguugcacacauggugugccaggagaccuacaggucuaccacaucggaaauuuauuaaaaggggauaagguaaauggacaucuaauucauaaaauugagccacacuucaacaccuccuggauguccugggaugguugugaccuagacuacuacugcaacaugggagauuggccuucuugcacauacacaggggucacccaacacaaucaugcuucauuuguaaacuuacucaacauugaaacugauuacacaaagaacuuccacuuucacucuaaaagggucacugcacacggagauacaccacaacuagaucuuaaggcaagaccaaccuauggugcaggcgagaucacuguucugguagaaguugcugacauggaguuacauacaaagaagauugaaauaucaggcuuaaaauuugcaagcuuagcuugcacagguuguuaugcuuguagcucuggcaucucaugcaaaguuagaauucauguggaugaaccagaugaacuuacaguacauguuaaaagugaugauccagaugugguugcagcuagcucaagucucauggcaaggaagcuugaauuuggaacagacaguacauuuaaagcuuucucggccaugccuaaaacuucucuauguuucuacauuguugaaagagaacacuguaagagcugcagugaagaagacacaaaaaaauguguuaacacaaaacuugagcaaccacaaagcauuuugaucgaacacaagggaacuauaaucggaaagcaaaacagcacuugcacggcuaaggcaaguugcugguuagagucagucaagaguuuuuuuuauggccuaaagaacaugcuuaguggcauuuuuggcaaugucuuuaugggcauuuucuuguuccuugcccccuucauccuguuaauacuauucuuuauguuuggguggaggauccuauucugcuuuaaauguuguagaagaaccagaggccuguucaaguauagacaccucaaagacgaugaagaaacugguuauagaaggauuauugaaaaacuaaacaauaaaaaaggaaaaaacaaacugcuugauggugaaagacuugcugauagaagaauugccgaacuguucucuacaaaaacacacauuggc

SEQ ID NO: 3691 - RNA, 3495 nt, Artificial Sequence
  derived and/or modified CDS sequence (wt) from CCHVF(CCHVF Turkey-Kelkit06)__GQ337054.1__Gn-NSm-Gc
uccgaagagccaggugaugacugcauaucaagaacucagcuauugaggacagaaacagcagagauccaugaugacaacuauggugguccaggugauaaaauaacuaucugcaacgguucaaccauuguagaucagagacugggcagugaacuaggguguuauaccaucaacagggugaagucauucaagcuaugcaaaaacagcgccacagggaaaaccugugagguagacagcacuccgguuaagugcaggcaagguuuuuguuuaaaaaucacccaagagggaaggggccacguaaaauuaucuagaggcucagagguuguccuggaugcuugcgacucaagcugugaaguaaugauaccuaaaggcacuggggauauccuaguggacuguucaggugggcagcaacauuucuuaaaagacaacuuaauugaccuagggugcccccauaucccgcuauuggguaggauggcuauuuacauuugcagaaugucaaaucauccuagaacaaccauggcuuuucucuucugguucagcuuuggcuauguuaucacuuguauauuuugcaaggcucuuuuuuauucauugauaauuauuggaacacuaggaaaaaagaucaagcaauauagggaacugaaaccucaaaccugcaccauaugugagacagcuccugucaaugcaauagaugcugaaaugcaugaccucaacuguaguuacaauauaugcccuuauugugcaucaagauugaccuccgaugggcuagccaggcauguaacgcaaugccccaagcggaaagagaaaguugaggagacugaacuguaccugaaccuggaaagaauuccuuggauugucagaaagcuauugcaggugucagaguccacugguguggcauugaaacgaagcagcuggcugauuguacugcuuguguuacugacaguuucguugucgccgguucagucagcaccuguuggucauggaaagacaaucgaaauauaucagaccagggaaggauucgcaagcaucugucucuuuauguuaggaagcauucuauuuauagucucuugcuuggugaaagggcuaguugacagugucagugaaagcuucuuccccggccuaucugucuguaagacaugcucuauuggcaguguaaauggcuuugaaauugaaucgcacaaaugcuacuguagccuauuuugcugccccuacuguaggcacugcucugcugacagagaaauucaccaguuacacuugaguaucugcaaaaaaaggaaaacggggagcaaugucaugcuggccgucugcaaacgcaugugcuuuagggcaaccauagaagcaagcagaagagcccugcucauccgaagcauuaucaauaccacuuuuguaauaugcauucuaacauugacaaucuguguuguuagcaccucugcaguggagauggaaaaccuuccagcaggaacuugggagagggaggaagaucugacaaauuucugucaucaggaaugccaggugacugagacagaaugccucuguccauacgaagcucuugugcucagaaaaccucuuuucuuggacaguauaguuaaagguaugaaaaauuugcuaaacucaacaagcuuggaaacaagcuuaucaauugaggcaccauggggagcaauaaauguccaaucaaccuuuaaaccaacuguaucgacugcaaacauagcacucaguuggagcucaguggugcacagaggcaacaagaucuuggucacaggcaggucugaaucaauuaugaaacuggaggaaaggacaggagucagcugggaucuaggcguagaagaugccucugaauccaaauuacuuaccguuucuaucauggauuugucacaaauguauucuccuguuuuugaguacuugucaggagacagacagguugaagaauggcccaaagcaacuuguacaggugauugcccggaaaggugugguugcacaucaucaaccugcuuacauaaagaauggucucacucaagaaacuggagauguaaucccacuuggugcuggggaguaggaaccggcugcaccugcugcgggguggauguaaaagaucuuuuuaccgaucacauguuugucaaauggaaaguugaauacauaaaaacugaagcuauaguauguguugcgcucaccagccaagaaagacagugcagucugauugaggcagguacuagauucaacuugggcccugugacuauuacccugucugagccaagaaacauucagcagaagcuuccuccugagauuaucacguugcaucccaaaauugaagaaggcuucuuugacuugaugcauguacaaaaaguguugucugcaaguacaguguguaaacugcagaguugcacacaugguauaccaggagaucuacaaguuuaccacauuggcaacuuguugaaaggggauagaguaaacgggcaucuaauucacaaaauugaaucacauuucaacaccucuuggauguccugggaugguugugacuuagacuacuacugcaacaugggggauuggccaucuugcacauacacaggagugacccagcauaaccaugcugcauuuguaaacuugcuuaacauugaaacugauuacacgaaaaccuuccacuuccacucuaaaagagucacagcacauggugacacaccacaauuggacuuaaaagcaaggccgaccuacggugcaggugggaucacugugcugguugagguugcugacauggaguugcauaccaagaaaguugaaauaucaggcuugaaauuugcaagucuggcuugcacggguugcuaugcuuguagcucuggcaucuccuguaaaguuaggauucauguagaugaaccagaugagcucacaguacauguaaagagcagugauccagaugugguugcagcuagcacaagucucauggcgaggaagcuugaauuugggacagacagcacauucaaggccuuuucagcuaugcccaaaaccucucuauguuuuuacauuguggagagagaauacugcaagagcugcagugaagaugauacacaaaaauguguugacacaagacuugagcagccacagagcauacuaauugagcacaaaggaacgauaauuggaaagcagaaugauacuugcacagccaaggcaagcuguuggcuagagucagucaagaguuuuuuuuauggauugaagaauaugcuuggcaguguuuuugguaaucuuuucauaggcauuuuguuauuccuugccccuuuuguccuguuggugcuuuucuuuauguuuggguggaaaaucuuguuuugcuuuaaauguugcaggaggaccagaggcuuauuuaaguauagacaccucaaagacgaugaggaaacaggcuacagaaggauuauugaaagacugaacagcaaaaaagggaaaaacaggcugcuugauggugauagacuggcugauaggaaaauugcugagcuguucuccacaaaaacacacauuggc

SEQ ID NO: 3692 - RNA, 3498 nt, Artificial Sequence
  derived and/or modified CDS sequence (wt) from CCHVF(CCHVF SR3)__AJ538199.1__Gn-NSm-Gc
uccgaagaaucuggugaugacugcauaucaagaacucagcuauugaggacagagacugcagagguccauggcgacaacuacggugguccaggugauaagauaaccaucuguaaugguucaacuguuguagaucaaagacuggguagugaacuaggguguuacacuaucaauagagugaggucauucaagcuaugcgaaaacagugccacagggaagagcugugaaauagacaguaucccagucaaguguaagcaggguuauugccuuaaaaucacucaggaaggaaggggccaugugaaguuaucuagaggcucagaaguugucuuggauguaugugauucaagcugugaagugaugauaccuaagggcacuggugacauucuaguagauuguucaggugggcagcaacauuuuuuaaaagacaaccugguugaccuagggugucccaaaauuccguuacugggcaaaauggcuauuuauaucugcaggaugucgaaucaccccaagacaaccauggccuuccucuuuugguucagcuuuggcuaugugauaacuuguauacuuugcaaggccauuuuuuucuuauuaauaauuuuuggaacacuagggaaaagguucaagcaguacagagaguugaaaccccagaccugcaccauaugugagacaacaccuguaaaugcaauagaugcugaaaugcaugaucucaacugcaguuacaauauaugucccuauugugcgucuagacugacuucagaugggcuugcuaggcauguaacacaauguccuagacggaaggagaaaguggaggaaaccgaauuauaccugaauuuagagagaauucccuggguuguaagaaagcuauugcaggugucagaguccacugguacaguauuaaaaaggagcagcuggcuaauuguauuacuugugcuguucacaguuucauugucaccaguucaaucagcacccauuggucacgggaaaacaauugaaacauaccggguuagggaagaauacacaaguauuugccucuuuguacuagggaguauccuguuuauagucucuuuucuaaugaaaggacugguugacgguguuggcaacaucuucuuuccugggcuguccgucuguaagacaugcucuauagguagcauuaauggcuuugaaauugagucucauaagugcuacuguagcuuguuuuguugcccuuacuguaggcacugcucugcugauggagaaauccaucagcugcacuugagcaucugcaaaaaaaggaagacaggaaguaauguuaugcuggcuguuugcaaacgcauguguuucagggcaacuauggaaguaagcaacaaagcccuauuuauccguagcaucaucaacaccacuuuuguuaugugcauacugaagggcgaauucgcggccguuaaaucaauucacccuauagagauggaaagccuaccagcugggaccugggaaagagaagaagaccuaacaaauuucugccaucaggaaugccagguuacagagacugagugccucugcccuuaugaagcucuagugcucagaaggccccuauuucuagauaguauagucaaagguaugaaaaaucugcuaaacucaacaagucuagaaacaagcuuaucaauugaggcaccguggggagcaaucaauguucagucaaccuacaaaccaacugucucaacugcaaacauagcacuuaguuggagcucaguggaacacagaggcaauaagguuuuggucucaggcagaucagaaucaauuaugaagcuggaagaaaggacaggaaucagcugggaucuuggcguggaagaugccucugagucuaagcuacuuacaguuucaguuauggacuugucucagauguacucuccugucuucgaguacuuaucaggugacagacaaguggaagaguggccuaaagcaaccugcacaggugacugcccagaaagauguggcugcacaucaucaaccugcuuacacaaagaguggccccacucaaggaauuggagauguaauccuacuuggugcugggguguagggacuggcugcaccuguugugguuuagaugugaaagaccuuuucacagauuacauguucgucaaguggaaaguugaguacauuaagacagaggccauaguauguguagaacuaaccagucaggaaagacaguguagcuugauugaggcgggcacaagauucaauuuagguucugugacuauuacauugucagaaccaaggaacauucaacaaaagcucccuccugaaauaaucacacugcaccccaagauugaggaagguuuuuuugaccuaaugcauguacaaaaagugcuaucggcaagcacaguguguaaguugcagaguugcacacauggugugccaggagaucugcaggucuaccacaucggaaaccuauuaaaaggggacagaguaaacggacaccugauucauaaaauugagcaacacuucaacacauccuggaugucuugggaugguugugaccuagacuacuacuguaacaugggagacuggccuuccugcacauauaccggagucacucagcauaaccaugcuucauuuguaaaccugcucaacauugaaacugauuauacaaaaaccuuucacuuucacucuaaaaggguuacugcacauggagacacaccacaacuagaucugaaggcaaggccaaccuauggugcaggugagaucaccgugcugguggaaguugcugacauggaguuacacacaaagaagauugaaauaucaggcuuaaaauuugcaggccuaacuugcacagguuguuaugcuuguaguucuggcaucucuuguaaaguuagaauucauguagaugaaccagaugaacuuacaguacauguuaaaagugaugacccagauguaguugcagcuagcucaagucucauggcgaggaagcuugaauuuggaacagacaguacauuuaaagcuuucucagccaugccuaaaaccucccuauguuucuacauuguggaaagggaauacuguaaaagcugcaauaaagaagauacacaaaaauguguuaacacgaaacucgaacaaccacagagcauuuugaucgaacauaagggaacuauaauuggaaagcaaaacaauacuugcacggcuaaagcgaguugcugguuagagucaguuaagaguuucuuuuauggucugaagaauaugcucgguggcauauuuggcaauguuuuuauaggcauuuucacauuucuuacccccuuuaucuuguuaauacuuuucuuuauguuuggguggaggauccuguuuugcuucaaguguugcagaaggaccagaggccuauucaaguacagacaccucaaagacgaugaagaaacugguuacagaaagaucauugaaagacugaacaacaaaaaaggaaaaaacaggcugcuugauggugaaagacuugcugacagaaagauugcugaacuguucuccacaaaaacacacauuggc

SEQ ID NO: 3693 - RNA, 3498 nt, Artificial Sequence
  derived and/or modified CDS sequence (wt) from CCHVF(CCHVF UCCR4413)__KY484038.1__Gn-NSm-Gc
ucagaaagcagcgcuagugguugcauuucaaggacccagaugaucaagucagaaacagcagagauccacgacgacaucuacggaggaccuggugagaagcuuaccaucuguaaugguaccacuguuguagaucaaagacugggcagugaacuagguugcuacacaaucaacagaauuaagaccuauaaauugugugaaaacagugucaaagaaaaaacuugugagauugacaguguaccagucaaguguagacaggggcuuuguuugaagauaacucaagaaggaagaggccauguuaagcuuuccagaggcucagagauuguccuggacauuugugacucuaguugugaauugaugauaccuaaaggcacuggggacauauugguagauuguucuggaggacagcaacauuuuuuacaggauaaccugguugacuuagguugcccuaacaucccccuacuugggaaaguggcuaucuacauaugcagaaugucaaaucaccccaagacuaccauggcauuucucuucugguucaguuuugguuaugugaucacaugcauauugugcaaaauacucuuuuaccuacucauaaucacuggcacacuagggaaaaaacuaaagcaguauagagagcucaagccacaaacauguaccauaugugaaucaacaccugugaaugcaauagaugcugagaugcaugaccucaacuguaguuacaacauaugcccuuauugugcaucuagacugacuucagaugggcucauaaggcaugugaaucugugccccaagaggaaggagaaaguugaagagacagaacuguauuugaacuuagaaagaauaccuugguuugugagaaagcuuuuacaggugucugaaucuacaggaguagcucucaaaagaagcaguuggcuauugauacuuguuauauugcucacaguuucuaugucaccaguucagucggcaccaauuaaucaacaaagagcaguugaagccuaccaggcuagggagggcuacacaggcaucugccucuuuauauuagggaguguccuauuuaugaccucuuggcuaacaaaaggauugauugacaguauuggcgacaguuucuucccugggcucuuugugugcaaaacaugcuccauaggcagcaucaauggcuuugaaauagaaucccauagguguuacugcagcuugcucugcuguccauacuguagaaccugcucugcugacaaagacagccaucagcugcaucuaaguauuuguaaaaagaaaaaagcaggaaguaaugucaugcuagcaguguguaagcguaugugcuucaaggcaacaauugaagcaagcaauagggugcuacugauuagaaguaucauaaacacuacauucauuauaugcaugcuaauuuuaguagugugugucauaagcacuucugcagucgaaauggaagaucuaccggcaggcacuugggagagagaagaagaccucaccaacuucugccaccaagaaugccaaguaacagagacugaguguuugugcccuuaugaagcuuuugugcuuagaaaaccacucuuccugaguaguauagucaaggguaagaagaaucugcuaaacucagcaaguuuagaaacaagccugucaauugaggcaccauggggagccauaaaugcucaguccaccuuuaaacccaccauaucaacugcaaauauagcacucagcuggagcucaguggagcauagaggcaauaaaguuuugguuucagguagaucagagucuaucaugaaacucgaggagcgaacaggaaucaguuggaaccuagggguagaggacgcaucagagucaagaaugcuaacggucucugucauggacuugucacagauguacuuaccaguauuugaauaucugucuggugacaggcaaguggaagaguggccaaaagcaaccuguacaggugacuguccagaaagaugcggcugcacaucaucaaccugcuugcauaaagaauggccgcacucaagaaacuggagaugcaaucccacuugguguugggggguuggaacaggaugcacaugcugcggauuagacgugaaagaccuguucacugauuauauguuuguuaaguggaagguugaguauauuaagacugaagccauaguuuguguugaguuaaccagccaagagagacagugcagcuuaauugaggccggcacaagauucaacuuaggucccgugacaauaacauuaucagaaccaaggaacauccaacaaaagcucccuucagagauagucacacugcaucccaaaauagaagaaggcuucuuugaccucaugcaugugcaaaagguacuaucugcuagcacggugugcaagcugcagagcugcacgcacggaguggcgggagaccugcaggucuaucauguuggcaauuuauuaaaaggggacaaaauaaauggacauucgauucacaagauugaaccacaucucaacacaucauggaugucuugggauggcugugaucuagacuauuacugcaauaugggagauuggcccucuugcacauacacaggggugacacaacacaaucaugcagcauuugucaaccuacuaaacauugaaacugauuacaccaaaagcuuccacuuucacucaaaaagaguaacagcacauggagacacuccccaacuggaccugaaggcgcggcccauguauggugcaggcgaaauaacugucuugguggagguugcugacauggaauugcacucaaagaacauugagaucucaggucuaaaauuugcaagcuugaccugcucaggcuguuaugccugcagcucagguauuucaugcaaagucagaauccauguagacgagcccgaugagcuagcaguacauguaaagagugaugaucuggauguuguggcagcuaguucaagucuuauggcaagaaaaauagaauucggaacagauagcacauuuaaagcuuucucaucuaugccaaaagaaucuuuaugcuucuacauuguugaaagagacuucuguaaaaguugugcagcagaagacacacaaaaaugugugaaagcaaaacuugaacagccacaaagcauacuuauugaacacaaagggacaauaauugggaaacaaaaugacacuugcucaaccaaaacaagcuguugguuggagucauucaaaagcuucuuuuaugggcuaaaaaacaugcuaagcggcguuuuuggcagugcuauuaugggcauucucuuguuccuugcccccuuuaucuuguuaauacuuuucuucuuuuuuggauggagaaucuuauucugccuaagauguuguagaaggaccagagggcuguuuaaguacaagcauaucaaggaugaugaggaagcaggcuacaaaaaaaucauugagaagcuuaacaacaaaaaagggggaacaaguaaauuguuagauggugagagacuugcggacagaaagauugccgaacuuuucucaacaaaagcacacaucggc

SEQ ID NO: 3694 - RNA, 3495 nt, Artificial Sequence
  derived and/or modified CDS sequence (wt) from CCHVF(CCHVF 66019)__AB069669.1__Gn-NSm-Gc
uccgaagagucuggugacgacugcauaucuagaacucagcuauugaggacagagacugcagagguccauggugacaacuauggugguccaggugacaaaauaacuaucuguaaugguucaaccauuguggaucaaagacuuggcagugaacugggguguuauacuaucaauagagugaagucauucaagcuaugcgaaaauaguggcacgggaaaauccuguaagauagauaacaccccaguuaagugcaggcaggguuuuugcuuaaaaauuacucaggaaggaaggggccaugugaagcuaucgagaggcucagaaguugucuuagaugccugcgacucaagcugugaaauaaugauaccgaagggcacaggagacauccuaguagacuguucaggugggcaacaacauuucuuaaaagauaacuugguugaucuaggaugcccuaacauuccacuauuagguaaaauggcuaucuacauuugcaggaugucaaaucacccuaaaacaacuauggcuuuucucuuuugguuuaguuucggcuauguaauaacauguauauuuuguaaaaucauuuuuuacuuguugauagucguggggacauuggggaaaaaguucaaacaguaccgggagcugaaaccucagacuuguacuauaugugaaacaacuccuaccaaugcaauagaugcugaaaugcacgaucuuaaaugcaguuacaauauaugcccuuauugugcaucuagauuaaccucggacgggcuugccaggcaugugacacaaugcccuaagcgaaaagagaaaguagaagagacugaacuguacuugaacuuggaaagaauuccuuggauugucagaaaacuacugcaagugucagagucuaccgguguggcacugaaaaggagcaguuggcuaauuguguuacuugugcuacuuacaguuucauugucaccgguucaaucagcacccauuggacauggaaagacaauugaggcauaucagaccagagagggguacacaaguguuugccuguuuaugcugggaggcaucuuguuuguggucuccugccugaugaaagggcuaguugacagugucagcaacagcuuuuucccuggguuaucuauuugcaaaaccuguucuaucggcaguguaaauggcuuugaaauugaaucccauaaauguuacuguagcuuacuuuguugccuuuauuguagacauugcucugcugauagggaaauccaccaauugcacuugagcaucugcaaaaaaagaagggcaggaggcaaugucaugcuggcugucugcaagcgcaugugccucagagcaacuauggagguaagcaauaagguccuauucauccgaaguauuaucaacaccacuuuuguuauaugcauacugguauuggcagucuguaucguuagcaccuccgcaguagagauggaaagccuaccagccggcacuugggaaagggaggaagaccugacaaacuucugccaccaggaaugccaagucacagagacugaaugucucuguccuuacgaggcucuuguacucaggaaaccccuauucucagacaguauagucaagggcaugaaaaaccugcuaaauucaacuagcuuggaaacaagcuuaucaauugaagcaccauggggagcaauaaacguccagucaaccuuuaaacccaccguuucaacugcaaacauagcacuuagcuggaguucaguagaacacagagguaacaaaauuuuggucucaggcagaucagaaucaauuaugaagcuagaagaaaggacaggaaucagcugggaucugggcguagaagaugccucugagucuaaguugcuuacuguuucugucauggauuugucacagauguauucuccugucuuugaguacuuaucaggugacagacagguagaggaguggcccaaagcaaccugcacagguaauugcccagauagguguggcugcacaucaucaaccugcuuacacaaggaauggccccauucaaggaauuggagaugcaaccccacuugguguuggggagucggcacuggaugcaccugcuguggacuagaugugaaagaucuuuuuacagauuauauguuugucaaguggaaaguugaauacauaaagaccgaggccauagugugcguugagcucaauagccaagaaaggcagugcagcuugauugaggcaggcacaagauucaacuuggguccugugaccaucacguugucagaaccaagaaacauucagcagaagcuuccuucugaaauaaucacauugcauccuagaauugaggaaggcuucuucgaucugaugcauguucaaaaggugcugucugcaaguacaguaugcaagcuacaaagcugcacacauggugugccaggagacuuacagaucuaccacauuggcaacuuguuaaaaggggauaggguaaaugggcaucugauucacaaaauugagccacacuucaacacuucuuggauguccugggauggcugugaccuagauuacuacuguaacaugggggauuggcccucuugcacauauacuggagugacccaacauaaccaugcugcuuuuguaaacuuacuuaacaucgaaacugauuacacaaagaacuuccauuuucauucuaagagaguuacugcacauggagacacaccacagcuggauuugaaagcuagaccaacuuacggugcgggugaaaucacuguacuaguggagguugcugacauggaguuacacacaaaaaagauugcgauaucaggucugaaauuugcaaguuugacuugcacagguugcuaugcuuguagcucuggcaucuccuguaaagucaggauucauguggaugaaccagaugagcuuacaguacaugugaaaagugaagauccggacauuguugcagccagcucaagccucauggcaaggaagcuugaauuugggacagacagcacauucaaggccuucucagccaugcccaaaaccuccuugugcuucuacauuguagagagagaauacugugagagcugcagcaaagaagacacacagaaauguguuaacacaaagcuugagcaaccacaaagcauuuuaauugagcacaaaggaacaauaaucggaaagcaaaaugacacuugcacagccaaagcaagcugcugguuagagucaguaaagaguuuuuuuuauggauugaagaacaugcuuagcggcaucuucggcaacguuuuuauaggcauuuucuuauuccuugcuccuuuuauucuguuaauacucuucuuuauguuuggguggagaauccuguuuugcuuuaaguguugcagaaggaccagaggcuuauucaaguacagauaucucaaggacgacgaagagucugguuacagaagaaucauugaaagauuaaacaacaaaaaaggaaaaaacaaguuacuugacggugaaagacuagcugacaggaggaucgcugaguuguucucuaccaaaacacacauuggu

SEQ ID NO: 3695 - RNA, 3495 nt, Artificial Sequence
  derived and/or modified CDS sequence (wt) from CCHVF(CCHVF 7001)__AB069670.1__Gn-NSm-Gc
gcagaaggaggaagcagugacugcauuucaagaacucagcuaguuaaaacggagguugcagaaauucaugaggacaguuacggugggccuggugagaaaauaacaaucugcaaugguuccacaauuguagaucaaaggcuugguagugaauugggcuguuauacaaucaacagaguaagauccuacaagcuaugcgagaacagugccucagggaaaagcugugaaauagauagcaucccagucaaaugcaaacaaggguuuugccucaaaauaacccaagaaggaagaggucauguaaaacuguccagagggacagaaauuguucuagaugucugugauuccagcugugagcugaugauacccaagggcacuggagacauuuuaguggauugcucaggagggcaacagcauuuuuuacaaaacaaucugauugacuugggaugccccaaugucccauuacuggguaaaauggccauauaugucugcagaaugucaaaccacccaaaaacuaccauggcauuucuguucugguucagcuuuggcuaugucauuacauguauagcaugcaggguacucuucuacuugcugauugccaucggaacaguagggaaaaagcuaaaacaguauagagagcugaaaccacaaacaugcauugucugugaaucugucccuguuaaugcaauagaugcugaaaugcaugagcuuaauugcaguuacaauauaugcccauacugugcaucuagacugucuacagacgggcucaucaggcacguaacucagugucccaaacggagggagaagguggaagagacugagcuauucuugaacuuggaaagaauaccuuggcuggugagaaagcuccuucaaguaucagagucaacaggaauggcucuaaagagaagcuguuggaugaucacacuccucauucuacuauugguuucgauaucaccaguccaaucugcaccgguaggcaaagagagggcaaucgagaccuaucaagcaagagaaaccuacacaggcauaugccucuuuguguuaggaaguguucucuuugcgguauccuggcugacaaaggccuugauugauggcaucggcaacagcuucuucccuggacuuucugucugcaagacaugcuccauugguaguauaaauggauuugaaauagagucucauaaaugcuauugcagucuauucuguuguccuuacuguagagcuugcucauccgacaaaaacacucaccggaugcacuuaaauguuugcaaaaaaaggaagauggguagcaaugucaugcuggcugucuguaaacguaugugcuuuagagcaaccauugaggcaagcaauaaggcuuuacugaucaggagcaucauaaauuccacuuuugugauuugcauauuaauccuaacaaucugugugguaagcaccuccgcaguugauauggaaaauuugccugcaggcaucugggagaaagaagaagaucuuacaaacuucugucaccaggagugucaagugacagaaacugaaugccucugcccguaugaggccaugguacucaggaagccacucuuccuggauaacauagccaagggaaugaaaagccuguugaacuccacgagcuuagaaacuagucugucaauugaagcuccguggggagcaaucaauguccagucaacuuucaaaccaacaguuucagcugcuaacauagcacuuagcuggaguucaguugaacacaggggcaacaaaauuuuaguuucagguagaucagagucaaucaugaaauuagaagaaagaacaggagucagcuggaaucuggguguagaagaugcuucugagucaaagacgcuuacuguuuccgucauggaccugucacaaauguacucuccuguuuuugaguacuugucaggugacagacaaguggaggaauggccaaaggcaacuugcacaggugacuguccagagagaugcggcugcacuucgucaaccugcuuacauaaagaguggccacauucaagaaacuggcgauguaauccuaccugguguugggggguggggacuggcugcacuugcugugggcuggauguaaaggauuuuuuuacugacuacaugcugguaaaauggaaaguggaauauauaaagacagaagcuauagugugugucgagcugacuagucaagagaggcaguguaguuuaauugaagcaggcacaagauuuaaccuaggcccuguaacaauaacccuaucagagccaagaaauguccagcagaggcuuccucccgaaauuguaacacugcauccuaaaauagaggaagguuuuuuugauuugaugcauguacaaaaaauacugucugcaagcacaguuugcaagcuacagagcugcacacacggugugccgggcgauuuucaggucuaccaugucgguaaccugcugaggggagacaagguuaauggacacucaauucacaagauagaaccacauuuuaauacuucauggaugucaugggaugguugcgaucuggacuauuucugcaauaugggggacuggccuucaugcacauacacuggagugacacagcauaaccgugcugcauuuaucaacaugcucaacauugagacugacuauacaaaaacuuuccacuuucauucgaagagggucacggcacauggagauacuccccagcuagaccuaaaagcgagaccggcauauggugcuggcgaggucacuguucuaguggagguugcagacuuggaguugcacacaaagaaacuugaagugucagguuugaaaauugcaaguuugaccugcucuggguguuaugccugcagcucuggcaucuccugcaaaguuagaauccauguaaaugaaccagaugaauuuacaguacauguaagaaguagcgacccagauguuguagcagcaggaucaagucuuauggcaaggaaaauagaguuuggggcugacaguacauucaaggccuuuucaucaaugcccaaggacuccuuaugcuuuuacauaguagaaaaggauuacugcagcagcugcaccgacgaugacacacaaaagugugucaacacgaagcuugaccauccacagagcauacucauugagcacaaaggaacaauaauuggcaagcaaaaugacacuuguucgaccaagacaagcugcuggcuagaaucaguuaaggguuuuuucuaugggcuaaaaaacaugcuaaguggcaucuuuggaaauguuuuuuuaggcaucuucuuauuccuugcuccuuuugugcuacugauauuuuuuuucuuuuuuggguggaggcuucuguuuugucucaaauguugcagaagaacuagaggacuguugaaauacaagcaccuuaaggaugaagaggaggcuggauacaaaaaaaucauugaaaggcuaaauggcaaaaaagguaaaagucaauuguuugauggugaaaggcuugcagacaggaagauugcugagcuuuuuucuacuaaaauucacauaggu

SEQ ID NO: 3696 - RNA, 3495 nt, Artificial Sequence
  derived and/or modified CDS sequence (wt) from CCHVF(CCHVF 75024)__AB069671.1__Gn-NSm-Gc
ucugaagaaucuggugaugacugcauaucaagaacucagcuauugaggacagagacugcagagauccauggugauaacuauggcgguccgggugacaagauuacuauuugcaaugguucgacaauuguagaucaaagacuggguagugagaugggguguuacacuaucaauagggugaagucauucaagcugugcgaaaacagugcaacagggaagagcugugaaauagacaguaucccaguuaagugcaggcaggguuauugccuaaaaaucacucaggaaggaaggggccaugugaaauuauccaggggcucagagguugucuuggaugcaugcgacucaagcugugaaguaaugauaccuaagggcacaggugacauccugguagacuguucaggugggcagcaacauuuuuugaaggacaacuuaauugaucuaggaugucccaguauuccauuacuggguaaaauggcuauuuauauuugcagaaugucgaaucacccuaagacaaccauggcuuuccucuuuugguucaguuuuggcuaugugauaacuuguauacucugcaaggcuauuuucuacuuauuaauaauuguuggaacgcuagggaagagguuuaagcaguacagagaguuaaaaccccagaccuguaccauaugugagacaacuccugcaaaugcaauagaugcugaaaugcaugaccuuaacugcaguuacaacauaugucccuauugugcaucuagacuaaccucagacgggcuugcuaggcaugugacacaaugcccuaagcggaaggagaaaguagaagaaacugaauuguacuugaacuuagagagaauucccuggguuguaagaaagcuguugcagguaucggaguccaccgguguugcauuaaaaagaagcagcuggcugauugugcugcuugugcuguucgcaauuucauuaucaccaguucaaucagcacccaucggucaugggaagacaauugaaacauaccaggccagggaggaauacacaagcaucugccucuuuguacuaggaaguauccuguuuauagucucuugucuaaugaaagggcugguugacaguauuggcaacaucuucuucccugggcuguccauuugcaaaacgugcucuauagguaguaucaauggcuuugaaauugagucucauaagugcuauuguagcuugcuuuguugccccuauuguaggcauuguucugcugauagagaaauucaucagcugcacuugagcaucugcaaaaaaagaaaaacaggaaguaauguuaugcuugcagucugcaagcgcaugugcuucagagcaacuauggaagugagcaauaaggcccuacuuauccguaguaucaucaacaccacuuuuguugugugcauauuaauacuagcagucuguguuguuagcaccucagcaguugagauggaaagccuaccagcugggaccugggaaagagaagaagaccuaacaaauuucugucaucaggaaugccagguuacggagacugagugccucugcccuuaugaagcccuaguacucagaaggcccuuguuccuggacaguauaguuagaggcaugaaaaaucagcuaaacucaacaaguuuagaaacaagcuuaucgauugaggcaccauggggagcaauaaauguucagucaaccuacaaaccaacugugucaacugcaaacauagcacuuaguuggagcucaguugaacacagagguaauaagauuuugguuucaggcagaucagaaucaauuaugaagcuggaagaaaggacaggaaucagcugggaccuuggcguagaagaugccucugaaucuaagcuacuuacagucucugucauggacuugucucagauguacucuccugucuucgaguacuuaucaggugacagacaaguagaagaguggcccaaggcaaccuguacaggagacugcccagaaagauguggcugcacaacaucaaccugcuugcauaaagaauggccccauucaagaaacuggagauguaaucccacuuggugcugggggguggggacuggcugcacuuguuguggauuagaugugaaagaccuuuuuacagauuauaugauugucaaguggaaaguugaauacauuaaaacagaggccauaguguguguggaacucaccagucaggaaaggcaguguagcuugauugaggcaggcacaagguucaauuuagguucugugaccaucacauugucagaaccgaggaacauucaacaaaagcucccuccugaaauaaucacauugcauccuaggauugaagaagguuuuuuugaccugaugcauguacaaaaaguguugucagcuagcacaguguguaaguugcagaguugcacacacggugugccaggugaucuacaggucuaccaugucggaaauuuauuaaaaggagauaaggugaauggacaccuaauucauaaaauugagccacacuuaaacacuuccuggauguccugggauggcugugaucuagacuacuauugcaacaugggagacuggccuucuuguacauauaccggaguuacccaacacaaucaugcuucauuuguaaaccugcucaacauugaaacugacuauacaaaaagcuuccacuuucacucuaaaaggguuacugcacacggagacacaccacaauuagaucugaaggcaagaccaaccuacggcgcaggagaaaucacuguacugguagaaguugcugacauggaguucacaccgaagaagauugaaauaucaggccuaaaauuugcaagccugacuugcacaggcuguuaugcuuguaguucuggcauuuccugcaaaguuaggauucauguggaugaaccagaugaacuuacaguacauguuaagagugaugauccagauguaguagcagcuagcucaagucucauggcaaggaagcuugaguuuggaacagacaguacauuuaaagcuuucucagcuaugcccaaaacuuccuuauguuucuacauugucgaaagggaguacuguaagagcugcaguaaagaagacacacaaaaauguguuaacacaaaacuugagcaaccacagagcauuuugaucgaacauaagggaacuauaauuggaaagcaaaacaauaccugcacagccaaagcaaguugcugguuagagucgguuaaaaguuucuuuuauggucuaaagaacaugcuuaguggcauuuuuggcaaucuuuuuaugggcaucuucuuauuucuugcccccuucaucuuguuaauacuuuucuuuauguuuggauggaggauccuguuuugcuuuaaguguugcagaagaaccaggggccuguucaaguauagacaucucaaagacgaugaagaaacugguuacaggaggaucauugaaagacugaacaacaagaaggggaagaacaagcugcuugauggugaaagacuugccgauagaagaauugccgaacuauucuccacaaaaacacacauuggc

SEQ ID NO: 3697 - RNA, 3495 nt, Artificial Sequence
  derived and/or modified CDS sequence (wt) from CCHVF(CCHVF 7803)__AB069672.1__Gn-NSm-Gc
ucugaagaaucuggugaugacugcauaucaagaacucagcuauugaggacagagacugcagagauccauggugauaacuauggugguccgggugacaagauuacuauuugcaaugguucgacaauuguagaucaaagacuggguagugagaugggguguuacacuaucaauagggugaagucauucaagcugugcgaaaacagugcaacagggaagagcugugaaauagacaguaucccaguuaagugcaggcaggguuauugccuaaaaaucacucaggaaggaaggggccaugugaaauuauccaggggcucagagguuaucuuggaugcaugcgacucaagcugugaaguaaugauaccuaagggcacaggugacauccugguagacuguucaggugggcagcaacauuuuuugaaggacaacuuaauugaucuaggaugucccaguauuccauuauuggguaaaauggcuauuuauauuugcagaaugucgaaucacccuaagacaaccauggcuuuccucuuuugguucaguuuuggcuaugugauaacuuguauacucugcaaggcuauuuucuacuuauuaauaauuguuggaacgcuagggaagagguuuaagcaguacagagaguuaaaaccccagaccuguaccauaugugagacaacuccugcaaaugcaauagaugcugaaaugcaugaccuuaacugcaguuacaacauaugucccuauugugcaucuagacuaaccucagacgggcuugcuaggcaugugacacaaugcccuaagcggaaggagaaaguagaagaaacugaauuguacuugaacuuagagagaauucccuggguuguaagaaagcuguugcagguaucggaguccaccgguguugcauuaaaaagaagcagcuggcugauugugcugcuugugcuguucgcaauuucauuaucaccaguucaaucagcacccaucagucaugggaagacaauugaaacauaccaggccagggaggaauacacaagcaucugccucuuuguacuaggaaguauccuguuuauagucucuugucuaaugaaagggcugguugacaguauuggcaacaucuucuucccugggcuguccauuugcaaaacgugcucuauagguaguaucaauggcuuugaaauugagucucauaagugcuauuguagcuugcuuuguugccccuauuguaggcauuguucugcugauagagaaauucaucagcugcacuugagcaucugcaaaaaaagaaaaacaggaaguaauguuaugcuugcagccugcaagcgcaugugcuucagagcaacuauggaggugagcaauaaggcccuacuuauccguaguaucaucaacaccacuuuuguuguguacauauugauacuagcagucuguguuguuagcaccucagcaguugagauggaaagccuaccagcugggaccugggaaagagaagaagaccuaacaaauuucugucaucaggaaugccagguuacggagacugagugccucugcccuuaugaagcccuaguacucagaaggcccuuguuccuggacaguauaguuagaggcaugaaaaauccgcuaaacucaacaaguuuagaaacaagcuuaucgauugaggcaccauggggagcaauaaauguucagucaaccuacaaaccaacugugucaacugcaaacauagcacuuaguuggagcucaguugaacacagagguaauaagauuuugguuucaggcagaucagaaucaauuaugaagcuggaagaaaggacaggaaucagcugggaccuuggcguagaagaugccucugaaucuaagcuacuuacagucucugucauggacuugucucagauguacucuccugucuucgaguacuuaucaggugacagacaaguagaagaguggcccaaggcaaccuguacaggagacugcccagaaagauguggcugcacaacaucaaccugcuugcauaaagaauggccccauucaagaaacuggagauguaaucccacuuggugcugggggguggggacuggcugcacuuguuguggauuagaugugaaagaccuuuuuacagauuauaugauugucaaguggaaaguugaauacauuaaaaccagaggcauaguguguguggaacucaccagucaggaaaggcaguguagcuugauugaggcgggcacaagguucaauuuagguucugugaccaucacauugucagaaccgaggaacauucaacaaaagcucccuccugaaauaaucacauugcauccuaggauugaagaagguuuuuuugaccugaugcauguacaaaaaguguugucagcuagcacaguguguaaguugcagaguugcacacacggugugccaggugaucuacaggucuaccaugucggaaauuuauuaaaaggagauaaggugaauggacaccuaauucauaaaauugagccacacuuaaacacuuccuggauguccugggauggcugugaccuagacuacuacugcaacaugggagacuggccuucuuguacauauaccggaguuacccaacacaaucaugcuucguuuguaaaccugcucaacauugaaacugacuauacaaaaagcuuccacuuucacucuaaaaggguuacugcacacggagacacaccacaauuagaucugaaggcaagaccaaccuacggcgcaggagaaaucacuguacugguagaaguugcugacauggaguucacaccgaagaagauugaaauaucgggccuaaaauuugcaagccugacuugcacaggcuguuaugcuuguaguucuggcauuuccugcaaaguuaggauucauguggaugaaccagaugaacuuacaguacauguuaagagugaugauccagauguaguagcagcuagcucaagucucauggcaaggaagcuugaguuuggaacagacaguacauuuaaagcuuucucagcuaugcccaaaacuuccuuauguuucuacauugucgaaagggaguacuguaagagcugcaguaaagaagacacacaaaaauguguuaacacaaaacuugagcaaccacagagcauuuugaucgaacauaagggaacuauaauuggaaagcaaaacaauaccugcacagccaaagcaaguugcugguuagagucgguuaaaaguuucuuuuauggucuaaagaacaugcuuaguggcauuuuuggcaauuuuuuuaugggcaucuucuuauuucuugcccccuucaucuuguuaauacuuuucuuuauguuuggauggaggauccuguuuugcuuuaaguguugcagaagaaccaggggccuguucaaguauagacaucucaaagacgaugaagaaacugguuacaggaggaucauugaaagacugaacaauaagaaggggaagaacaagcugcuugauggugaaagacuugccgauagaagaauugccgaacuauucuccacaaaaacacacauuggc

SEQ ID NO: 3698 - RNA, 3495 nt, Artificial Sequence
  derived and/or modified CDS sequence (wt) from CCHVF(CCHVF 79121)__AB069673.1__Gn-NSm-Gc
gcagaaggaggaagcagugacugcauuucaagaacucagcuaguuaaaacggagguugcagaaauucaugaggacaguuacggugggccuggugagaaaauaacaaucugcaaugguuccacaauuguagaucaagggcuugguagugaauugggcuguuauacaaucaacagaguaagauccuacaagcuaugcgagaacagugccucagggaaaagcugugaaauagauagcaucccagucaaaugcaaacaaggguuuugccucaaaauaacccaagaaggaagaggucauguaaaacuguccagagggacagaaauuguucuagaugucugugauuccagcugugagcugaugauacccaagggcacuggagacauuuuaguggauugcucaggagggcaacagcauuuuuuacaaaacaaucugauugacuugggaugccccaaugucccauuacuggguaaaauggccauauaugucugcagaaugucaaaccacccaaaaacuaccauggcauuucuguucugguucagcuuuggcuaugucauuacauguauagcaugcaggguacucuucuacuugcugauugccaucggaacaguagggaaaaagcuaaaacaguauagagagcugaaaccacaaacaugcauugucugugaaucugucccuguuaaugcaauagaugcugaaaugcaugagcuuaauugcaguuacaauauaugcccauacugugcaucuagacugucuacagacgggcucaucaggcacguaacucagugucccaaacggagggagaagguggaagagacugagcuauucuugaacuuggaaagaauaccuuggcuggugagaaagcuccuucaaguaucagagucaacaggaauggcucuaaagagaagcuguuggaugaucacacuccucauucuacuauugguuucgauaucaccaguccaaucugcaccgguaggcaaagagagggcaaucgagaccuaucaagcaagagaaaccuacacaggcauaugccucuuuguguuaggaaguguucucuuugcgguauccuggcugacaaaggccuugauugauggcaucggcaacagcuucuccccuggacuuucugucugcaagacaugcuccauugguaguauaaauggauuugaaauagagucucauaaaugcuauugcagucuauucuguuguccuuacuguagagcuugcucauccgacaaaaacacucaccggaugcacuuaaauguuugcaaaaaaaggaagauggguagcaaugucaugcuggcugucuguaaacguaugugcuuuagagcaaccauugaggcaagcaauaaggcuuuacugaucaggagcaucauaaauuccacuuuugugauuugcauauuaauccuaacaaucugugugguaagcaccuccgcaguugauauggaaaauuugccugcaggcaucugggagaaagaagaagaucuuacaaacuucugucaccaggagugucaagugacagaaacugaaugccucugcccguaugaggccaugguacucaggaagccacucuuccuggauagcacagccaagggaaugaaaagccuguugaacuccacgagcuuagaaacuagucugucaauugaagcuccguggggagcaaucaauguccagucaacuuucaaaccaacaguuucagcugcuaacauagcacuuagcuggaguucaguugaacacaggggcaacaaaauuuuaguuucagguagaucagagucaaucaugaaauuagaagaaagaacaggagucagcuggaaucuggguguagaagaugcuucugagucaaagacgcuuacuguuuccgucauggaccugucacaaauguacucuccuguuuuugaguacuugucaggugacagacaaguggaggaauggccaaaggcaacuugcacaggugacuguccagagagaugcggcugcacuucgucaaccugcuuacauaaagaguggccacauucaagaaacuggcgauguaauccuaccugguguugggggguggggacuggcugcacuugcugugggcuggauguaaaggauuuuuuuacugacuacaugcugguaaaauggaaaguggaauauauaaagacagaagcuauagugugugucgagcugacuagucaagagaggcaguguaguuuaauugaagcaggcacaagauuuaaccuaggcccuguaacaauaacccuaucagagccaagaaauguccagcagaggcuuccucccgaaauuguaacacugcauccuaaaauagaggaagguuuuuuugauuugaugcauguacaaaaaauacugucugcaagcacaguuugcaagcuacagagcugcacacacggugugccgggcgauuuucagaucuaccaugucgguaaccugcugaggggagacaagguuaauggacacucaauucacaagauagaaccacauuuuaauacuucauggaugucaugggaugguugcgaucuggacuauuucugcaauaugggggacuggccuucaugcacauacacuggagugacacagcauaaccgugcugcauuuaucaacaugcucaacauugagacugacuauacaaaaacuuuccacuuucauucgaagagggucacggcacauggagauacuccccagcuagaccuaaaagcgagaccggcauauggugcuggcgaggucacuguucuaguggagguugcagacuuggaguugcacacaaagaaccuugaagugucagguuugaaaauugcaaguuugaccugcucuggguguuaugccugcagcucuggcaucuccugcaaaguuagaauccauguaaaugaaccagaugaauuuacaguacauguaagaaguagcgacccagauguuguagcagcaggaucaagucuuauggcaaggaaaauagaguuuggggcugacaguacauucaaggccuuuucaucaaugcccaaggacuccuuaugcuuuuacauaguagaaaaggauuacugcagcagcugcaccgacgaugacacacaaaagugugucaacacgaagcuugaccauccacagagcauacucauugagcacaaaggaacaauaauuggcaagcaaaaugacacuuguucgaccaagacaagcugcuggcuagaaucaguuaaggguuuuuucuaugggcuaaaaaacaugcuaaguggcaucuuuggaaauguuuuuuuaggcaucuucuuauuccuugcuccuuuugugcuacugauauuuuuuuucuuuuuuggguggaggcuucuguuuugucucaaauguugcagaagaacuagaggacuguugaaauacaagcaccuuaaggaugaagaggaggcuggauacaaaaaaaucauugaaaggcuaaauggcaaaaaagguaaaagucaauuguuugauggugaaaggcuugcagacaggaagauugcugagcuuuuuucuacuaaaauucacauaggu

SEQ ID NO: 3699 - RNA, 3495 nt, Artificial Sequence
  derived and/or modified CDS sequence (wt) from CCHVF(CCHVF 8402)__AB069674.1__Gn-NSm-Gc
uccgaagagucuggugaugacugcauaucaagaacucagcuauugaggacagagacugcggaaauucacaaugauaacuauggugguccaggugacaagauaaccaucugcaaugguucaacuguuguggaucagagauugggcagugaacugggguguuacacuaucaauagaguaaagucauuuaagcuuugcgagaacagugccacaggcaaauccugugaaauagauagcaccccagucaaaugcaggcaggguuucuguuugaaaauuacucaggagggaaggggccacgugaagcuaucgagagguucagaaguuguccuggacgccugcgauucaagcugugaaauaaugauaccaaagggcaccggagacauccuaguugacuguucagguggacagcaacauuucuuaaaagauaacuugauugaucuaggaugcccaaacaucccacuauuaggcaagauggcuaucuacauuuguagaaugucaaaucauccuaaaacgacuauggcuuuucuuuuuugguuuagcuuugguuauguggugaccuguauacucuguaaggucaucuucuaucuauuaauaguuguggggacguuggggaaaaaguucaaacaguauagagaguugaaaccucagaccuguaccauaugcgaaacaacuccuguuaaugcaauagaugcugaaaugcacgaccucaacugcaguuacaauauauguccuuacugugcaucuagguuaaccucagauggucuugccagacauguaaugcagugcccuaagcggaaggaaaaaauagaagaaaccgaauuauacuuaaacuuggaaagaauccccuggguuguuaggaaauuacugcaggugucagaauccaccgguguggcacuaaagaggaguaguuggcugguugugcuacuuguguuacuuacaguuucauugucaccaguacaaucagcaccuaucggccauggaaagacaguugaaacauaucaaaccagagaaggauacacaaguauuugccucuuuguacuaggaagcaucuuauuuauagucucuugccuaaugaagggguugguugacaguguugguaacaguuuuuucccugguuuguccauuuguaagacauguucuauuggcaguguaaauggcuuugagauugaaucucacaaauguuacuguagccuauuuuguugucccuacuguagacacugcucugccgauagagaaauacauagguugcacuugagcaucugcaagaaaaggaagacugggaguaaugucaugcuggccgucuguaagcgcaugugcuuuagggcaacuguggaaguaagcaacaaggcucuacucauccgaaacaucaucaacaccacuuuuguucugugcauacugauauuagcaguuuguguugucagcaccuccgcaguggagauggaaagccugccagcuggcacuugggagagagaggaagaucugacaaauuucugucaucaagaaugccaagucacugagacugaaugccucugucccuacgaagcucuugugcucaggaaacccuuguuuucagacagcauugucaaaggcaugaagaacuugcuaaauucaacaagcuuagaaacaagcuuaucaauugaggcaccauggggagcaauaaauguccaaucaaccuucaaaccuacugugucagcugcgaauauagcucuuaguuggagcucaguggaacacagggguaauaagauuuugguuucagguagaucagagucaaucaugaagcuagaggaaaggacaggaaucagcugggaucuagggguagaagaugcuucugagucuaaauugcuuacugucucuguuauggacuugucacagauguacucuccugucuuugaguaccuaucaggugacagacaaguggaggaauggcccaaggcaaccugcacaggagauugcccagaaagauguggcugcacaucaucaaccugccuacacaaagaauggccccauucaagaaacuggagaugcaaccccaccugguguuggggagucggcacuggauguaccugcugugggcuggauguaaaagaccuuuuuacagauuacauguuuaucaaguggaaaguugaguacauuaaaacagaagcuauaguguguguugagcuuacuagccaagagagacaauguaccuugauugaggcaggcacaagauucaacuuagguccugugaccaucacauugucagagccaagaaacauucagcaaaagcucccuccagagauaguuacauugcaccccagaauugaagaagguuucuuugauuuaaugcauguacaaaaggugcuaucagcaaguacaguguguaagcuacagaguugcacacauggugugccaggggaccuacaggucuaucacauaggaaacuuguuaaaaggagacaaggugaaugggcaccugauucacaaaauugaaccacacuucaacacuuccuggaugucuugggacggcugugaccuagacuacuacuguaauaugggggauuggccaucuugcacauauacuggaguaacccagcacaaucaugcugcauuuguaaacaugcucaacaucgaaacugauuauacaaaaaacuuccacuuucacucuaagagaguuacugcacauggagacacaccacaauuagauuugaaagcuagaccaacuuauggugcaggugaaaucacugugcugguggaaguugcugacauggaguuacacacaaagaaaauugagauaucagguuugaaguuugcaagcuuaacuugcacaggcuguuaugcuuguagcucugguaucuccuguaagguuagaauccauguagaugagccagaugagcuuacaguacaugugaagagugaagacccagacauaguugcugcuagcucaagucucauggcuagaaaacuugaauuugggacagauaguacauucaaagccuuuucagccaugcccaaaaccuccuuaugcuuuuacauuguggagagagaauauuguaaaagcugcagcaaagaagauacacaaaaaugugucaacacaaagcuugagcaaccacagagcauuuuaaucgagcacaaaggaacgauaauugguaagcagagcaacaccugcacagcuaaagcaagcuguuggcuagagucagucaagagcuucuuuuaugggcuaaagaacaugcuuaguggcauuuuuggcaauguuuucauagggguuuucuuauucuuugcuccuuuuauccuuuugauacuuuucuuuauguuuggauggagaauccuguucugcuuuaaauguugcagaagaacuagaggccuuuuuaaguacagacaccucaaggacgaugaagaaaccgguuacaggaaaaucauugagagacugaacaacaaaaaagggaaaaacaaacugcuugauggugaaagauuagcugauaggaagauugcugagcuguucuccacaaagacacacauuggc

SEQ ID NO: 3700 - RNA, 3495 nt, Artificial Sequence
  derived and/or modified CDS sequence (wt) from CCHVF(CCHVF 88166)__AB069675.1__Gn-NSm-Gc
uccgaagagucuggugaugacugcauaucaagaacucagcuauugaggacagagacugcggaaauucacagugauaacuauggugguccaggugacaagauaaccaucugcaaugguucaacuguuguggaucagagauugggcagugaacuaggguguuacacuaucaauagaguaaagucauuuaagcuuugcgagaacagugccacaggcaaauccugugaaauagauagcaccccagucaaaugcaggcaggguuucuguuugaaaauuacucaggagggaaggggccacgugaagcuaucgagagguucagaaguuguccuggacgccugcgauucaagcugugaaauaaugauaccaaagggcacuggagacauccuaguugacuguucagguggacagcaacauuucuuaaaagauaacuugauugaucuaggaugcccaaacaucccacuauuaggcaagauggcuaucuacauuuguagaaugucaaaucauccuaaaacgacuauggguuuucuuuuuugguuuagcuuugguuauguggugaccuguauacucuguaaggucaucuucuaucuauuaauaguuguggggacguuggggaaaaaguucaaacaguauagagaguugaaaccucagaccuguaccauaugcgaaacaacuccuguuaaugcaauagaugcugaaaugcacgaccucaacugcaguuacaauauauguccuuacugugcaucuagguuaaccucagauggccuugccagacauguaaugcagugcccuaagcggaaggaaaaaauagaagaaaccgaauuauacuuaaacuuggaaagaauccccuggguuguuaggaaauuacugcaggugucagaauccaccgguguggcacuaaagaggaguaguuggcugguugugcuacuuguguuacuuacaguuucauugucaccaguacaaucagcaccuaucggccauggaaagacaguugaaacauaucaaaccagagaaggauacacaaguauuugccucuuuguacuaggaagcaucuuauuuauagucucuugccuaaugaagggguugguugacaguguugguaacaguuuuuuuccugguuuguccauuuguaagacauguucuauuggcaguguaaauggcuuugagauugaaucucacaaauguuacuguagccuauuuuguugucccuacuguagacacugcucugccgauagagaaauacauagguugcacuugagcaucugcaagaaaaggaagacuuggaguaaugucaugcuggccgucuguaagcgcaugugcuuuagggcaacuguggaaguaagcaacaaggcucuacuuauccgaaacaucaucaacaccacuuuuguucugugcauacugauauuagcaguuuguguugucagcaccuccgcaguggagauggaaagccugccagcuggcacuugggagagagaagaagaucugacaaauuucugucaucaagaaugccaagucacugagacugaaugccucugucccuacgaagcucuugugcucaggaaacccuuguuuucagacagcauugucaaaggcaugaagaacuugcuaaauucaacaagcuuagaaacaagcuuaucaauugaggcaccauggggagcaauaaauguccaaucaaccuucaaaccuaccaugucagcugcgaauauagcucuuaguuggagcucaguggaacacagggguaauaagauuuugguuucagguagaucagagucaaucaugaagcuagaggaaaggacaggaaucagcuggaaucuagggguagaagaugcuucugagucuaaauugcuuacugucucuguuauggacuugucacagauguacucuccugucuuugaguaccuaucaggugacagacaaguggaggaauggcccaaggcaaccugcacaggagauugcccagaaagauguggcugcacaucaucaaccugccuacacaaagaauggccccauucaagaaacuggagaugcaaccccaccugguguuggggagucggcacuggauguaccugcugugggcuggauguaaaagaccuuuuuacagauuacauguuuaucaaguggaaaguugaguacauuaaaacagaagcuauaguguguguugagcuuacuagccaagagagacaauguaccuugauugaggcaggcacaagauucaacuuagguccugugaccaucacauugucagagccaagaaacauucagcaaaagcucccuccagagauaguuacauugcaccccagaauugaagaagguuucuuugauuuaaugcauguacaaaaggugcuaucagcaaguacaguguguaagcuacagaguugcacacauggugugccaggggaccuacaggucuaucacauaggaaacuuguuaaaaggagacaaggugaaugggcaccugauucacaaaauugaaccacacuucaacacuuccuggaugucuugggacggcugugaccuagacuacuacuguaauaugggggauuggccaucuugcacauauacuggaguaacccagcacaaucaugcugcauuuguaaacaugcucaacaucgaaacugauuauacaaaaaacuuccacuuucacucuaagagaguuacugcacauggagacacaccacaauuagauuugaaagcuagaccaacuuauggugcaggugaaaucacugugcugguggaaguugcugacauggaguuacacacaaagaaaauugagauaucagguuugaaguuugcaagcuuaacuugcacaggcuguuaugcuuguagcucugguaucuccuguaagguuagaauccauguagaugagccagaugagcuuacaguacaugugaagagugaagacccagacuuaguugcugcuagcucaagucucauggcuagaaaacuugaauuugggacagauaguacauucaaagccuuuucagccaugcccaaaaccuccuuaugcuuuuacauuguggagagagaauauuguaaaagcugcagcaaagaagauacacaaaaaugugucaacacaaagcuugagcaaccacagagcauuuuaaucgagcacaaaggaacgauaauugguaagcagaacaacacaugcacagcuaaagcaagcuguuggcuagagucagucaagagcuucuuuuaugggcuaaagaacaugcuuaguggcauuuuuggcaauguuuucauagggguuuucuuauucuuugcuccuuuuauccuuuugauacuuuucuuuauguuuggauggagaauccuguucugcuuuaaauguugcagaagaacuagaggccuuuuuaaguacagacaccucaaggacgaugaagaaaccgguuacaggaaaaucauugagagacugaacaacaaaaaagggaaaaacaaacugcuugauggugaaagauuagcugauaggaagauugcugagcuguucuccacaaagacacacauuggc

SEQ ID NO: 3701 - RNA, 3495 nt, Artificial Sequence
  derived and/or modified CDS sequence (wt) from CCHVF(CCHVF BA88166)__AF338470.1__Gn-NSm-Gc
uccgaagagucuggugaugacugcauaucaagaacucagcuauugaggacagagacugcggaaauucacagugauaacuauggugguccaggugacaagauaaccaucugcaaugguucaacuguuguggaucagagauugggcagugaacuaggguguuacacuaucaauagaguaaagucauuuaagcuuugcgagaacagugccacaggcaaauccugugaaauagauagcaccccagucaaaugcaggcaggguuucuguuugaaaauuacucaggagggaaggggccacgugaagcuaucgagagguucagaaguuguccuggacgccugcgauucaagcugugaaauaaugauaccaaagggcacuggagacauccuaguugacuguucagguggacagcaacauuucuuaaaagauaacuugauugaucuaggaugcccaaacaucccacuauuaggcaagauggcuaucuacauuuguagaaugucaaaucauccuaaaacgacuauggguuuucuuuuuugguuuagcuuugguuauguggugaccuguauacucuguaagggcaucuucuaucuauuaauaguuguggggacguuggggaaaaaguucaaacaguauagagaguugaaaccucagaccuguaccauaugcgaaacaacuccuguuaaugcaauagaugcugaaaugcacgaccucaacugcaguuacaauauauguccuuacugugcaucuagguuaaccucagauggccuugccagacauguaaugcagugcccuaagcggaaggaaaaaauagaagaaaccgaauuauacuuaaacuuggaaagaauccccuggguuguuaggaaauuacugcaggugucagaauccaccgguguggcacuaaagaggaguaguuggcugguugugcuacuuguguuacuuacaguuucauugucaccaguacaaucagcaccuaucggccauggaaagacaguugaaacauaucaaaccagagaaggauacacaaguauuugccucuuuguacuaggaagcaucuuauuuauagucucuugccuaaugaagggguugguugacaguguugguaacaguuuuuuuccugguuuguccauuuguaagacauguucuauuggcaguguaaauggcuuugagauugaaucucacaaauguuacuguagccuauuuuguugucccuacuguagacacugcucugccgauagagaaauacauagguugcacuugagcaucugcaagaaaaggaagacuuggaguaaugucaugcuggccgucuguaagcgcaugugcuuuagggcaacuguggaaguaagcaacaaggcucuacuuauccgaaacaucaucaacaccacuuuuguucugugcauacugauauuagcaguuuguguugucagcaccuccgcaguggagauggaaagccugccagcuggcacuugggagagagaggaagaucugacaaauuucugucaucaagaaugccaagucacugagacugaaugccucugucccuacgaagcucuugugcucaggaaacccuuguauuuagacagcauugucaaaggcaugaagaacuugcuaaauucaacaagcuuagaaacaagcuuaucaauugaggcaccauggggagcaauaaauguccaaucaaccuucaaaccuaccaugucagcugcgaauauagcucuuaguuggagcucaguggaacacagggguaauaagauuuugguuucagguagaucagagucaaucaugaagcuagaggaaaggacaggaaucagcuggaaucuagggguagaagaugcuucugagucuaaauugcuuacugucucuguuauggacuugucacagauguacucuccugucuuugaguaccuaucaggugacagacaaguggaggaauggcccaaggcaaccugcacaggagauugcccagaaagauguggcugcacaucaucaaccugccuacacaaagaauggccccauucaagaaacuggagaugcaaccccaccugguguuggggagucggcacuggauguaccugcugugggcuggauguaaaagaccuuuuuacagauuacauguuuaucaaguggaaaguugaguacauuaaaacagaagcuauaguguguguugagcuuacuagccaagagagacaauguaccuugauugaggcaggcacaagauucaacuuagguccugugaucaucacauugucagagccaagaaacauucagcaaaagcucccuccagagauaguuacauugcaccccagaauugaagaagguuucuuugauuuaaugcauguacaaaaggugcuaucagcaaguacaguguguaagcuacagaguugcacacauggugugccaggggaccuacaggucuaucacauaggaaacuuguuaaaaggagacaaggugaaugggcaccugauucacaaaauugaaccacacuucaacacuuccuggaugucuugggacggcugugaccuagacuacuacuguaauaugggggauuggccaucuugcacauauacuggaguaacccagcacaaucaugcugcauuuguaaacaugcucaacaucgaaacugauuauacaaaaaacuuccacuuucacucuaagagaguuacugcacauggagacacaccacaauuagauuugaaagcuagaccaacuuauggugcaggugaaaucacugugcugguggaaguugcugacauggaguuacacacaaagaaaauugagauaucagguuugaaguuugcaagcuuaacuugcacaggcuguuaugcuuguagcucugguaucuccuguaagguuagaauccauguagaugagccagaugagcuuacaguacaugugaagagugaagacccagacauaguugcugcuagcucaagucucauggcuagaaaacuugaauuugggacagauaguacauucaaagccuuuucagccaugcccaaaaccuccuuaugcuuuuacauuguggagagagaauauuguaaaagcugcagcaaagaagauacacaaaaaugugucaacacaaagcuugagcaaccacagagcauuuuaaucgagcacaaaggaacgauaauugguaagcagaacaacacaugcacagcuaaagcaagcuguuggcuagagucagucaagagcuucuuuuaugggcuaaagaacaugcuuaguggcauuuuuggcaauguuuucauagggguuuucuuauucuuugcuccuuuuauccuuuugauacuuuucuuuauguuuggauggagaauccuguucugcuuuaaauguugcagaagaacuagaggccuuuuuaaguacagacaccucaaggacgaugaagaaaccgguuacaggaaaaucauugagagacugaacaacaaaaaagggaaaaacaaacugcuugauggugaaagauuagcugauaggaagauugcugagcuguucuccacaaagacacacauuggc

SEQ ID NO: 3702 - RNA, 3495 nt, Artificial Sequence
  derived and/or modified CDS sequence (wt) from CCHVF(CCHVF BA66019)__AF350448.1__Gn-NSm-Gc
uccgaagagucuggugacgacugcauaucuagaacucagcuauugaggacagagacugcagagguccauggugacaacuauggugguccaggugacaaaauaacuaucuguaaugguucaaccauuguggaucaaagacuuggcagugaacugggguguuauacuaucaauagagugaagucauucaagcuaugcgaaaauaguggcacgggaaaauccuguaagauagauaaacacccaguuaagugcaggcaggguuuuugcuuaaaaauuacucaggaaggaaggggccaugugaagcuaucgagaggcucagaaguugucuuagaugccugcgacucaagcugugaaauaaugauaccgaagggcacaggagacauccuaguagacuguucaggugggcaacaacauuucuuaaaagauaacuugguugaucuaggaugcccuaacauuccacuauuagguaaaauggcuaucuacauuugcaggaugucaaaucacccuaaaacaacuauggcuuuucucuuuugguuuaguuucggcuauguaauaacauguauauuuuguaaaaucauuuuuuacuuguugauagucguggggacauuggggaaaaaguucaaacaguaccgggagcugaaaccucagacuuguacuauaugugaaacaacuccuaccaaugcaauagaugcugaaaugcacgaucuuaaaugcaguuacaauauaugcccuuauugugcaucuagauuaaccucggacgggcuugccaggcaugugacacaaugcccuaagcgaaaagagaaaguagaagagacugaacuguacuugaacuuggaaagaauuccuuggauugucagaaaacuacugcaagugucagagucuaccgguguggcacugaaaaggagcaguuggcugauuguguuacuugugcuacuuacaguuucauugucaccgguucaaucagcacccauuggacauggaaagacaauugaggcauaucagaccagagagggguacacaaguguuugccuguuuaugcugggaggcaucuuguuuguggucuccugccugaugaaagggcuaguugacagugucagcaacagcuuuuucccuggguuaucuauuugcaaaaccuguucuaucggcaguguaaauggcuuugaaauugaaucccauaaauguuacuguagcuuacuuuguugccuuuauuguagacauugcucugcugauagggaaauccaccaauugcacuugagcaucugcaaaaaaagaagggcaggaggcaaugucaugcuggcugucugcaagcgcaugugccucagagccacuauggagguaagcaauaagguccuauucauccgaaguauuaucaacaccacuuuuguuauaugcauacugguauuggcagucuguaucguuagcaccuccgcaguagagauggaaagccuaccagccggcacuugggaaagggaggaagaccugacuaacuucugccaccaggaaugccaagucacagagacugaaugucucuguccuuacgaggcucuuguacucaggaaaccccuauucucagacaguauagucaagggcaugaaaaaccugcuaaauucaacuagcuuggaaacaagcuuaucaauugaagcaccauggggagcaauaaacguccagucaaccuuuaaacccaccguuucaacugcaaacauagcacuuagcuggaguucaguagaacacagagguaacaaaauuuuggucucaggcagaucagaaucaauuaugaagcuagaagaaaggacaggaaucagcugggaucugggcguagaagaugccucugaaucuaaguugcuuacuguuucugucauggauuugucacagauguauucuccugucuuugaguacuuaucaggugacagacagguagaggaguggcccaaagcaaccugcacaggugauugcccagauagguguggcugcacaucaucaaccuguuuacacaaagaauggccccauucaagaaauuggagaugcaaccccacuugguguuggggagucggcacuggaugcaccugcuguggacuagaugugaaagaucuuuuuacagauuauauguuugucaaguggaaaguugaauacauaaagaccgaggccauagugugcguugagcucaauagccaagaaaggcagugcagcuugauugaggcaggcacaagauucaacuuggguccugugaccaucacguugucagaaccaagaaacauucagcagaagcuuccuccugaaauaaucacauugcauccuagaauugaggaagguuucuucgaucugaugcauguucaaaaggugcugucugcaaguacaguaugcaagcuacaaagcugcacacauggugugccaggagacuuacagaucuaccacauuggcaacuuguuaaaaggggauaggguaaaugggcaucugauucacaaaauugagccacacuucaacacuucuuggauguccugggauggcugugaccuagauuacuacuguaacaugggggauuggcccucuugcacauauacuggagugacccaacauaaccaugcugcuuuuguaaacuuacuuaacaucgaaacugauuacacaaagaacuuccauuuucauucuaaaaggguuacugcccauggagacaccccacaacuggaucuuaaagcuagaccaacuuacggugcgggugaaaucacuguucugguggagguugcugacauggaguuacacacaaaaaagauugcgauaucaggucugaaauuugcaaguuugacuugcacagguugcuaugcuuguagcucuggcaucuccuguaaagucaggauucauguggaugaaccagaugagcuuacaguacaugugaaaagugaagauccggacauuguugcagccagcucaagccucauggcaaggaagcuugaauuugggacagacagcacauucaaggccuucucagccaugcccaaaaccuccuugugcuucuacauuguagagagagaauacugugagagcugcagcaaagaagacacacagaaauguguuaacacaaagcuugagcaaccacaaagcauuuuaauugagcacaaaggaacgauaaucggaaagcaaaaugacacuugcacagccaaagcaagcugcugguuagagucaguaaagaguuuuuuuuauggauugaagaacaugcuuagcggcaucuucggcaacguuuuuauaggcauuuucuuauuccuugcuccuuuuauucuguuaauacucuucuuuauguuuggguggagaauccuguuuugcuuuaaguguugcagaaggaccagaggcuuauucaaguacagauaucucaaggacgacgaagagucugguuacagaagaaucauugaaagauuaaacaacaaaaaaggaaaaaacaaguuacuugacggugaaagacuagcugacaggaggaucgcugaguuguucucuaccaaaacacacauuggu

SEQ ID NO: 3703 - RNA, 3495 nt, Artificial Sequence
  derived and/or modified CDS sequence (wt) from CCHVF(CCHVF BA8402)__AF350449.1__Gn-NSm-Gc
uccgaagagucuggugaugacugcauaucaagaacucagcuauugaggacagagacugcggaaauucacaaugauaacuauggugguccaggugacaagauaaccaucugcaaugguucaacuguuguggaucagagauugggcagugaacugggguguuacacuaucaauagaguaaacucuuuuaaccuuugcgaaaacacugccacgggcaaauccugugaaauagauagcaccccagucaaaugcaggcaggguuucuguuugaaaauuacucaggagggaaggggccacgugaagcuaucgagagguucagaaguuguccuggacgccugcgaaucaagcugugaaauaaugauaccaaagggcaccggagacauccuaguugacuguucagguggacagcaacauuucuuaaaagauaacuugauugaucuaggaugcccaaacaucccacuauuaggcaagauggcuaucuacauuuguagaaugucaaaucauccuaaaacgacuauggcuuuucuuuuuugguuuagcuuugguuauguggugaccuguauacucuguaaggucaucuucuaucuauuaauaguuguggggacguuggggaaaaaguucaaacaguauagagaguugaaaccucagaccuguaccauaugcgaaacaacuccuguuaaugcaauagaugcugaaaugcacgaccucaauugcaguuacaauauauguccauacugugcaucuaggccaaccucagauggucuugccagacauguuaugcagugcccuaagcggaaggaaaaaauugaagaaaccgcauuauacuuaaacuuggaaagaauccccuggguuguuaggaaauuacugcaggugucagaauccaccgguguggcacuaaagaggaguaguuggcugguugugcuacuugugcuacuuacaguuucauugucaccaguacaaucagcaccuaucggccauggaaagacaguugaaacauaucaaaccagagaaggauacacaaguauuugccucuuuguacuaggaagcaucuuauuuauagucucuugccuaaugaagggguugguugacaguguugguaacaguuuuuucccugguuuguccauuuguaagacauguucuauuggcaguguaaauggcuuugagauugaaucucacaaauguuacuguagccuauuuuguugucccuacuguagacacugcucugccgauagagaaauacauagguugcacuugagcaucugcaagaaaaggaagacugggaguaaugucaugcuggccgucuguaagcgcaugugcuuuagggcaacuguggaaguaagcaacaaggcucuacucauccgaaacaucaucaacaccacuuuuguucugugcauacugauauuagcaguuuguguugucagcaccuccgcaguggagauggaaagccugccagcuggcacuugggagagagaggaagaucugacaaauuucugucaucaagaaugccaagucacugagacugaaugccucugucccuacgaagcucuugugcucaggaaacccuuguuuucagacagcauugucaaaggcaugaagaacuugcuaaauucaacaagcuuagaaacaagcuuaucaauugaggcaccauggggagcaauaaauguccaaucaaccuucaaaccuacugugucagcugcgaauauagcucuuaguuggagcucaguggaacacagggguaauaagauuuugguuucagguagaucagaaucaaucaugaagcuagaagaaaggacaggaaucagcugggaucuagggguagaagaugcuucugaaucuaaauugcuuacugucucuguuauggacuugucacagauguacucuccugucuuugaguaccuaucaggugacagacaaguggaggaauggcccaaggcaaccugcacaggagauugcccagaaagauguggcugcacaucaucaaccugccuacacaaagaauggccccauucaagaaacuggagaugcaaccccaccugguguuggggagucggcacuggauguaccugcugugggcuggauguaaaagaccuuuuuacagauuacauguuuaucaaguggaaaguugaguacauuaaaacagaagcuauaguguguguugagcuuacuagccaagagagacaauguaccuugauugaggcaggcacaagauucaacuuagguccugugaccaucacauugucagagccaagaaacauucagcaaaagcucccuccagagauaguuacauugcaccccagaauugaagaagguuucuuugauuuaaugcauguacaaaaggugcuaucagcaaguacaguguguaagcuacagaguugcacacauggugugccaggggaccuacaggucuaucacauaggaaacuuguuaaaaggagacaaggugaaugggcaccugauucacaaaauugaaccacacuucaacacuuccuggaugucuugggacggcugugaccuacacuacuacuguaauaugggggauuggccaucuugcacauauacuggagucacccagcacaaucaugcugcauuuguaaacaugcucaacaucgaaacugauuauacaaaaaacuuccacuuucacucuaagagaguuacugcacauggagacacaccacaauuagauuugaaagcuagaccaacuuauggugcaggugaaaucacugugcugguggaaguugcugacauggaguuacacacaaagaaaauugagauaucagguuugaaguuugcaagcuuaacuugcacaggcuguuaugcuuguagcucugguaucuccuguaagguuagaauccauguagaugagccagaugagcuuacaguacaugugaagagugaagaccccgacauaguugcugcuagcucaagucucauggcuaggaagcuugaauuugggacagauaguacauucaaagccuuuucagccaugcccaaaaccuccuuaugcuucuacauuguggagagagaauauugugaaagcugcagcaaagaagauacacaaaaauguguuaacacaaagcuugagcaaccacagagcauuuuaaucgagcacaaaggcacgauaauugguaagcagagcaacaccugcacagcuaaagcaagcuguuggcuagagucagucaagagcuucuuuuaugggcuaaagaacaugcuuaguggcauuuuuggcaauguuuucauagggguuuucuuauucuuugcuccuuuuauccuuuugauacuuuucuuuauguuuggauggagaauccuguucugcuuuaaauguugcagaagaacuagaggccuuuuuaaguacagacaccucaaggacgaugaagaaaccgguuacaggaaaaucauugagagacugaacaacaaaaaagggaaaaacaaacugcuugauggugaaagauuagcugauaggaagauugcugagcuguucuccacaaagacacacauuggc

SEQ ID NO: 3704 - RNA, 3495 nt, Artificial Sequence
  derived and/or modified CDS sequence (wt) from CCHVF(CCHVF Matin)__AF467769.2__Gn-NSm-Gc
uccgaagagucuggugaugacuguauaucaagaacucagcuauugaggacagagacugcggaaauucacagugauagcuaugguggaccaggugauaagauaaccaucugcaaugguucaacuguuguagaucagagguugggcagugaacuaggguguuacacuauaaauagaguaaagucauuuaagcuuugcgagaacagugccacagguaaauccugugaaauagauagcaccccaguuaaaugcaggcaggguuuuugcuuaaaaauuacucaggagggaaggggccacgugaagcugucgagagguucagaaguugucuuggaugccugugacucaagcugugaaauaaugauaccaaagggcacuggagacauccuaguugacuguucaggugggcagcaacauuucuuaaaagauaaccugauugaucugggaugccccaacauuccacuauuaggcaaaauggccaucuacauuuguagaaugucaaaucaucccaaaacaacuaugguuuuucuuuuuugguuuagcuuugguuauguaauaaccuguauacucuguaaggucaucuucuaucuauuaauaguuguagggacauuagggaaaaaguucaaacaguauagagaguugaaaccucagaccuguaccauaugcgaaacaacuccuguuaaugcaauagaugcugaaaugcacgaccuuaacugcaguuacaauauauguccuuacugugcauccagguugacaucagauggucuugccagacauguaaugcagugccccaaacggaaggaaaaaauagaagaaaccgaauuauacuuaaacuuagaaaggaucccuuggguuguuaggaaauuacugcaggugucagaaucuaccgguguggcacuaaagaggaguagcuggcugguugugcuacuuguguuacuuacaguuucacuaucaccaguacaaucagcaccuaucggccauggaaagacaguugaaacauaucagaucagagaaggguacacaaguguuugccuuuuuguacuagggagcaucuuguuuauagucucuugccuaaugaaagggcugguugacagugacgguaacaguuuuuucccugguuuguccauuugcaagacauguucuauuggcaguauaaauggcuuugaaauugaaucucacaaauguuacuguagccuauuuuguugccccuacuguagacacugcucuacagauagagaaauacauaaauugcacuugagcaucugcaagaaaaggaaaacuggaaguaaugucauguuggccgucuguaagcgcaugugcuuuagggcaacuguagaaguaagcaacaaggcucuacuaauccgaagcaucaucaacaccacuuuuguuguguguauacugauauuagcaguuuguguugucaguaccuccgcaguggagauggaaagccugccagcuggcacuugggagagagaagaagaccugauaaauuucugucaucaggaaugccaagucacugagacugaaugucucuguccuuacgaagcucuugugcucagaaaacccuuguuuuuagacaguauuauuaaggguaugaagaacuugcuaaauucaacaagcuuagaaacaagcuuaucaauugaggcaccauggggagcaauaaauguccaaucaacuuucaaaccuacuaugucagcugcgaacauagcgcuaaguuggagcucaguggaacacagagguaauaagauuuugguuucaggcagaucagagucgaucaugaagcuagaggaaaggacaggaaucagcugggaucuaggaguagaagaugccucugagucuaaauugcuuacuguaucuguuauggacuuaucacagauguauucuccugucuuugaguacuuaucaggugauagacaaguggaggaauggcccaaggcaaccugcacaggcgauuguccagaaagauguggcugcacaucaucaaccugccuacacaaagaauggccccauucaagaaacuggagaugcaauccuacuugguguuggggagucggcacuggauguaccugcugugggcuagacguaaaagaccuuuuuacugauuacauguuugucaaguggaaaguugaauacauuaaaacggaaguuauaguguguguugagcuuacuagccaagaaagacaauguagcuugauugaggcaggcacaagauucaacuuagguccugugaccauuacauugucagagccaagaaacauucagcaaaagcucccuccagagauagucacauugcaucccagaauugaagaagguuucuuugauuuaaugcauguacaaaaagugcuaucagcaaguacagugugcaagcuacagaguugcacacauggugugccaggggaccuacaggucuaccacauaggaaacuuguuaaaaggagauaaggugaacgggcacuugauucacaaaauugaaccacacuucaacacuuccuggaugucuugggacggcugugaccuagacuacuacuguaauaugggggauuggccaucuugcucauauacuggaguaacccaacacaaucaugcugcauuuguaaacaugcucagcaucgaaacugauuauacaaaaaacuuccacuuucacucuaagagaguuacugcacauggagacacaccacaauuagaucugaaagcuaggccaacuuacggugcaggugaaaucacugugcugguagagguugcugacauggaauuacauacaaagaaaauugagauaucagguuugaaguuugcaagcuuaacuugcacaggauguuaugcuuguagcucugguaucuccuguaagguuagaauccauguagaugaaccagaugagcuuacaguacaugugaagagugaagacccagacauaguugcugcuagcucaagucucauggcuagaaagcuugaauuugggacagauaguacauucaaagccuuuucagccaugcccaaaaccuccuuaugcuuuuacauuguggagagagaauauuguaaaaguugcaguaaagaagacacacaaaaaugugucaacacaaagcuugagcaaccacagagcaucuuaaucgagcauaaagggacgauaauuggaaagcaaaacgacaccuguacagccaaagcaagcugcuggcuggagucagucaaaaguuuuuuuuauggacuaaagaacaugcuuaguggcauuuuuggcaauguuuucauagggauuuucuuauuccuugcuccuuuugcccuuuuaauacuuuucuuuauguuuggauggagaauccuguucugcuuuaaauguugcagaagaacuagaggccuauuuaaauacagacaccucaaggacgacgaagaaaccgguuacaggaaaaucauugagaggcugaacaacaaaaaagguaaaaacaaacugcucgacggugaaagacuagcugacaggaagaucgcugagcuguucuccacaaaaacacacguuggc

SEQ ID NO: 3705 - RNA, 3495 nt, Artificial Sequence
  derived and/or modified CDS sequence (wt) from CCHVF(CCHVF Baghdad 12)__AJ538197.2__Gn-NSm-Gc
ucugaagaaucuggugaugacugcauaucaagaacucggcuauugagaacagagacugcagagauccauggugacagcuauggugguccgggugacaaaauuacuauuugcaacgguucaacuauuguagaucaaagacugggaagugagaugggguguuacacuaucaauagagugaagucauucaagcugugcgaaaacagugcaacaggaaagagcuguaaaauagacaguaucccaguuaagugcagacaggguuauugccuaaaaaucacucaggaaggaaggggccaugugaaauuauccaggggcucagagguugucuuggaugcaugcgacucaagcugugaaguaaugauaccuaaaggcacaggugacaucuuaguagacuguucaggugggcagcaacauuuuuugaaggauaacuugauugaucuaggaugccccaacauuccauuauuagguaaaauggcuauuuauauuugcagaaugucaaaucacccuaagacaaccauggcuuuccucuuuugguucaguuuugguuaugugauaaccuguauacucugcaaggccaucuucuacuuauuaauaauuguugggacacuagggaaaagguuuaagcaguacagagaguuaaaaccccagaccuguacuauaugugagacaacuccuguaaaugcaauagaugcugaaaugcaugaccuuaacugcaguuacaauauaugucccuauugugcaucuagauuaaccucagaugggcuugcuaggcaugugacacaaugcccuaagcggaaggagaaaguggaagaaacugaauuguacuugaacuuagagaggauucccuggguuguaagaaagcuguugcagguaucagaguccacagguguugcauuaaagagaagcagcuggcugauugugcugcuugugcuacuugcaguuucaucaucaccaguucaaucagcacccaucgguuaugggaagacaauugagacauaccaggccagggagggauacacaaguauuugccucuuuguacuaggaaguauccuguuuauagucucuugucuaacaaaagggcugguugacaguauuggcaacaucuucuucccugggcuguccauuugcaaaacgugcucuauagguaguaucaauggcuuugaaguugagucucauaagugcuauuguagcuugcuuuguugucccuacuguaggcauugcucugcugauagagaaauccaucagcugcacuugagcaucugcaaaaaaagaaaaacaggaaguagugucaugcuugcagucugcaagcgcaugugcuucagagcaacuauggaagugagcaauaaggcccuacuuauccguagcauuaucaacaccacuuuuguugucugcauauugacacuagcagucuguguuguuagcaccucagcaguagagauggaaagccuaccagcugggaccugggaaagagaagaagaccuaacaaauuucugucaucaagaaugccaggucacggagacugagugccucugcccuuaugaagcccuaguacucagaaagcccuuguuccuggauaguauagucaaaggcacgaaaaaucugcuaaacucaacaaguuuagaaacaagcuuaucgauugaggcaccauggggagcaauaaauguucagucaaccuauaaaccaacugugucaacugcaaacauagcacuuaguuggaguucaguugaacacagagguaacaagauuuugguuucaggcagaucagaaucaauuaugaagcuagaagagagaacaggaaucaguugggaucuuggcguagaagaugccucugaaucuaagcuacuuacagucucugucauggacuugucucagauguacucuccugucuuugaguacuuaucaggugacagacaaguagaagaauggcccaaggcaaccuguacaggugacugcccagaaagauguggcugcacaacaucaaccugcuugcauaaagaauggccccauucaagaaacuggagauguaaucccacuuggugcuggggagugggaacuggcugcacuuguugcggauuagaugugaaggaccuuuuuacagauuauauguucgucaaauggaaaguugaauacauuaaaacagaugccauaguguguguggaacucacuagucaagaaaggcaaugcagcuugauugaggcagguacaagguuuaacuuagguucugugaccaucacauugucagaaccgaggaacauucagcaaaagcucccuccugaaauaaucacauuacauccuaggauugaagaagguuuuuuugaccugaugcauguacaaaaaguguugucagcuagcacaguguguaaguugcagaguugcacacacggugugccaggugaucuacaggucuaccacaucggaaauuuauuaaaaggggauaaagugaauggacaccuaauucauaaaauugagccacauuuuaacacuucuuggauguccugggauggcugugacuuagacuacuauugcaauaugggagacuggccuucuugcacauauaccggaguuacccaacacaaucaugcuucauuuguaaaccugcucaacauugaaacugauuacacaaaaagcuuccacuuucacucuaaaaggguuacugcacauggagauacaccacaguuagaucugaagguaagaccaaccuacggcgcaggagaaaucacuguacugguagaaguugcugacauggaguugcacacgaagaagauugaaauaucaggccuaaaauuugcaagccugacuugcacaggcuguuaugcuuguagcucuggcauuuccugcaaaguuaggauacauguggaugaaccggaugaacucacaguacacgucaaaagugaugauccagauguaguagcagcuagcucaagucucauggcaaggaagcuugaguuuggaacagacagcacauuuaaagcuuucuccgccaugccaaaaacuuccuuauguuucuacauugucgaaagggaguacuguaaaagcugcaguaaagaagauacacaaaaauguguuaacacaaaacuugagcaaccacagagcauuuugauugaacauaagggaacuauaaucggaaagcaaaacaauaccugcacagccaaaacaaguugcugguuagagucaguuaaaaguuucuuuuauggucuaaagaauaugcuuaguggcauuuuuggcaauuuuuucaugggcaucuucuuauuucuugcccccuuuaucuuguuaauacuuuucuuuauguuuggauggaggauccuguuuugcuuuaaguguugcagaagaaccaggggccuguuuaaguacagacaucucaaagaugaugaagaaacugguuauagaaggaucauugaaagacugaacaacaagaaagggaagaacaagcugcuugauggugaaagacuugccgauagaaggauugccgaacuauucuccacaaaaacacauauuggc

SEQ ID NO: 3706 - RNA, 3495 nt, Artificial Sequence
  derived and/or modified CDS sequence (wt) from CCHVF(CCHVF VLG/TI29414)__AY179961.1__Gn-NSm-Gc
uccgaggagccaggugaugacugcauaucaagaacucagcuauugagggcagaaccagcagagauccaugaugacaacuauggugguccaggugauaaaauaacuaucugcaaugguucaaccauuguagaucagagacugggcagugaacuaggguguuauaccaucaacagggugaagucauucaagcuaugcgaaaacagcgccacagggaaaaccugugagauagacagcacuccgguuaagugcaggcaagguuuuuguuuaaaaaucacccaagagggaaggggccacguaaaauuaucuagaggcucagagguuguuuuggaugcuugcgacucaagcugcgaaguaaugauaccuaaaggcacuggagauauccugguggacuguucagguggacagcaacauuucuuaaaagacaauuuaauugaccuagggugcccccauaucccgcuauuggguaaaauggccauuuacaucugcagaaugucaaaucauccuagaacaacuauggcuuuucucuucugguucagcuuuggcuaugugaucaccuguauauuuugcaaggcucuuuuuuauucauugauaauuauugggacacuagggaaaaagaucaagcaauauagggaauugaaaccucaaacuuguaccauaugugagacagccccugucaaugcaauagacgcugaaaugcaugaccuuaacugcaguuacaauauaugcccuuauugugcaucaagauugaccuccgaugggcuagcuaggcaugugccacaaugccccaagcggaaggaaaaaguugaagagacugagcuguacuugaaccuggaaagaauuccuuggaaugucagaaagcuauugcaagugucagaguccacugguguggcauugaaacgaagcagcuggcugauuguacugcuuguguuacucacaguuucauugucaccgguucaaucagcaccuguuggucaugguaagacaaucgaaacauaucagaccagagaaggauucacaaguaucugucucuuuauguuaggaagcauccuguuuuuagucucuugcuuggugaaggggcugguugacagugucagugacagcuucuuccccggccugucugucuguaagacaugcucuauuggcaguauaaauggcuuugaaauugaaucgcauaaaugcuacuguagccuauuuugcugccccuacuguaggcacugcucugcugacagagaaauucaucaguuacacuugaguaucugcaaaaaaagaaaaauggguagcaaugucaugcuggccgucugcaagcgcaugugcuuuagggcaaccauagaagcaagcagaagagcccugcucauccgaagcauuauaaauaccacuuuuguaauaugcauuuuaacauugacaaucuguguuguuagcaccucugcaguagagauggaaaaccuuccaucaggcacuugggagagagaggaagaccugacaaauuucugucaucaggaaugccagguaaccgagacggagugccucuguccauacgaagcucuugugcucagaaaaccucuguucuuagacaguauaguuaaaggcaugaagaauuuacuaaacucaacaaacuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguagaagaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcugggaaguaggaacuggcugcaccugcugcggguggaauguaaaagaccuuuuuacagaucacauguuugucaaauggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacgcugcaucccaaaguugaagagggcuucuuugacuugaugcaugugcaaaaaguguugucugcaaguacaguguguaaacugcagaguugcacacaugguauaccaggagaucuacaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggaaugacccagcauaaccaugcugcauuuguaaacuugcuuaauaucgaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcauaccaagaaaguugagauaucaggcuuaaaauuugcaagucuggcuugcacggguugcuaugcuuguagcucuggcaucuccuguaaagucaggauucauguagaugagccagaugagcucacaguacauguaaagagcaaugauccagaugugauugcagcuagcacaagucucauggcgaggaagcuugaauuugggacagacaguacauucaaggccuuuucagcuaugcccaaaaccucuuuauguuuuuacauugcggagagagaauacugcaagagcugcagugaagaggacacacaaaaauguguugacacaaaacuugagcagccacagagcauacuaauugagcacaaaggaacgauaauuggaaagcagaaugauacuugcacagccaaggcaagcuguuggcuagagucagucaagaguuuuuuuuauggauugaaaaauaugcuugguaguguauuugguaacuuuuucauaggcauuuuguuauuccuugccccuuuuguccuguuggugcuuuucuuuauguuuggauggaaaaucuuguuuugcuucaaauguugcaggaggaccagaggcuuacuuaaguauagacuccucaaagacgaugaggaaacaggcuacagaaggauuauugaaagacugaacaacaaaaaaggaaaaaacagacugcuugauggugaaagguuggcugauaggaaaauugcugagcuguucuccacgaaaacacacauuggu

SEQ ID NO: 3707 - RNA, 3495 nt, Artificial Sequence
  derived and/or modified CDS sequence (wt) from CCHVF(CCHVF TADJ/HU8966)__AY179962.1__Gn-NSm-Gc
ucugaagaaucuggugacgacugcauaucaagaacucagcuacugaggacagagacugcagagauccauggugaugauuauggugguccgggugacaagauuaccauuugcaaugguucgacuauuguagaucaaagacuggguagugaacugggguguuacacuaucaauagagugaagucauucaagcugugcgaaaacagugcaacagggaagaacugcgaaauagacagcgucccaguuaaaugcaggcaggguuauugccuaaaaauuacucaggaaggaaggggccaugugaaauuauccaggggcucagagguuguuuuggaugcaugcgauucaagcugugaaguaaugauaccuaagggcacaggugacaucucaguagacuguucaggagggcagcaacauuuuuugaaagacaacuuaauugaucugggaugucccaagauuccauuauuggguaaaauggccauuuauauuugcagaaugucgaaucacccuaaaacaaccauggcuuuccucuuuugguucaguuuuggcuaugugauaacccguauacucugcaaggccauuuucuacuuauuaauaauuguuggaacacuagggaagagguuuaagcaauauagagaguuaaaaccccagaccuguaccauaugugagacaacuccugcaaaugcaauagaugcugaaaugcaugaccuuaacugcaguuacaacauaugucccuauugugcaucuagacugaccucagauggacucgcuaggcaugugacacaaugcccuaagcggaaggagagaguagaagaaacugaauuguacuugaacuuagaaagaauucccuggauuguaagaaagcuguugcagguaucggaguccacugguguugcauuaaaaagaagcagcuggcugauugugcuacuugugcuguucacaguuucauuaucaccaguucaaucagcacccauugguuaugggaauacaauugaaacauaccaggccagggaagaauacacaagcauuugccucuuuguacugggaaguaucuuguuuauagucucuugucugaugaaagggcugguugacaguauuggcaacaucuucuucccugggcugaccaucugcaagacaugcucuauagguaguaucaauggcuuugaaauugagucucacaagugcuauuguagcuuacuuuguugccccuacuguaggcacugcucugcugauagagaaauucaucagcugcacuugagcaucugcaaaaaaagaaaaacaggaaguaaugucaugcuugcagucugcaagcgcaugugcuucagagcaacuauggaagugagcaauaaggcccuacuuauccguagcaucaucaauaccacuuuuguugugugcauauuaauauuagcagucuguauuguuagcaccucagcaguagagauggaaagccuaccagcugggaccugggaaagagaagaagaccuaacaaauuucugucaucaggaaugccagguuacagagacugagugccucugcccuuaugaagcccuugugcucagaaggccccuguuccuggauaguauagucaaaggcaugaaaaauccgcuaaacuccacaaguuuagaaacaagcuugucgauugaggcaccauggggggcaauaaauguucagucaacuuacaagccaacuguuucaacugcaaacauagcacuuaguuggaguucaauugaacacagagguaauaauauuuugguuucaggcagaucagaaucaauuaugaagcuggaagaaagaacaggaauuaguggggaucuuggcguugaagaugccucugaauccaagcuacuuacagucucuguuauggacuugucucagauguacuccccugucuucgaguacuuaucaggugacagacaaguagaagaguggcccaaggcaaccuguacaggugacugcccagaaagauguggcugcacaucaucaaccugcuuacauaaagaauggccccauucacgaaacuggagaugcaaucccacuuggugcugggggguggggacuggcugcaccuguuguggauuagaugugaaagaccuauuuauagauuauauguucgucaaguggaaaguugauuacauuaaaacagaagccauaguguguguagaacucaccagucaggaaaggcaguguagcuugguugaggcgggcacaagguucaauuuagguccugugaccaucacauugucagaaccgaggaacauacaacaaaagcucccuccugaaauaaucacauugcauccuaggauugaagaagguuuuuuugaucuaaugcaugugcaaaaagugcugucagcaagcacaguguguaaauugcagaguugcacacauggugugccaggagaucuacaggucuaccacaucggaaacuuauuaaaaggagauaaagagaacggacaccuaauucauaaaauugagccgcacuucaauacuuccuggauguccugggauggcugugaccuagacuacuacugcaacaugggagacuggccuucuugcacauauaccggaguuacccagcacaaucaugcuucauuuguaaaccugcucaacauugaaacugacuauacaaaaagcuuccacuuucacucuaaaaggguuacugcacacggagacacaccacaauuggaucugaaggcaagaccaacuuacggcgcaggagaaaucacuguacugguagaaguugcugauauggaguuacacacgaagaagauugaaauaacaggccucaaauuugcaagccugacuugcacagguuguuaugcuuguaguucaggcauuuccugcaaaguuaggauucauguggacgagccagaugaacuuacaguacauguuaaaagugaugauccagauguaguugcagcuagcucaagucucauggcaaggaagcuugaguucgggacagacaguacauucaaagcuuucucagccaugccuaaaacuuccuuaugcuucuacauugucgaaagggaguaccguaagagcuguaguaaagaggacacacagaaauguguuaacacaaaacuugagcaaccacagagcauuuugaucgaacacaagggaacuauaaucggaaagcaaaauaauacuugcacagccaaagcaaguugcugguuagagucagucaaaaguuucuuuuauggucuaaagaacaugcuuaguggcauuuuuggcaauguuuuugugggcauuuucuuguuucuugccccuuuuaucuuguuaauacuuuucuuuauguuuggauggaggauccugucuugcuuuaaguguugcagaagaaccaggggccugcuuaagcauagacaucucaaagacgaugaagaaacugguuacagaaggaucauugaaagacugaacaacaagaaggggaaaaacaagcugcuugauggugaaagacuugccgauagacggauugccgaacuauucuccacaaaaacacacauuggc

SEQ ID NO: 3708 - RNA, 3495 nt, Artificial Sequence
  derived and/or modified CDS sequence (wt) from CCHVF(CCHVF Hodzha)__AY223476.1__Gn-NSm-Gc
ucugaagaaucuggugacgacugcauaucaagaacucagcuacugaggacagagacugcagagauccauggugaugauuauggugguccgggcgacaagauuaccauuugcaaugguucaacuauuguagaucaaagacuagguagugaacugggguguuacacuaucaauagagugaagucauucaagcugugcaaaaacagugcaacagggaagagcugugaaauagacagcaccccaguuaaaugcaggcaggguuauugccuaaaaaucacucaggaaggaaggggccaugugaaauuauccaggggcucggagguugucuuggaugcaugcgauucaagcugugaaguaaugauaccuaagggcacaggugacauccuaguagacuguucaggugggcagcaacauuuuuugaaagacaacuuaauugaucuaggaugucccagaauuccauuauuagguaaaauggcuauuuauauuugcagaaugucgaaucacccuaagacaaccauggcuuuccucuuuugguucaguuuuggcuaugugauaaccuguauacucugcaaggccauuuucuacuuauuaauaauuguuggaacacuagggaagagguucaagcaguauagagaguuaaaaccccagaccuguaccauaugugagacaacuccugcaaaugcaauagaugcugaaaugcaugaccuuaacugcaguuacaacauaugucccuauugugcaucuagacuaaccucagaugggcuugcuaggcaugugacacaaugcccuaagcggaaggagaagguagaagaaacugaauuguacuugaacuuagagagaauucccuggauuguaagaaagcuguugcaggugucggaguccacugguguugcauuaaaaagaagcagcuggcugauugugcugcuugugcuguucgcaguuucauuaucaccuguucaaucagcacccauuggucaugggaagacaauugaaacauaccaggccagggaagauuacacaaguauuugccucuuuguacugggaagcaucuuguuuauagucucuugucugaugaaagggcugguugacaguauuggcaacaucuucuucccugggcugaccaucugcaagacaugcucuauagguaguaucaauggcuuugaaauugagucucacaagugcuauuguagcuuacuuuguugccccuacuguaggcacugcucugcugauagagaaauucaucagcugcacuugagcaucugcaaaaaaaggaaaacaggaaguaaugucaugcucgcagucugcaagcgcaugugcuucagagcaacuauggaagugagcaauaaggcccuacuuauccguagcaucaucaacaccacuuuuguugugugcauauugauauuagcagucuguguuguuagcaccucagcgguagagauggaaagccuaccagcugggaccugggaaagagaagaagaccuaacaaauuucugucaucaggaaugccagguuacagagacugagugccucugcccuuaugaagcccuugugcucagaaggccccuguuccuggauaguauaguuaaaggcacgaaaaaucuguuaaacuccacaaguuuagaaacaagcuugucgauugaggcaccauggggggcaauaaauguucagucaaccuacaaaccaacuguaucaacugcaaacauagcacuuaguuggaguucaguugaacacagagguaauaagauuuugguuucaggcagaucagaaucaauuaugaagcuggaagaaagaacaggaaucagcugggaucuuggcguugaagaugccucugaaucuaagcuacuuacugucucugucauggacuugucucagauguacuccccugucuucgaguacuuaucgggugacagacaaguagaagaguggcccaaagcaaccugcacaggugacugcccagaaagauguggcugcacaucaucaaccugcuuacauaaagaauggccccauucacgaaacuggagaugcaaucccacuuggugcugggggguggggacuggcugcaccuguuguggauuagaugugaaagaccuauuuacagauuauauguucgucaaguggaaaguugauuacauuaaaacagaggccauaguguguguagaacucaccagucaggaaaggcaguguagcuugguugaggcgggcacaagguucaauuuagguccuguaaccaucacauugucagaaccgaggaacauacaacaaaagcucccuccugaaauaaucacauugcauccuaggauugaagaagguuuuuuugaccugaugcauguacaaaaagugcugucagcaagcacaguguguaaauugcagaguugcacacauggugugccaggagaucuacaggucuaccacaucggaaauuuauuaaaaggggauaaagugaacggacaccuaauucauaaaauugagccgcacuucaauacuuccuggauguccugggauggcugugaccuagacuacuacugcaacaugggagacuggccuucuugcacauauaccggaguuacccaacacaaucaugcuucauuuguaaaccugcucaacauugaaacugacuauacaaaaagcuuccacuuucacucuaaaaggguuacugcacauggagacacaccacaauuggaucugaaggcaagaccaaccuacggcgcaggagaaaucacuguacugguagaaguugcugauauggaguuacacacaaagaagaucgaaauaacaggccuuaaauuugcaagccugacuugcacagguuguuaugcuuguaguucaggcaucuccugcaaaguuaggauucacguggaugaaccagaugagcuaacaguacauguuaaaagugaugacccagauguaguugcagccagcucaagucucauggcaaggaaacuugaguuuggaacagacaguacauucaaagcuuucucagccaugccuaaaacuuccuuaugcuucuacauugucgaaagggaguacuguaagagcugcaguaaagaagacacacagaaauguguuaacacaaaacuugagcaaccacagagcauuuugaucgaacgcaagggaacuauaaucggaaagcaaaacaauacuugcacagccaaggcaaguugcugguuagagucaguuaaaaguuucuuuuauggucuaaagaacaugcuuaguggcauuuuuggcaauguuuuuguaggcauuuucuuauuucuugcccccuuuaucuuguuaauacuuuucuucauguuuggauggaggauccuguuuugcuucaaguguugcagaagaaccaggggccuguuuaaguauaaacaucucaaagacgaugaagaaacugguuacagaaggaucauugaaagacugaacaacaagaaggggaaaaacaagcugcuugacggugaaagacuugccgauagaaggauugccgaacuauucuccacaaaaacacacauuggc

SEQ ID NO: 3709 - RNA, 3495 nt, Artificial Sequence
  derived and/or modified CDS sequence (wt) from CCHVF(CCHVF Kosovo/9553/2001)__AY675511.1__Gn-NSm-Gc
uccgaagagccaggugaugacugcauaucaaggacucagcuauugaggacagaaacagcagagauccaugacgauaacuauggugguccaggugacaaaauaacuaucugcaaugguucgaccauuguagaucagagacugggcagugaacuaggguguuauaccaucaacagggugaagucauucaagcuaugcgaaaacagcgccacagggaaaaccugugagauagacagcacuccaguuaagugcaggcaagguuuuuguuuaaaaaucacccaagagggaaggggccacguaaaauuaucuagaggcucagagguugucuuggacgcuugcgacucaagcugugaaguaaugauacccaaaggcacuggagauauccuaguagacugcucugguggacagcagcauuucuuaaaagacaacuugauugaccuagggugcccucauaucccacuauuggguaagauggccauuuacauugccagaaugucaaaucauccuaaaacaaccauggcuuuucucuucugguucaguuugggcuaugugaucaccuguauacuuugcaaggcucuuuuuuauucauugauaauuauugggacacuagggaaaaaaaucaagcaauauagggaacugaaaccucaaacuugcaccauaugugagacagcuccugucaaugcaauagaugcugaaaugcaugaccucaacuguaguuacaauauaugccccuauugugcaucaagauugaccucugaugggcuagcuaggcauguaaagcagugcccuaagcgaaaggagaaagucgaggagacugagcuguaccugaaccuggaaagaauuccuugggucgucagaaagcuauugcaagugucagaguccacugguguggcauugaaacgaagcaguuggcugauugugcugcuuguguuacucacaguuucauugucaccgguucaaucagcacccguuggucaugguaagacaaucgaaacauaucagaccagagaaggauucacaaguauuugucucuuuauguuaggaagcauccuauucauagucuccugcuuggugaaagggcugguugacagugucagugacagcuucuucccuggccugucugucuguaaaacaugcuccauuggcaguauaaauggcuuugaaauugaaucgcauaaaugcuacuguagcuuguucugcugccccuauuguagacacugcucugcugacagagaaauucaccaauugcacuugaguaucugcaaaaaaagaaaaacagggagcaaugucaugcuagcugucugcaagcgcaugugcuuuagagcaaccauagaagcaagcagaagagcccugcucauccgaaguauuaucaauaccacuuuuguaauaugcauucuaacauuaacaaucuguguugcuaguaccucugcaguagagauggaaacccuuccagcagccaccugggagagagaggaagaccugacaaauuucugucaucaggaaugccagguacccgagacggaaugccuuugcccauacgaagcucuugugcucaggaaaccucuuuucuuagacaguauagucaaagguaugaaaaauuugcuaaacucaacaagcuuggaaacaagcuuaucaauugaggcaccauggggagcaauaaauguccagucaaccuuuaaaccaacaguaucgacugcgaacauagcacucaguuggagcucaguggagcacagaggcaacaagaucuuagucacaggcaggucugaaucaauuaugaaacuagaggaaaggacaggagucagcugggaucuagggguagaagaugccucugaauccaaauuacuuaccgucucuaucauggauuugucacagauguauuccccaguuuuugaguacuugucuggagacagacagguugaagaauggcccaaagcaacuuguacaggugacugcccagaaagguguggcugcacaucaucaaccugcuugcauaaagaauggccucauucaagaaacuggagauguaaucccacuuggugcuggggagugggaaccggcugcaccugcugcgggguggauguaaaagaccuuuuuacagaucacauguuugucaaauggaagguugaauauauaaaaacugaagccauaguguguguugagcucaccagccaagaaagacagugcagucugauugaggcagguacuagauucaacuugggcccugugacuauuacccugucugagccaagaaacauucagcagaagcuucccccugagaucauuacguugcaucccaaaauugaggaaggcuucuuugacuugaugcauguacaaaaaguguuguccgcaaguacaguguguaaacugcagaguugcacacaugguauaccaggagaucuacaaguuuaccacauuggcaacuuguugaaaggggauagaguaaacgggcaucuaauucacaaaauugaaccacauuucaacaccucuuggauguccugggaugguugugacuuagacuacuacugcaacaugggggacuggccuucuuguacauacacaggagugacccagcauaaucaugcugcauuuguaaacuugcuuaacauugaaacugauuacacgaaaaccuuccacuuccacucuaaaagagucacagcacauggugacacaccacaauuggacuuaaaagcaaggccgaccuacggugcaggagagaucacugugcugguugagguugcugacauggaguugcauaccaagaaaguugagauaucgggcuugaaauuugcaagucuggcuugcacagguugcuaugccuguagcucuggcaucuccuguaaagucaggauucauguagaugaaccagaugagcucacagugcauguaaagagcagugacccagauguuguugcagcuagcacaagccucauggcaaggaagcuugaauuugggacagacagcacauucaaggccuuuucagcuaugcccaaaaccucuuuauguuuuuacauuguggagaaagaauacugcaagagcugcagugaagaugauacaaaaaaauguguugacacaaaacuugagcagccacagagcauacuaauugagcacagagggacgauaauuggaaagccgaaugauacuugcccagccaagacaagcuguuggcuagaguccgucaagagcuuuuuuuauggauugaagaauaugcuuggcagugucuuugguaauuuuuucauaggcauuuuguuauuccuugccccuuuuuuccuguggaugcuuuccuuuauguuuggauggaaaaucuuguucugcuuuaaauguugcaggaggaccagaggccuguuuaaguauagacaccucaaagacgaugaggaaacaggcuacagaaggauuauugaaaggcugaacaacaaaaaagggaaaaauagacugcuugauggugaaagguuggcugauaggaaaauugccgagcuguuuucuacaaaaacacacauuggc

SEQ ID NO: 3710 - RNA, 3495 nt, Artificial Sequence
  derived and/or modified CDS sequence (wt) from CCHVF(CCHVF SPU41/84)__AY900142.1__Gn-NSm-Gc
uccgaggagucuagcgacgacugcauaucaagaacucaacuauugaggacagagacugcagagauccacggcgauaacuaugguggcccaggugacaagauaaccaucugcaauggcucaacuguuguagaccagagacuggguagugagcugggguguuacacuaucaauagaguaaagacauucaaacuaugcgaaaacagugcuacagggaagaguugugagauagauagugucccaguuaaaugcaggcaggguuauugccuaaaaaucacucaggaaggaaggggccauguaaaauuaucuagaggcucagagguugucuuggaugcaugugauacaagcugugaaguaaugauacccaaaggcacuggugacauccuaguugacuguucaggugggcagcaacauuuucuaaaagacaaucuaauagaccuaggaugccccaaaauuccauuacuggguaaaauggcuauuuacauuugcagaaugucgaaucaccccaaaacaacuauggcuuuccucuucugguucagcuuuggcuaugugauaacuuguauaauuuguaaggucauuuuuuacuuguuaauaauuguuggaacacuaggaaaaagguucaagcaguacagagaguuaaaaccucagaccugcaccauaugugagacaacuccugugaaugcaauagaugcugagaugcaugaccucaauugcaguuacaacauaugucccuauugugcaucuagacuaaccucagacgggcuugcuaggcaugugacacagugcccuaagcggaaggaaaaaguggaggaaacugaauuguacuugaacuuggagagaauucccuggguugugagaaagcuguugcagguaucagaguccacugguguggcauugaaaaggagcagcuggcugguugugcugcuggugcuguugacgguuucauugucaccgguucagucagcgcccauuagucaugggaagacaguugaggcauaccgggcaagagagggguacacaaguaugugucucuuugugcugggaaguguccuguuuuuagucuccugucuaaugaaaggacugguugacagugucggcaacaccuucuucccuggacuguccauuugcaaaacgugcucuauaagcagcauuaauggcuuugaaauugagucucauaggugcuauugcagcuuguuuuguugcccauauuguaggcacugcucugcuaauaaagaaauucaucagcugcacuugagcaucugcaaaaaaaggaaagcaggaaguaaugucaugcuggcugucugcaagcgcaugugcuuuagggccaccauggaaguaagcaacagagcccuguuuauccguagcaucaucaacaccacuuuuguuuuaugcauacugauacuagcagccuguguugucagcaccucagcaguggagauggaaagccuaccagccgggaccugggagagagaagaagaccuaacaaacuucugucaucaggaaugccaaguugcggauacugaaugccucugcccuuaugaagcucuagugcucagaagaccucuauucuuagauaguauaguuaagggcaugaaaaauuugcuaaacucaacaaguuuagagacaaguuuaucaauugaggcaccauggggagcaauaaauguucagucaaccuacaaaccaacuguaucaacugcaaacauagcgcuuaguuggagcucaguggaacacagaggcaauaagauacugguuucaggcagaucagaaucaauuaugaagcuggaagaaaggacaggaauaagcugggaucucgguguggaagacgccucugagucuaaacugcuuacagucucugucauggacuugucucagauguacucaccugucuucgaguacuuaucaggagacagacagguggaggaguggcccaaagcaacuuguacgggugacugcccagaaagauguggcugcacaucaucaaccugcuugcacaaagaauggccccacucaagaaauuggagauguaaucccacuuggugcugggguguaggaacuggcugcaccuguuguggauuagacgugaaagaccucuuuacagauuauauguuugucaaguggaaaguugaauacauuaagacagaagcaauaguguguguagaacuuacuagucaggaaagacaguguagcuugauugaagcgggcacaagguucaacuuggguccugugaccaucacauugucagaaccaagaaacauccagcaaaagcucccaccugaaauaaucacacugcaucccaggauugaggaggguuuuuuugaccugaugcauguacaaaaaguguugucggcaagcacaguguguaaguugcagaguugcacacauggugugccaggagaucuacaggucuaccacaucggaaauuuacuaaaaggggauaagguaaaugggcaccuaguucauaaaauugagccacacuucaauacuucuuggauguccugggaugguugugaucuagacuauuauugcaacaugggagauuggccuucuugcacauacacaggaguuacccagcacaaucaugccucauuuguaaacaugcucaacauugaaacugauuacacaaaaaacuuccacuuucacucuaaaagggucacugcacacggagacacaccacaacuagaucuuaaagcaagaccaaccuauggugcaggugagaucacuguauugguggagguugcugacauggaguuacacacaaagaagauugaaauaucaggcuuaaaauuuacuagcuugacuuguacagguuguuaugcuuguaguucuggcaucucaugcaaaguuagaauucauguggaugaaccagaugagcuuacagugcauguuaaaagugaagauccagauguuguugcagcuagcucaagucucauggcaagaaagcuugaauuuggaacagacaguacauuuaaagcuuuuucagccaugccuaaaacuucucuauguuucuacauuguggaaagagaauacuguaagagcugcagugaagaagacacacaaaaauguguuaacacaaaacuugagcagccacagagcauuuugaucgaacguaagggaacuauaaucgggaagcaaaacaacacuugcaaggcuaaggcggguugcugguuagagucaguuaagaguuuuuuuuacggccuaaagaacaugcucaguggcauuuuuggcaauguauuuauaggcauuuucuuauuccuugcccccuucauccuguuaauacuauucuuuauguuuggguggaggaucuuguuuuguuuuaaguguuguagaagaaccagaggccuguucaaguacagacaccugaaagacgaugaagaaacugguuauagaaagaucauugaaagacuaaacaacaaaaaagggaaaaauaaacugcuugauggugaaagacuugcugauagaagaauugccgaacuguucucuacaaaaacacacauuggc

SEQ ID NO: 3711 - RNA, 3495 nt, Artificial Sequence
  derived and/or modified CDS sequence (wt) from CCHVF(CCHVF UG3010)__AY900143.1__Gn-NSm-Gc
gcagaaggagugagcaaugacuguguuucaaggacccagcuaaucaaaacagaaguugcagagauucaugaagauaguuauggugggccuggagaaaaaauaacaaucugcaacggcuccacaaucguggaccaaagacucgguagcgaacuaggcugcuacacaaucaaccgugugaagacuuauaagcuuugugagaauagugcuacagagaaggguugugagaucgauagugucccagucaaaugcaaacaaggguucugccucaaaguaacccaagagggcaggggccauguaaaacuguccagaggaacggaaauuguccuagauguaugugacaccaguugugaguugaugauacccaagggcacuggggacauauugguggacugcucaggaggacagcagcacuuuuugcaggauaacuugauugacuuagguuguccaaauguaccauuauuaggcaagauggcaauauauaucugcaggaugucaaaucauccuaaaacuaccauggcuuuucuguucugguuuagcuuuggcuaugucaucacaugcauaguauguaaagugcuuuucuaucugcuaauugucaucgggacacuaaguaagaaacuuaaacaguauagggaauuaaaaccucaaacaugcauugucugugaaucaaccccuguuaaugcaauagaugcugaaaugcacgagcucaauuguaauuacaacauaugcccauacugcgcguccagacuaacuucagauggacuagucagacaugugaaucaaugucccaaaaggaaagaaaaggucgaggagacugaacuauacuugaaccuggagaggauaccuuggcuaguaaggaggcuacuacaagugucagagucaacggggauggcucuaaagagaaguugcuggaugaccacacuccucauucugcuaguaguuucauuaucgccaguucaaucugcuccaguuggucaggggaaagcagucgaagucuaccgggugagagaaagcuacacaagcauaugccucuuuguauuaggaaguguucucuuugcgguauccuggcugauaaaggguuugauugacgguaucggcaacaguuuuuucccugggcuuucugucugcaaaacaugcucuauuggcagcauaaauggguucgagauagagucucacaaaugcuauuguagucuguuuuguuguccuuauugcagagcuugcucaucugacaaaaucacucaccgaaugcauuugaacgucugcaagaaaaggaaagcggguagcaauguuaugcuggcugucuguaagcguaugugcuuuaaggcaacuguugaagcaagcaacacagccuugcucaucagggguaucauaaauuccacuuuugugauaugcguacugauccugguuaucugugugguaagcacaucugcuguugacauggagaaucuaccagcaggaaucugggagagagaagaagaccuuacaaacuuuugccaccaagaaugucaaguaacagaaacugagugucuuugcccguaugaagccuuaauucucagaaagccucuuuaccuagacagcauagccaaggggaugaaaagucugcuaaauucuacgaauuuagagacaagccugucgauugaggccccguggggagcaaucaauguucagucaacuuuuaaaccaacaguuucagcugccaauauagcacuuagcuggaguucaguugaacacaggggcaacaaaauccuaguuucgggcaggucagagucaauuaugaagcuggaagaaaggaccgguaucagcuggagccuagguguagaggaugcuucugagucaaagacgcugacuguuucugucauggaccuaucccaaauguauucucccgucuuugaguaucugucaggugauagacagguagaagaguggccaaaagccaccugcacaggcgacugccaagagagauguggcugcacuucuucaaccugcuugcauaaagaauggccacacucgagaaacuggcgaugcaaccccacuugguguuggggaguggggacuggcugcaccugcuguggauuggaugugagagaccuuuucacggacuacaugaugguuaaguggaaaguggaauauguaaaaacagaagcuauaauguguguugagcuaaccagucaggagaggcaauguaguuugauugaagcagguacaagauuuaaccuaggcccugugacaauaacccugucagagccaagaaacauccagcaaaggcucccuuccgaaaucguuacacugcacccuaagauagaagaaggguucuuugacuugaugcaugugcaaaagguacuaucugcaaguacagucugcaaacuacagagcugcacacacggugucccuggcgaucuacaggucuaccauguuggcaaccuacugaaaggagauaaggucaaugggcacucaauccacaagauagagucccauuucaacacuucauggaugucaugggauggaugugaucuagacuacuucugcaacaugggugacuggcccucauguacauacacuggagugacacagcacaaccgugcggcauucaucaauaugcucaauauugagacugauuauacaaagacuuuccacuuccauuccaagagaguaacggcacauggugacaccccucaacuggaucugaaggcaaggccuacauauggugcaggcgaagucacuguucuaguagagguugcagaucuggagcuacacaccaagaaaauugaagugucaggacugaaguuugcaagucugaccugcuccgguuguuacgccugcagcuccgguaucuccugcaaaguuagaauucaugugaaugaaccagaugaauuuacuguacaugugaaaagcagugauccagauguuguggcagcaggaucaaguuugauggcaaggaaaauagaguuuggggcugacagcaccuucaaagcuuucucaucaaugccuaaaaacucuuugugcuucuauauaguggaaagagacuacugcagcagcugcaccaaugaugacacucagaaguguguugacacaaagcucgaacauccacaaagcauauuaauugagcauaagggaacaauaauuggcaaacaaaacgacaccuguucgaccaaaacaagcuguuggcuagaaucagucaagaguuuuuuuuauggacuaaaaaacaugcuggguggcaucuucgguaaugucuucuuaggcaucuuccuguuccuugcuccuuuugcacugcuaauauucuucuucuucuucggguggaggcuucuguucugucugaaguguugcagaagaaccagggggcugcuaaaguauaaacaacuuaaggacgaagaagaagccggguacaagaaaaucaucgagaggcuaaaugacaaaaaaggcaaaagucgacuguuugacggagagaggcuugcagauaggaagauugcagaacucuuuucaaccaaaacucauauaggg

SEQ ID NO: 3712 - RNA, 3495 nt, Artificial Sequence
  derived and/or modified CDS sequence (wt) from CCHVF(CCHVF Hy13)__AY900145.1__Gn-NSm-Gc
uccgaagagucuggugaugacugcauaucaagaacucagcuaucgaggacagagacugcggaaauucacagugauaacuauggugguccaggugacaagauaaccaucugcaaugguucaacuauuguagaucagagauugggcagugaacuaggguguuacacuaucaauagaguaaagucauuuaagcuuugcgagaacagugccacagguaaauccugugaaauagauagcaccccaauuaaaugcaggcaggguuuuuguuuaaaaauuacucaggagggaaggggccacgugaagcuaucaagagguucagaaguugucuuggacgccugugauucaagcugugagauaaugauaccaaagggcacuggagacauccuaguugacuguucagguggacagcaacauuucuuaaaagauaacuugauugaucugggaugcccaaacaucccacuauuagguaagauggcuaucuacauuuguagaaugucaaaucauccuaaaacgacuauggcuuuucuuuuuugguuuagcuuugguuaugugauaaccuguauacucuguaaggucaucuucuaccuauuaauaguuguggggacguugggaaaaaaguucaaacaguauagagaguugaaaccucagaccuguaccauaugcgaaacaacuccuguuaaugcaauagaugcugaaaugcacgaccucaacugcaguuacaauauauguccuuacugugcaucuagguuaaccucagacggucuugccagacauguaaugcagugcccuaagcggaaggaaaaaguagaagaaaccgaauuauacuuaaacuuagaaagaauccccuggguuguuaggaaauuacugcagguaucagaauccaccgguguggcacuaaagaggaguaguuggcugguugugcuacuuguguuacuuacaguuucauugucaccaguacaaucagcaccuaucggccauggaaagacaguugaaacauaucaaaccagagaaggguacacaagcauuugccuuuuuguacuaggaagcaucuuauuuauagucucuugccuaaugaagggguugguugacaguguugguaacaguuuuuucccugguucguccauuuguaagacauguucuauuggcagcauaaauggcuuugagauugaaucucacaaauguuacuguagccuauuuuguugccccuacuguagacacugcucugccgauagagaaauacauaaguugcacuugagcaucugcaagaaaaggaagacugggaguaaugucauguuggccgucuguaagcgcaugugcuuuagggcaacuguggaaguaagcaacaaggcucuacuuauccgaaacaucaucaauaccacuuuuguugugugcauacugauauuagcaguuuguguugucagcaccuccgcaguggagauggaaagccugccagcuggcacuugggagagagaggaagaucugacaaauuucugucaucaagaaugccaagccacugagacugaaugccucuguccuuacgaagcucuugugcucaggaaacccuuguuuucagacaguauugucaaaggcaugaagaacuugcuaaauucaacaagcuuagaaacaagcuuaucaauugaggcaccauggggagcuauaaauguccaaucaaccuucaaaccuacuguguccgcugcgaacauagcucuuaguuggagcucaguggaacacagggguaauaagauuuugguuucagguagaucagagucaauuaugaagcuagaggaaaggacaggaaucagcugggaucuagggguagaagaugccucugagucuaaauugcuuacugucucuauuauggacuugucacagauguauucuccugucuuugaguaccuaucaggugauagacaaguggaggaauggcccaaggcaaccugcacaggagauugcccagaaagauguggcugcacaucaucaaccugccuacacaaagaauggccccauucaagaaacuggagaugcaaccccaccugguguuggggagucggcacuggauguaccugcugugggcuggauguaaaagaccuuuuuacagaucacauguuugucaaguggaaaguugaguacauuaaaacagaagcuauaguguguguugagcuuacuagccaagagagacaauguagcuugauugaggcaggcacaagauucaacuuagguccugugaccaucacauugucagagccaagaaacauucagcaaaagcucccuccagagauaguuacauugcaucccagaauugaagaagguuucuuugauuuaaugcauguaaaaaaagugcuaucagcaaguacaguauguaagcuacagaguugcacacauggugugccaggggaccuacaggucuaccacauaggaaacuuguuaaaaggagacaaggugaaugggcaccugauucacaaaauugaaccacacuucaacacuuccuggaugucuugggacggcugugaccuagacuacuacuguaauaugggagacuggccaucuugcucauauacuggaguaacccagcacaaucaugcugcauuuguaaacaugcucaacaucgaaacugauuauacaaaaaucuuccacuuucacucuaagagaguuacugcacauggagacacaccacaauuagauuugaaagcuagaccaacuuauggugcaggugaaaucacugugcuaguggaaguugcugacauggaguuacacacaaagaaaauugagauaucagguuuaaaguuugcaagcuuaacuugcacaggcuguuaugcuuguagcucugguaucuccuguaagguuagaauccauguagaugagccugaugagcuuacaguacaugugaagagugaagacccagacauaguugcugcuagcucaagucucauggcuagaaaacuugaauuugggacagauagcacauucaaagccuuuucagccaugcccaaaaccuccuugugcuuuuacauuguggagagagaauauuguaaaagcugcaguaaagaagauacacaaaaaugugucaacacaaagcuugagcaaccacagagcauuuuaauugagcacaaaggaacgauaauugguaagcaaaacgacaccugcacaucuaaagcaggcuguuggcuagagucagucaagagcuucuuuuaugggcuaaaaaacaugcuuaguggcauuuuuggcaauguuuucauagggauuuucuuauuccuugcuccuuuuauccuuuuaauacuuuucuuuauguuuggauggagaauccuguucugcuuuaaauguugcagaagaacuagaggcuuauuuaaguacagacaccucaaggacgaugaagaaaccgguuacaggaaaaucauugagaggcugaacaacaaaaaagggaaaaacaaacugcuugauggugaaagauuagcugauaggaagauugcugagcuguucuccacaaagacacacauuggc

SEQ ID NO: 3713 - RNA, 3495 nt, Artificial Sequence
  derived and/or modified CDS sequence (wt) from CCHVF(CCHVF Semunya)__DQ094832.1__Gn-NSm-Gc
gcagaaggagugagcaaugacugcguuucaaggacccagcuaaucaaaacagaaguugcggagauucaugaagauagcuacggugggccuggagaaaaaauaacaaucugcaacggcuccacaaucguggaccaaaggcuugguagcgaacuagguugcuacacaauuaaccgcgugaagacuuauaagcuuugugagaacagugccacagaaaaggguugugagaucgauaguguuccagucaaaugcaaacaaggguucugccucaaaguaacccaagagggcaggggccaugugaaacuaucuagaggaacggaaauuguccuggaugugugugacaccaguugugaguugaugauaccuaaaggcacuggagacauauugguggacugcucaggaggacagcagcacuucuugcaggacaacuugauugacuuagguugcccaaauguaccauuacuaggcaagauggcaauauauaucugcaggaugucgaaccauccaaagaccaccauggcuuuuuuguucugguucaguuuuggcuaugucaucacaugcguaguaugcaaagugcucuucuaucugcuaauugucaucgggacacuaggaaagaaacuuaaacaguauagggaacuaaaaccucagacaugcauugucugugaaucaaucccugucaaugcaauagaugcugaaaugcacgagcucaauugcaauuacaauauaugcccauacugugcguccagacugacuucagauggacuaguuagacaugugacucaaugucccaaaaggaaggaaaaggucgaggagacugagcuguacuugaaccuggagaggauacccugguugguaagaagacuacugcaagugucagagucaacagggauggcucuaaagagaaguugcuggaugaccacacuccucauucugcuaguaguuucauugucuccaguucaaucugcuccaguaggucaggagaaagcaaucgaagucuaccaggugagagaaaguuacacaagcauaugccucuuuguauuaggaaguguucucuuugcagucuccuggcugguaaaggguuugauugacgguaucggcaacaguuuuuucccugggcuuucugucugcaaaacaugcucuauuggcagcauaaauggauuugaaauagagucccacaaaugcuauuguagucuguucuguuguccuuacugcagagcuugcucaucugacaaaaucacucaccgaaugcauuugaauaucugcaagaggaggaaaguggguagcaauguuaugcuggcugucuguaagcguaugugcuuuaaggcgacuguugaagcaagcaacucagcccugcucaucagaagcaucauaaacuccaccuuugugauaugcgugcugauucuaguuaucugugugguaagcacaucugcugucgacauggagaaucuaccagcaggcaucugggagagagaagaagaccuuacaaacuucugccaucaagaaugccaagugacagagacugagugucuuugcccguaugaagccuuaauucucagaaagccccuuuuccuggauagcauagccaaggggaagaaaagucuguuaaauucuacgaacuuagagacaagccugucgauugaggccccauggggagcaaucaauguucagucaacuuuuaaaccaacaguuucagcugccaacauagcacuuagcuggaguucaguugaacacaggggcaacaaaauccuaguuucgggcaggucagagucaauuaugaaacuggaagaacggaccggcaucagcuggagccuagguguagaggaugcuucugagucaaagacgcuuacuguuucugucauggaccugucucaaauguauucuccugucuuugaguaucugucaggugauagacaaguagaagaguggccaaaggccacuugcacaggcgacugcccggagagauguggcugcaccuccucaaccugcuugcauaaagaauggccgcacucgagaaacuggcgaugcaaccccacuugguguuggggaguagggacuggcugcaccugcuguggacuggauguuagagaccuuuucacggacuacaugauggucaaguggaaaguggaauauguaaaaacagaagcuauaauguguguugagcuaacuagucaggaaaggcaguguaguuuaauugaggcagguacaagguuuaaccuaggcccugugacaauaacccugucagagccaagaaauguccagcaaaggcuucccuccgaaaucguuacacugcacccuaagauagaggaaggauucuuugauuugaugcaugugcaaaaaguacuauucugcaaguacaguuugcaagcuacaagcugcacacacggcgucccaggcgauuugcaggucuaccauguuggcaaccuacugaaaggagacaagguuaaugggcacucaauucacaagauagagucucauuucaacaccucauggaugucaugggauggaugugaccuagacuacuuuugcaacaugggugacuggccuucauguacauauacuggagugacacagcacaaucgugcggcauucgucaacaugcucaauauugagacugauuauacaaagacuuuucacuuccauuccaagaggguuacggcacacggugacaccccucaacuggaucugaaggcaagaccaacauauggugcaggcgaggucacuguucuaguggagguugcagaucuggagcuacacacuaagaaaauagaagugucaggguugaaguuugcaagucugaccugcuccgguuguuaugccugcaguuccggcaucuccugcaaaguuagaauucaugugaaugaaccagaugaguucacaguacacgugaaaagcaaugauccagacguuguggcagcaggaucaagucugauggcaaggaaaauagaguuuggggcugacagcaccuuuaaagccuuuucaucaaugccuaaaaacucuuugugcuuuuauauaguggaaagagacuacugcagcagcugcaccgaugaugacacucagaaguguguuaacauaaagcucgaacauccacaaagcauauuaauugagcauaagggaacaauaauugguaagcaaaaugacaccuguccgaccaaaacaagcugcuggcuagaaucagucaagaguuuuuuuuauggacugaaaaacaugcuggguggcaucuucggcaaugucuucuuaggcaucuuccuauuccuugcuccuuuugcacugcugauacucuucuucuucuuuggauggaggcuucuguucugucugaaguguugcagaaggaccaggggucugcuaaaguauaaacaacuuaaggaugaagaagaagccggguacaagaaaaucaucgagaggcugaaugacaaaaagggcaaaagucgacuuuuugauggagagaggcucgcugacaggaagauugcuaaacucuucucaaccaagacucauauaggg

SEQ ID NO: 3714 - RNA, 3495 nt, Artificial Sequence
  derived and/or modified CDS sequence (wt) from CCHVF(CCHVF SPU128/81/7)__DQ157174.1__Gn-NSm-Gc
uccgaagaacccagugaugacugcauaucaagaacucaacuauugaggacagagacugcagagauccacggcgacaacuaugguggcccgggugacaaaauaaccaucugcaacggcucaacuauuguagaccaaagacuaggcagugagcuaggguguuacacuaucaacagagugaagucauucaagcuaugcgaaaauagugccacagggaagagcugugaaauagaaagugucccaguuaaaugcaggcaggguuauugccugagaaucacucaggaagggaggggccauguaaaauuaucuaggggcucagagguugucuuagaugcaugugauacaagcugugaaauaaugauaccuaagggcacuggugacaucuugguugacuguucaggugggcagcaacauuuucuaaaggacaauuugauagaucuaggaugccccaaaauuccauuauugggcaaaauggcuauuuacauuugcagaaugucgaaucaccccaaaacaaccauggcuuuccucuucugguucagcuuuggcuacguaauaacuuguauacuuugcaaggccaucuucuacuuguuaauaauuauuggaacacuagggaaaagguucaagcaguauagagaguuaaaaccucagaccugcaccauaugugagacaacuccuguaaaugcaauagaugcugagaugcacgaccucaauugcaguuacaacauuugucccuacugugcaucuagacuaaccucagaugggcuugcuaggcaugugacacaaugcccuaagcggaaggagaaaguggaagaaacugaacuguacuugaacuuagaaagaauuccuuggguuguaagaaagcuguugcagguaucagaguccacugguguggcauugaaaagaagcagcuggcugauugugcugcuugugcuguucacgguuucauugucaccaguucaaucagcacccauuggucacgggaagacaauugaggcauaccgggccagggagggauacacaaguauaugucucuuuguacuaggaaguauccuauucauagucucuugccuaaugaaagggcugguugacaguguuggcaacuccuucuucccuggacuguccauuugcaagacgugcuccauaagcagcauuaauggcuuugaaauugagucccauaagugcuauugcagcuuauucuguugccccuauuguaggcacugcucugcugauaaagaaauucauaagcugcacuugagcaucugcaaaaaaagaaaaacaggaaguaaugucauguuggcugucugcaagcgcauguguuucagggccaccauggaaguaaguaacagagcccuguuuauccguagcaucaucaacaccacuuuuguuuuguguauacugauacuagcaguuuguguuguuagcacgucagcaguggagauggaaaaccuaccagccgggaccugggaaagagaagaagaccuaacaaauuucugucaucaggaaugucagguuacagagacugaaugccucugcccuuaugaagcucuaguacucagaaagccucuauuccuagauaguauaguuaaaggcaugaaaaaucugcuaaacucaacaaguuuagaaacaaguuuaucaauugaggcaccauggggggcaauaaauguucagucaaccuacaaaccaacugugucaacugcaaacauagcacucaguuggagcucuguggaacacagaggcaauaagaucuugguuucaggcagaucagaaucaauuaugaagcuggaagaaaggacaggaaucagcugggaucucggcguagaagacgccucugagucuaaacugcuuacagucucugucauggacuugucucagauguacucuccugucuucgaguacuuaucaggagacagacagguggaagaguggcccaaagcaacuuguacaggugacugcccagaaagaugcggcugcacaucaucaacguguuugcacaaagaauggccccauucaagaaauuggagaugcaaucccacuuggugcugggguguagggacuggcugcaccuguuguggauuagaugugaaagaccuuuuuacagauuauauguuugucaaguggaaaguugaauauauuaagacagaggccauaguguguguagaacuuaccagucaggaaaggcaguguagcuugauugaagcgggcacaagguucaauuuagguccugugaccaucacacugucagaaccaagaaacauccaacagaagcucccuccugaaauaaucacacugcaucccaggaucgaagaagguuuuuuugacuugaugcauguacagaaaguguuaucggcaagcacaguauguaaguugcagaguugcacacaugguguaccaggagaccuacaggucuaccacaucggaaauuuauugaaaggggauaagguaaauggacaucuaauucauaaaauugagccacacuucaacacuuccuggauguccugggaugguugugaccuggacuacuacugcaacaugggagauuggccuucuugcacauacacaggagucacccaacacaaucaugcuucauuuguaaaccugcucaacauugagacugauuacacaaaaaacuuccacuuucacucuaaaagggucacugcacacggagacacaccacaacuagaucuuaaggcaagaccaaccuauggugcaggugagaucacuguacugguagaaguugcugacauggaguuacacacaaagaagauugaaauaucaggcuuaaaauuugcaagcuugacuugcacagguuguuaugcuuguagcucuggcaucucaugcaaaguuagaauucauguggaugaaccagaugaacuuacaguacauguuaaaagugaugauccagauguaguugcagcuagcucaagucucauggcaagaaagcuugaauuuggaacagacaguacauuuaaagcuuucucagccaugccuaaaacuucucuauguuucuacauuguugaaagagaacacuguaagagcugcagcgaagaagacacaaaaaaaugugucaacacaaaacuugagcaaccacaaagcauuuugaucgaacacaagggaacuauaaucggaaagcaaaacagcacuugcacagccaaggcgaguugcugguuagagucagucaaaaguuuuuuuuauggucuaaagaacaugcuuagugguauuuuuggcaauguuuuuauagguauuuucuuguuccuuggccccuucaucuuguuaauacuauucuuuauguuuggguggaggauccuauuuugcuuuaaauguuguagaagaacuagaggccugcucaaguauagacaccucaaggaagaugaagaaacugguuauagaaggauuauugaaagacuaaacaauaaaaaaggaaaaaacaaacugcuugauggugaaagacuugcugauagaagaauugccgaacuguucucuacaaaaacacacauuggc

SEQ ID NO: 3715 - RNA, 3495 nt, Artificial Sequence
  derived and/or modified CDS sequence (wt) from CCHVF(CCHVF ROS/HUVLV-100)__DQ206448.1__Gn-NSm-Gc
uccgaggagccaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauaccaucaacagggugaagucauucaagcuaugcgaaaacagcgccacagggaaaaccugugagauagacagcacuccgguuaagugcaggcaagguuuuuguuuaaaaaucacccaagagggaaggggccacguaaaauuaucuagaggcucagagguuguuuuggaugcuugcgacucaagcugcgaaguaaugauaccuaaaggcacuggagauauccugguggacuguucagguggacagcaacauuucuuaaaagacaacuuaauugaccuagggugcccccauaucccgcuauuggguaaaauggccauuuacaucugcagaaugucaaaucauccuagaacaacuauggcuuuucucuucugguucagcuuuggcuaugugaucaccuguauauuuugcaaggcucuuuuuuauucauugauaauuauugggacacuagggaaaaagaucaagcaauauagggaauugaaaccucaaacuuguaccauaugugagacagccccugucaaugcaauagacgcugaaaugcaugaccuuaacugcaguuacaauauaugcccuuauugugcaucaagauugaccuccgaugggcuagcuaggcaugugccacaaugccccaagcggaaggaaaaaguugaggagacugagcuguacuugaaccuggaaagaauuccuuggauugucagaaagcuauugcaagugucagaguccacugguguggcauugaaacgaagcagcuggcugauuguacugcuuguguuacucacaguuucauugucaccgguucaaucagcaccuguuggucaugguaagacaaucgaaacauaucagaccagagaaggauucacaaguaucugucucuuuauguuaggaagcauccuguuuuuagucucuugcuuggugaaggggcugguugacagugucagugacagcuucuuccccggccugucugucuguaagacaugcucuauuggcaguauaaauggcuuugaaauugaaucgcauaaaugcuacuguagccuauuuugcugccccuacuguaggcacugcucugcugacagagaaauucaucaguuacacuugaguaucugcaaaaaaagaaaaacggguagcaaugucaugcuggcugucugcaaacgcaugugcuuuagggcaaccauagaagcaagcagaagagccuugcucauccgaagcauuauaaauaccacuuuuguaauaugcauuuuaacauugacaaucuguguuguuagcaccucugcaguagagauggaaaaccuuccaucaggcacuugggagagagaggaagaccugacaaauuucugucaucaggaaugccagguaaccgagacggagugccucuguccauacgaagcucuugugcucagaaaaccucuguucuuagacaguauaguuaaaggcaugaagaauuugcuaaacucaacaagcuuagaaacaagccuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguagaagaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcuggggaguaggaacuggcugcaccugcugcgggguggauguaaaagaccuuuuuacagaucacauguuugucaaauggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacauugcaucccaaaguugaagagggcuucuuugacuugaugcaugugcaaaaagugcugucugcaaguacaguguguaaacugcagaguugcacacaugguauaccaggagaucuacaaguuuaccauauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacaucgaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcauaccaagaaaguugagauaucaggcuuaaaauuugcaagucuggcuugcacggguugcuaugcuuguagcucuggcaucuccuguaaagucaggauucauguagaugagccagaugagcucacaguacauguaaagagcagugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaaugauacuugcacagccaaggcaagcuguuggcuagagucagucaagaguuuuuuuuauggauugaaaaauaugcuugguaguguauuugguaauuuuuucauaggcauuuuguuauuccuugccccuuuuguccuguuggugcuuuucuuuauguuuggauggaaaaucuuguuuugcuucaaauguugcaggaggaccagaggcuuacuuaaguauagacuccucaaagacgaugaggaaacaggcuacagaaggauuauugaaagacugaacaacaaaaagggaaaaaacagacugcuugauggugaaagguuggcugauaggaaaauugcugagcuguucuccacaaaaacacacauuggu

SEQ ID NO: 3716 - RNA, 3495 nt, Artificial Sequence
  derived and/or modified CDS sequence (wt) from CCHVF(CCHVF AP92)__DQ211625.1__Gn-NSm-Gc
ucagaagggggugauggaggcugcaucucaagaacucaacugauaaaaacagaaacugcggaggugcacggagacgauuacgguggaccuggcgagaaaauuaccaucugcaaugguucaaccaucguugaucagagguuagguagugaacugggguguuacacaauuaacagaauaaaaucuuucaaacuaugcgagaauagugcccagggcaagaacugugagauagacagugcaccaguacaaugcaggcaagguuauugcuugaaaauuagucaagagggaagaggacaugugaaacuuuccagggguucagaaauuguucuagauguuugugacacaagcugugagauaaugauuccuaagggcacaggugacaucuuaguagacugcucaggagggcagcagcauuuucuacagagcaacuuaguugaccuggguuguccgaacauuccgcugcugggcaagauggcuauuuauauuugcagaaugucaaaucacccuaaaacaaccauggcuuuccuuuuuugguucagcuuuggcuacgugaucacuuguauauugugcaagacacuuuuuuacauacuuauaauuauugggacauuagggaaaaaauuaaagcaguacagagagcugaaaccccaaacauguaccauaugugaaucaguaccgguuaaugcaauagaugcugaaaugcaugaccucaacugcagcuacaacauaugcccuuauugugccuccagacucaccucagaggggcucacuagacaugugaaccagugccccaaaaggaaagagaagguagaagagacagaguuauaccugaaccuggaaaggauccccuggauuguuaggaagcuccuacagguaucugagucaacagguguggccuuaaaaagaagcagcuggaugaucgugcuccucauauuacugauagucucuaugucaccgguucaaucugcaccaauaagucaggagagaacaguugcccucuaucaauccagagaagauuauaugggcauuugccuugucauaauggggaguguucuucuggcagucuccuugcugguuagggggcugauugacagcauuagcaguaccuuuuuuccuggauuaucuguuugcaggacaugccauaucgguagcauaaaugguuuugagauugagucucauaagugcuacuguggccuacugugcuguccuuacuguagggcuugcucaacugaccaggaugcccaccaguuccaucuaagugucuguaagaagagaaaggcaggaagcaacgucauguuggcugucuguaagcguauguguuucaaggcaauuaucgaagccagcaacaagguccuauucaucagaaaugucauaaacacuacuuuuguuguaugcauacuugugaugguggccugcauagccaguucggccgcuguagagauggaaaaccuaccggcaggaaccugggaacgagaagaagagcucacaaacuucugucaucaagagugucaagugacagaaacugaaugccucuguccuuaugagucuuucauacuuaggaaaccacuuuuuuuggauagcauagcuaaagguguuaagaaccucuugaacucaacaagccuggaaacuagcuugucaauugaagcaccauggggggccaucaaugcccaaucaacuuacaaaccaacugcaucaagugcuaauauugcucuaacauggagcucaguggaacacaggggcaacaagaucuuggucucaggcaggucugaaucaauuaugaaacuugaagagaggaccggaauaagcuggaacuugggcguugaagaugcuucugagucaagaacacucaccaucuccgucauggaucuaucacagauguauuccccugucuuugaguaccugucaggagaucgucagguggaggaauggccaaaggcaaccugcacuggcaacugcccggagagaugcggcugcacaucgucaaccugccuuuacaaggaguggccacauucgagaaacuggagaugcaaccccaccugguguugggggguugggacuggcugcacaugcuguggacuagaugucaaagaacuguucacggaucacaugcuaguaaaauggaaaguugaguacaucaagacagaggccauaguguguguugagcuuaccagucaagaaaggcagugcaguuugauugaagcagguacgagauuuagcuuaggaccaguaacaaucaccuugucugagccaaggaacauucagcagaagcuuccuccugaauuaauuacauuacacccaaagauagaagacggcuacuuugacuuaaugcauguucaaaagguuauguccgccaguacagugugcaagcugcaaaguugcacacacggugugcccggggacuugcaaauuuaucauguuggcaaucuguugaagggggacagagugaaugggcaccugauccacaagguugagccacaccugaacacauccuggaugucgugggaugguugugacuuagacuauuucugcaauaugggggacuggcccuccugcacauacaccggggugacacaacacaaucaugccgcauuugcaaaucugcuuaacauugaaaccgacuauacaaagacuuuccauuuccacuccaaaagagugacggcccauggagacacaccacagcuggacuugaaggcaaggccuagguauggugcaggugaaaucacuguucugguugaaguagcugauauggaguuacauacaaagaaggucgagguaacaggcuuaaaauuugcaagccuaacuuguucaggaugcuaugccuguaguucagguaucuccugcaagguuagaauacauguggacgagccagaugagcucacagugcaugugaaaagcagcgacccagacauuguggcagccagcucaagucucauggcaaggaagauugaguuugggguugacaguacuuucaaagcguucuccucuaugccuaaagauucucugugcuuuuauauugucgaaagagacuauugcaacagcugcaaaaaugaggaaacacagaggugugugaacgcaaagcuugaacagccacagagcauccucaucgaacauacagguacaaucauuggcaagcagaacgacaccuguggaucuaggacaagcugcuggcuagacucauuuaaaaguuucuuuuauggacuaaagagcauguugagcggcauuuuugguaaugucuuucuaggcaucuucuuguuucuugcccccuuugcucugcugcuguuuuucuuuuucuuuggauggagaauccuguuuugcuuuaagugcuguagaagaaccagaggccuguuuaaauacagacacaucaaggacgaugaagagguuggcuacaaaaaaaucaucgaaagacugaacaauaaaaaaggcaaacacagacuucuugacggcgagagacuugcagauaggaagaucgcugaacuuuucucaacuaagacacacauugga

SEQ ID NO: 3717 - RNA, 3495 nt, Artificial Sequence
  derived and/or modified CDS sequence (wt) from CCHVF(CCHVF ArD8194)__DQ211626.1__Gn-NSm-Gc
gcagagggggggagcaaugauuguguuucaagaacccagcuagucaaaacagagguugcagaaauucaugaagacaguuacggugguccuggcgaaaaaaucacaauuugcaacggcuccacaauaguggaucaaaggcuuggcagcgaauuagguugcuauacaauaaacagagugagaaccuauaagcucugugagaacagugccacagaaaagagcugugaaauagacaguguuccaguuaaaugcaaacagggguucugccucaaaauaacucaggaagguaggggccaugugaaauugucuagagggacagaaaucguuuuggaugucugugauacuagcugugaacugaugauacccaaaggcacuggggauauauugguggacugcucaggagggcagcaacacuuuuuacaggacaaucuaauugacuugggaugcccaaauauuccauugcuaggucgaacagcuauauauguuuguagaaugucaaaccaucccaagacaaccauggcuuuucuguuuugguucaguuuuggcuaugucaucacauguguagugugcaaggugcucuucuauuugcuaauugucaucgggacacuaggaaaaaggcugaaacaguacagagagcuaaagccucaaacauguauugucugugaaucuaucccugucaaugcaauagaugcugaaaugcacgaucuuaacugcaacuacaacauaugcccuuacugugcauccagacugaccucagauggucucgucaggcacguaacucaaugucccaaacggaaagagaaggucgaagaaacugaacuauacuuaaaccuggagagaauaccuugguuggugagaaaacuccuacaagugucggagucaacaggaguggcucuaaagagaagcugcuggaugaucacacuccuuauucugcugacuguuucaaugucaccaguucaguccgcaccaguaggccacaaaagggcaguugaagucuaucaaaugagagaaagcuauacagguauuugccucuucguguuaggaaguguucucuucgcagucucuuggcuggugaaggcccugauugauagcaucggcaauaguuucuucccggggcuuuccauaugcaagacauguuccauugguagcauaaauggauuugaaauagagucacacaaaugcuacugcagucuauuuugcuguccuuacuguagggccugcucaucggacaaaaucacucaccgaaugcauuugaaugugugcaaaaagagaaagguggguaguaauguuaugcuagccguuugcaagcgcauguguuuuaaagcaacuauugaagcaagcaacagggcuacuuucaucagaaacaucauaaacuccacuuuugucauaugcauacuaauccuggugaucugugugguuaguaccucugcugucgacauggaaaauuuaccggcaggcaucugggaaaaagaggaagaccuaacaaacuucugucaucaggagugucaaguaacagaaacugaaugccuuugcccauaugaggccuuaaugcuuagaaaaccacuuuucuuagauagaauagccaagggaaugaaaagcuuguugaacuccacaaguuuagaaacgagcuugucaauugaagcuccauggggggcaaucaauguucaaucaacuuucaaaccaacaguuucagccgccaauauagcacuuagcuggaguucaguugaacacaagggcaacaagaucuuaguuucaggcagaucagagucaauuaugaaauuagaagaaagaacuggaaucagcuggugucuagguguggaagaugccucugagucaaaaacacucaccguuucuguuauggaucugucucaaauguauucuccuguuuucgaguaccugucaggugaccgacagguggaggaguggccaaaagcaaccugcacaggugacuguccagaaagauguggcugcacuucaucaaccugccugcauaaggaguggccgcacucgaggaacuggcgcuguaaccccacuugguguuggggggugggaacuggcugcaccugcugugggcuagauguaaaggaucucuucacagacuacauguugguuaaauggaaaguggaauauauaaaaacagaagccauaauauguguugagcuuacuagucaagagaggcaguguaguuuaauugaagcaggcacaagguuuaaccuaggcccugugacaauaacucuaucagaaccaaggaacguacagcagaggcuuccucccgagaucaucacacugcacccuaaaauagaagaaggguuuuuugauuugaugcauguacagaagguaaugucugcaagcacgguuuguaagcugcaaagcuguacucauggugugccuggagacuuacaagucuaccauguuggcaacuuguuaaagggggacaaagucaaugggcacucaauccacaagauagaaucacaccucaacaccucauggaugucaugggaugggugugauuuagacuauuuuugcaacaugggggacuggcccucaugcacauacacaggggugacacaacacaaccaugcugcauucaucaacaugcuuaacauugagacugauuacacaaaaaccuuucacuuucauucaaaaagggucacagcacacggagacaccccucaguuggaccuaaaagcgagaccagcauauggugcaggcgaaaucacuguucuaguagaaguugcagauuuagaacugcacacgaagaaaauugaagugucgggucugaaauucgcaaguuugucaugcuccggauguuaugcuugcagcucuggcaucuccugcaaaguuaggauucauguaaaugaaccggaugaauucacaguacauguaaaaaguaaugacccagauguuguagcagcaggaucaagucucauggcuagaaagauagagucuggggccgacagcacguuuaaggcuuuuucaucaaugccaaaaaacucucuauguuuuuacauaguagaaagagauuauuguagcagcuguacagaugaugacacucagaaauguguugacauuaaacuugaacauccacagagcauacucauugaacacaaaggaacgauuauuggcaagcagaaugacaccuguccaacuaaaacaagcugcugguuggaaucuauuaagaguuuuuuuuaugggcuuaaaaacaugcugagugggaucuucgguaauguuuucuuaggcaugcuccuguuucuugcuccuuuuauauugcuaauauuguuuuucuucuucggguggagacuucucuuuugccuuaagugcuguagaaggaccagaaagcugcuaaaguauaagcaccuuagggacgaagaagagagugguuacaaaaaaaucauugaaaggcuaaaugacaaaaaaggcaaaagucgauuguuugauggagaaaggcuugcagacagaaagauugccgaacucuuuucaacuaaaacucauauaggu

SEQ ID NO: 3718 - RNA, 3495 nt, Artificial Sequence
  derived and/or modified CDS sequence (wt) from CCHVF(CCHVF ArD15786)__DQ211627.1__Gn-NSm-Gc
gcagagggggggagcaaugacuguguuucaagaacccagcuagucaaaacagagguuacagaaauucaugaagacaguuacggugguccuggcgaaaaaaucacaauuugcaacggcuccacaauaguggaucaaaggcuuggcagcgaauuagguugcuauacaauaaacagagugagaaccuauaagcucugugagaacagugccacagaaaagagcugugaaauagacaguguuccaguuaaaugcaaacagggguucugccucaaaauaacucaggaagguaggggucaugugaaauugucuagagggacagaaaucguucuggaugucugugauacuagcugugaacugaugauacccaaaggcacuggggauauauugguggacugcucaggagggcagcaacacuuuuuacaggacaaucuaauugacuugggaugcccaaauauuccauugcuaggucaaacggcuauauaugucuguagaaugucaaaccaucccaagacaaccauggcuuuucuguuuugguucaguuuuggcuaugucaucacauguguagugugcaaggugcucuucuauuugcuaauugucaucgggacacuaggaaaaaggcugaaacaguacagagagcuaaagccucaaacauguauugucugugaaucuaucccugucaaugcaauagaugcugaaaugcaugaucuuaacugcaacuacaacauaugcccuuacugugcauccagacugaccucagauggccucgucaggcacguaacucaaugucccaaacggaaagagaaggucgaagaaacugaacuauacuuaaacuuggagagaauaccuugguugguaagaaagcuccuacaagugucggagucaacaggaguggcucugaagagaagcugcuggauaaucacacuccuuauucugcugacuguuucaaugucaccaguucaguccgcaccgguaggccacaaaagggcaguugaagucuaucaaauaagagaaagcuauacagguauuugccucuucguguuaggagguguucucuucgcagucucuuggcuggugaaggcccugauugauagcaucggcaauaguuucuucccugggcuuuccauaugcaagacguguuccauugguagcauaaauggauuugaaauagagucacacaaaugcuacugcagucuacucugcuguccuuacuguagggccugcucaucggacaaaaucacucaccgaaugcauuugaaugugugcaaaaagagaaagguggguaguaauguuaugcuagccguuugcaaacgcauguguuuuaaagcaacuauugaagcaaacaacagggcuacuuucaucagaaacaucauaaacuccacuuuugucauaugcauacuaauccuggugaucuguguaguuaguaccucugcugucgacauggaaaauuuaccggcaggcaucugggaaaaagaggaagaccuaacaaacuucugucaucaggagugucaaguaacagaaacugaaugccuuugcccauaugaggccuuaaugcuuagaaagccacuuuccuuagauaguauagccaagggaaugaaaagcuuguugaacuccacaaguuuagaaacgagcuugucaauugaagcuccauggggggcaaucaauguucaaucaaccuucaaaccaacaauuucagccgccaacauagcacuuagcuggaguucaguugaacacaagggcaacaagaucuuaguuucaggcagaucagagucaauuaugaaauuagaagaaagaacuggaaucagcuggugucuagguguggaagaugcuucugaaucaaaaacacucacuguuucuguuauggaucugucucaaauguauucuccuguuuucgaguaccugucaggugaccgacagguggaggaguggccaaaagcaaccugcacaggugacuguccagaaagauguggcugcacuucaucaaccugccuacauaaggaguggccgcacucgaggaacuggcgcuguaaccccacuugguguuggggggugggaaccggcugcaccugcugugggcuagauguaaaggaucucuucacagacuacauguugguuaaauggaaaguggaauauauaaaaacagaagccauaauauguguugagcuuacuagucaagagaggcaguguaguuuaauugaagcaggcacaagguuuaaccuaggcccugugacaauaacucuaucagaaccaaggaacguacagcagaggcuuccccccgagaucauuacacugcacccuaaaauagaagaaggguuuuuugauuugaugcaugugcagaagguaaugucugcaagcacgguuuguaagcugcaaagcuguacucacggugugccuggagacuuacaagucuaccauguuggcaacuuguuaaagggggacaaagucaaugggcacucaauccacaagauagaaucgcaccucaacaccucauggaugucaugggaugggugugauuuagauuauuuuugcaacaugggggacuggcccucaugcacauacacaggggugacacaacacaaccgugcugcauucaucaacaugcuuaacauugagacugauuacacaaaaacuuuucacuuucauucaaaaagggucacagcacacggagacaccccucaguuggaccuaaaagcgaggccaacauauggugcaggcgaaaucacuguucuaguggaaguugcagauuuagaacuacacacgaagaaaauugaagugucgggucugaaauucgcaaguuugacaugcucuggauguuaugcuugcagcucuggcaucuccugcaaaguuaggauucauguaaaugaaccggaugaauucacaguacauguaaaaagcaaugacccagauguuguagcagcaggaucaagucucauggcuagaaagauagagucuggggccgacagcacguuuaaggcuuuuucaucaaugccaaaaaacucucuauguuuuuacauaguagaaagagauuauuguagcagcuguacagaugaugacacucaaaaaugcguugacauaaaacuugaacauccacaaagcauacuuauugaacacaaaggaacgauuauuggcaagcaaaaugacaccuguccaacuaaaacaagcugcugguuggaaucuaucaagaguuucuuuuaugggcuuaaaaauaugcugagugggaucuucgguaauauuuucuuaggcaugcuccuguuucuugcuccuuuuguauugcuaauauuguuuuucuucuucggguggagacuucucuuuugccuuaagugcuguagaaggacuagaaagcugcuaaaguauaagcaccuuagggacgaagaagagagugguuacaaaaaaaucauugaaaggcuaaaugacaagaagggcaaaagucgauuguuugauggagaaaggcuugcagacagaaagauugccgaacucuuuucaacuaaaacucauguaggu

SEQ ID NO: 3719 - RNA, 3495 nt, Artificial Sequence
  derived and/or modified CDS sequence (wt) from CCHVF(CCHVF ArD39554)__DQ211628.1__Gn-NSm-Gc
ucagaaagcaacaacaaugauugcguaucaaggacucagcugaucaagacagaaaaugcugaaauacauggugaugacuauggcgggcccggagagaaaauaaccaucugcaacggcucuacuauuguagaacaaagauuaggcagcgaauuaggaugcuacacuaucaacagaauaaaguccuucaaacuaugcgaaaauagugcuucaggaaaggguugugaaauugacaguacuccaguaaaauguaagcaaggcuucuguuugaaaauaacccaagaaggaaggggucauguuaaacuuuccagaggcucagagauaauucuagacguuugcgacucaagcugugaaaugaugauaccaaaagggucuggugauauccugguagauugcucuggaggacagcagcacuuccuacaggacaacuuggucgacuuaggaugcccaaacguuccccuacugggcaaaauggccauauacaucugcagaaugucaaaccaccccaagacaaccauggccuuccucuuuugguucagcuuuggcuaugucauaaccugcaucuuuugcaagguuaucuuuuaugugcuaauaauaauuggaacauuaggaaaaaggaucaaacaguacagagagcuuaagccucagaccugcacuauaugugaagcaacuccuguuaaugcaauagaugcugaaaugcaugaucuuaacuguagcuacaacauaugcccuuauugcgcaucuagauuaacuucagaaggucugguuaggcaugugacucaguguccuaagaggaaggaaaagauagaggaaacagagcuguacuuaaauuuggaaaggauacccugguuugucagaaagcucuugcagguaucagaaucaacagggguagcgcucaagagaagcagcuggcuggugacacuucuuguguugcuaacaguaucuuugucgccugugcaaucagcacccauuggucaggaaagaacgguaguaacguaccaagucagagaaaguuacacaggcaugugucuuuucauccuagguaguguccuuuuugcaaucuccugguugacaaagggacugguagacaguguugguaacauuuucuuuccuggacuuucaguuuguaaaacauguuccaucggcagcauaaauggcuuugaaauugaaucccacaaaugcuauuguagccuuuucugcugcccuuacuguagauacugcucggccgacagaggugcucaccagucucauuugaguguuuguaaaaagaggaaaacuggaagcaaugucauguuagcugucugcaagcgcauguguuuuagagcuacuuuaaaggugagcagugaggcuuugauuaucaggagcauuauaaacacuacuuuuguugugugcauucuaauauuaguugucuguguuguuagcaccucagccguagagauggagaacuugccagcagguacuugggagaaggaagaggaccuaacaaacuucugucaccaagaaugucagguaacagaaaccgaaugccucuguccauacgaggcuuuugugcuuagaaagccacuuuuuuuggacaguacugccaagagcaugaaaagccuguuaaauucaacaaguuuggaaacaagccugucaauugaagcacccuggggggcaauuaauguacagucaacuuucaaacccaccgcuucgacugcaaauauagcgcucaguuggagcucaguagaacacagaggcaauaagauucuuguuacagguagaucagagucgauuaugaaacuggaagaaagaacaggaaucaguuggaaucucgguguggaagaugcuucugaaucaaagacacucacuguaucagucauggacuuaucucagauguauuccacugucuucgaguacuuaucaggcgaccggcaaguagaggaguggccuaaagcaaccugcacaggugauuguccagaaagauguggcuguacaucaucuacuugccuccacaaggcguggccccauucaaggaacuggaggugcaaccccacgugguguuggggaguuggaacugguugcacuugcuguggauuggaugugaaaaaccucuuuacugacuauaugcuuaucaaauggaaaguugaauuuauaaaaacugaagccauaguguguguugaacucacaagccaggaaaggcaaugcagucuuauagaagcaggcacaagauuuaacuugggcccuguuaccaucacuuuaucagaaccaagaaacauucagcagaagcucccuccugaacugguuacgcugcauccaagaguagaagaaggcuucuucgaccuuaugcaugugcagaaagugcuuucugcaagcacuguguguaaauugcagagcugcacgcaugguguaccaggugacuugcaaguguaucauguaggcaacuugcugaaaggggauaaaauaaauggcaacucauuucacaaaauugagccgaaccuaaauacaucauggaugucuugggacggcugugaucuugauuacuacugcaacaugggagacuggcccuccuguacuuacacaggugugacgcagcacaaccaugcugcuuuugugaaccugcucaacauugaaacugacuauacaaagaacuuccacuuucacucaaagagagucacagcacauggagagacgccccagcuagaccuuaaagccagaccaaaguauggagcaggugaggucacaguccugguggaaguugcugacauggagcugcacacuaaaaagauugagauaucagguuugaaauuugcuagccugaccugcacgggcugcuaugcuuguagcucagguaucuccugcaagguuaggcuucauguagaugagccagaugagcucacgguacacgugaagagugaugauccggauguaguugcagccagcucaagccugauggccagaaaaauugaauuuggaacugauagcacauuuaaagcuuucucguccaugccuaaggauaaacucugcuuuuacauuguggaaagagacuacugcagcaguugcagcaaagaggacacacaaaaguguguaaaugcaaaacuugagcagccucagaguauacuuauugaacauaaaggcaccauaauugggaagcaaaaugacacuuguacagucaaggcgagcuguugguuggaaucgguaaaaaguuuuuuuuauggacuaaaaaacauguugggugguaucuucggcaacguuaucuugggcaucaucauguuccuugcuccuuuugccuuguuacugcucuucuuccuuuucggauggagaauucuguucugccuuagaugcugcagaaggacuagggggcuauuuaaguacaaacacaucaaagaugaugaagaaucaggcuacaaaaggauuauugaaagguuaaauaacaagaaagguaagaacaaguuauuugacggcgagagauuggcagacaagaaaauugcugaacuauucucaacgaagacacacauuggc

SEQ ID NO: 3720 - RNA, 3495 nt, Artificial Sequence
  derived and/or modified CDS sequence (wt) from CCHVF(CCHVF C-68031)__DQ211629.1__Gn-NSm-Gc
uccgaagagucuggugaugacugcauaucaagaacucagcuaucgaggacagagacugcggaaauucacagugauaacuauggugguccaggugacaagauaaccaucugcaaugguucaacuauuguagaucagagauugggcagugaacuaggguguuacacuaucaauagaguaaagucauuuaagcuuugcgagaacagugccacagguaaauccugugaaauagauagcaccccaauuaaaugcaggcaggguuuuuguuuaaaaauuacucaggagggaaggggccacgugaagcuaucaagagguucagaaguugucuuggacgccugugauucaagcugugagauaaugauaccaaagggcacuggagacauccuaguugacuguucagguggacagcaacauuucuuaaaagauaacuugauugaucugggaugcccaaacaucccacuauuagguaagauggcuaucuacauuuguagaaugucaaaucauccuaaaacgacuauggcuuuucuuuuuugguuuagcuuugguuaugugauaaccuguauacucuguaaggucaucuucuaccuauuaauaguuguggggacguugggaaaaaaguucaaacaguauagagaguugaaaccucagaccuguaccauaugcgaaacaacuccuguuaaugcaauagaugcugaaaugcacgaccucaacugcaguuacaauauauguccuuacugugcaucuagguuaaccucagacggucuugccagacauguaaugcagugcccuaagcggaaggaaaaaguagaagaaaccgaauuauacuuaaacuuagaaagaauccccuggguuguuaggaaauuacugcaggugucagaauccaccgguguggcacuaaagaggaguaguuggcugguugugcuacuuguguuacuuacaguuucauugucaccaguacaaucagcaccuaucggccauggaaagacaguugaaacauaucaaaccagagaaggguacacaagcauuugccuuuuuguacuaggaagcaucuuauuuauagucucuugccuaaugaagggguugguugacaguguugguaacaguuuuuucccugguuuguccauuuguaagacauguucuauuggcagcauaaauggcuuugagacugaaucucacaaauguuacuguagccuauuuuguugccccuacuguagacacugcucugccgauagagaaauacauaaguugcacuugagcaucugcaagaaaaggaagacugggaguaaugucauguuggccgucuguaagcgcaugugcuuuagggcaacuguggaaguaagcaacaaggcucuacuuauccgaaacaucaucaauaccacuuuuguugugugcauacugauauuagcaguuuguguugucagcaccuccgcaguggagauggaaagccugccagcuggcacuugggagagagaggaagaucugacaaauuucugucaucaagaaugccaagucacugagacugaaugccucuguccuuacgaagcucuugugcucaggaaacccuuguuuucagacaguauugucaaaggcaugaagaacuugcuaaauucaacaagcuuagaaacaagcuuaucaauugaggcaccauggggagcuauaaauguccaaucaaccuucaaaccuacuguguccgcugcgaacauagcucuuaguuggagcucaguggaacacagggguaauaagauuuugguuucagguagaucagagucaauuaugaagcuagaggaaaggacaggaaucagcugggaucuagggguagaagaugccucugagucuaaauugcuuacugucucuauuauggacuugucacagauguauucuccugucuuugaguaccuaucaggugauagacaaguggaggaauggcccaaggcaaccugcacaggagauugcccagaaagauguggcugcacaucaucaaccugccuacacaaagaauggccccauucaagaaacuggagaugcaaccccaccugguguuggggagucggcacuggauguaccugcugugggcuggauguaaaagaccuuuuuacagauuacauguuugucaaguggaaaguugaguacauuaaaacagaagcuauaguguguguugagcuuacuagccaagagagacaauguagcuugauugaggcaggcacaagauucaacuuagguccugugaccaucacauugucagagccaagaaacauucagcaaaagcucccuccagagauaguuacauugcaucccagaauugaagaagguuucuuugauuuaaugcauguaaaaaaagugcuaucagcaaguacaguauguaagcuacagaguugcacacauggugugccaggggaccuacaggucuaccacauaggaaacuuguuaaaaggagacaaggugaaugggcaccugauucacaaaauugaaccacacuucaacacuuccuggaugucuugggacggcugugaccuagacuacuacuguaauaugggggacuggccaucuugcucauauacuggaguaacccagcacaaucaugcugcauuuguaaacaugcucaacaucgaaacugauuauacaaaaaucuuccacuuucacucuaagagaguuacugcacauggagacacaccacaauuagauuugaaagcuagaccaacuuauggugcaggugaaaucacugugcuaguggaaguugcugacauggaguuacacacaaagaaaauugagauaucagguuuaaaguuugcaagcuuaacuugcacaggcuguuaugcuuguagcucugguaucuccuguaagguuagaauccauguagaugagccugaugagcuuacaguacaugugaagagugaagacccagacauaguugcugcuagcucaagucucauggcuagaaaacuugaauuugggacagauagcacauucaaagccuuuucagccaugcccaaaaccuccuugugcuuuuacauuguggagagagaauauuguaaaagcugcaguaaagaagauacacaaaaaugugucaacacaaagcuugagcaaccacagagcauuuuaauugagcacaaaggaacgauaauugguaagcaaaacgacaccugcacaucuaaagcaggcuguuggcuagagucagucaagagcuucuuuuaugggcuaaaaaacaugcuuaguggcauuuuuggcaauguuuucauagggauuuucuuauuccuugcuccuuuuauccuuuuaauacuuuucuuuauguuuggauggagaauccuguucugcuuuaaauguugcagaagaacuagaggccuauuuaaguacagacaccucaaggacgaugaagaaaccgguuacaggaaaaucauugagaggcugaacaacaaaaaagggaaaaacaaacugcuugauggugaaagauuagcugauaggaagauugcugagcuguucuccacaaagacacacauuggc

SEQ ID NO: 3721 - RNA, 3495 nt, Artificial Sequence
  derived and/or modified CDS sequence (wt) from CCHVF(CCHVF Drosdov)__DQ211630.1__Gn-NSm-Gc
ucugaagagccaggugacgacugcauaucaagaacucagcuauugaagacagaaacagcagagauccaugacgacaacuauggugguccaggugacaaaauaacuaucugcaaugguucaaccauuguggaucagagacugggcagugaacuaggguguuauaccaucaacagggugaagucauucaagcuaugcgaaaacagugccacagggaaaaccugugagauagacagcacuccggucaagugcaggcaagguuuuuguuugaaaaucacccaagagggaaggggccacguaaaauuauccaggggcucagagguuguuuuggaugcuugcgacucgagcugugaaguaaugauaccuaaaggcacuggagauauccuaguagacuguucagguggacagcagcauuucuuaaaagacaacuugauugaccuagggugcccucauaucccgcuauuggguaagauggccauuuacauuugcagaaugucaaaucaucccaggacaaccauggcuuuccucuucugguucaguuuuggcuauguaaucaccuguauauuuugcaaggcucuuuuuuacucauugauaauuauugggacacuagggaaaaaaaucaagcaauauagggagcugaaaccucaaacuugcaccauaugugagacagcuccugucaaugcaauagaugcugaaaugcaugaccucaaauguaguuacaauauaugcccuuauugugcaucaagauugaccucugaugggcuagcuaggcaugugacacaaugcccuaagcgaaaggagaaaguugaggagacugaacuguacuugaaccuggaaagaauuccuuggauagucagaaagcuauugcaagugucagaguccacugguguagcauugaaacgaagcaguuggcugauugugcugcuuguguuacucacagucucauugucaccgguucaaucagcaccuguuggucaugguaagacaauugaaacauaucagaccagagaaggauucacaaguaucugucucuuuauguuaggaagcauccuauucauagucucuugccuaguaaaggggcugguugacagugucagugacagcuucuuccccggccugucugucuguaagacaugcucuauuggcaguauaaauggcuuugaaauugaaucgcauaaaugcuacuguaguuuauuuugcugccccuacuguaggcacuacucugcugacagagaaauucaccaguugcacuugaguaucugcaaaaaaaggaaaacggggagcaaugucaugcuggcugucugcaaacgcaugugcuuuaaggcaacuauagaagcaagcagaagagcccugcucauccgaaguauuaucaacaccacuuuuguaauauguauucuaauauuagcaaucuguguuguuagcaccucugcaguagagauggaaaaccuuccagcaggcacuugggagagagaggaagaccugacaaauuucugccaccaggaaugccaggugaccgagacggaaugccucuguccauacgaagcucuugugcucaggaaaccucuuuucuuagacaguacaguuaaagguaugaaaaauuugcuaaacucaacaagcuuggaaacaagcuuaucaauugaggcaccauggggagcaauaaauguccagucaaccuuuaaaccaacaguaucgacugcaaacauagcacucaguuggagcucaguggagcacagaggcaacaagaucuuggucacaggcaggucugaaucaauuaugaaacuagaggaaaggacaggagucagcugggaucuaggcguagaagaugccucugaauccaaauuacuuaccgucuccaucauggauuugucacaaauguauuccccuguuuuugaguacuuaucaggagauagacagguugaagaauggcccaaggcaaccuguacaggugauugcccagaaagguguggcugcacaucaucaaccugcuugcauaaagaauggccucacucaagaaacuggagauguaaccccacuuggugcuggggaguaggaaccggcugcacaugcugcggaguggauguaaaagaccuuuuuacagaucacauguuugucaaauggaagguugaauauaugaaaaccgaagccauaguauguguugagcucaccagccaagaaagacagugcagucugauugaggcagguacuagauucaacuuggguccugugacuaucacccugucugagccaagaaacauucagcagaagcuucccccugagaucauuacgcugcaucccaaaauugaagaaggcuucuuugacuugaugcauguacaaaaaguguuaucugcaaguacaguguguaaacugcagaguugcacacaugguauaccaggagaucuacaaauuuaccacauuggcaacuuguugaaaggggauagaguaaacgggcaucuaauucacaaaauugaaccacauuuuaacaccucuuggauguccugggaugguugugaccuagacuacuauugcaacauggggaauuggccuucuugcacauacacaggagugacccaacauaaucaugcugcauuuguaaauuugcuuaacauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaagaaaguugagauaucaggcuugaaauuugcaagucugguuugcacggguugcuaugcuuguagcucuggcauuuccuguaaagucagaauucauguagaugaaccagaugagcucacagugcauguaaagagcagugauccagaugugguugcagcuagcacaagccuuauggcaaggaagcuugaauuugggacagauagcauauucaaggcauuuucagcuaugcccaaaaccucuuuaugcuuuuacauuguggagagggaauacugcaagagcugcagugaagaugauacaaaaaaauguguugacacaaaacuugagcagccacagagcauacuaauugagcacaaagggacgauaauuggaaagcagaaugauacuugcacagccaaggcaaguuguuggcuagagucagucaagaguuuuuuuuauggauugaagaauaugcuuggcaguguuuuugguaauuuuuucguaggcauuuuguuauuccuugccccuuuugucuuguuggugcuuuucuuuauguuuggauggaaaaucuuguuuugcuuuaaguguugcaggaggaccagaggcuuguuuaaguauagacaccucaaagacgaugaggaaacaggcuacagaaggauuauugaaagacugaauaguaaaaaaggaaaaaacagacugcuugauggugagagguuggcugauaggaaaauugcugagcuguucuccacaaaaacacacauuggc

SEQ ID NO: 3722 - RNA, 3495 nt, Artificial Sequence
  derived and/or modified CDS sequence (wt) from CCHVF(CCHVF Kashmanov)__DQ211631.1__Gn-NSm-Gc
uccgaggagccaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauaccaucaacagggugaagucauucaagcuaugcgaaaacagcgccacagggaaaaccugugagauagacagcacuccgguuaagugcaggcaagguuuuuguuuaaaaaucacccaagagggaaggggccacguaaaauuaucuagaggcucagagguuguuuuggaugcuugcgacucaagcugcgaaguaaugauaccuaaaggcacuggagauauccugguggacuguucagguggacagcaacauuucuuaaaagacaacuuaauugaccuagggugcccccauaucccgcuauuggguaaaauggccauuuacaucugcagaaugucaaaucauccuagaacaacuauggcuuuucucuucugguucagcuuuggcuaugugaucaccuguauauuuugcaaggcucuuuuuuauucauugauaauuauugggacacuagggaaaaagaucaagcaauauagggaauugaaaccucaaacuuguacuauaugugagacagcuccugucaaugcaauagacgcugaaaugcaugaccuuaacugcaguuacaauauaugcccuuauugugcaucaagauugaccuccgaugggcuagcuaggcaugugccacaaugccccaagcggaaggaaaaaguugaggagacugagcuguacuugaaccuggaaagaauuccuuggauugucagaaagcuauugcaagugucagaguccacugguguggcauugaaacgaagcagcuggcugauuguacugcuuguguuacucacaguuucauugucaccgguucaaucagcaccuguuggucaugguaagacaaucgaaacauaucagaccagagaaggauucacaaguaucugucucuuuauguuaggaagcauccuguuuuuagucucuugcuuggugaaggggcugguugacagugucagugacagcuucuuccccggccugucugucuguaagacaugcacuauuggcaguauaaauggcuuugaaauugaaucgcauaaaugcuacuguagccuauuuugcugccccuacuguaggcacugcucugcugacagagaaauucaccaguuacacuugaguaucugcaaaaaaagaaaaacggguagcaaugucaugcuggcugucugcaaacgcaugugcuuuagggcaaccauagaagcaagcagaagagcccugcucauccgaagcauuauaaauaccacuuuuguaauaugcauuuuaacauugacaaucuguguuguuagcaccucugcaguagagauggaaaaccuuccaucaggcacuugggagagagaggaagaccugacaaauuucugucaucaggaaugccagguaaccgagacggagugccucuguccauacgaagcucuugugcucagaaaaccucuguucuuagacaguauaguuaaaggcaugaagaauucgcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguagaagaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcuggggaguaggaacuggcugcaccugcugcgggguggauguaaaagaccuuuuuacagaucacauguuugucaaauggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcaugugcaaaaaguguugucugcaaguacaguguguaaacugcagaguugcacacaugguauaccaggagaucuacaaguuuaccacauuggcaacuugcugaaaggggauaggauaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacauugaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcauaccaagaaaguugagauaucaggcuugaaauuugcaagucuggcuugcacggguugcuaugcuuguagcucuggcaucuccuguaaagucaggauucauguagaugagccagaugagcucacaguacauguaaagagcagugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaaugauacuugcacagccaaggcaagcuguuggcuagagucagucaagaguuuuuuuuauggauugaaaaauaugcuugguaguguauuugguaacuuuuucauaggcauuuuguuauuccuugccccuuuuguccuguuggugcuuuucuuuauguuuggauggaaaaucuuguuuugcuucaaauguugcaggaggaccagaggcuuacuuaaguauagacaccucaaagacgaugaggaaacaggcuacagaaggauuauugaaagacugaacaacaaaaaaggaaaaaacagacugcuugauggugaaagguuggcugauaggaaaauugcugagcuguucuccacaaaaacacacauuggu

SEQ ID NO: 3723 - RNA, 3495 nt, Artificial Sequence
  derived and/or modified CDS sequence (wt) from CCHVF(CCHVF Oman)__DQ211632.1__Gn-NSm-Gc
uccgaagagucuggugaagacuguauaucaaggacucagcuauugaggacagaaacugcagaaauccauggugauaacuauggugguccaggugacaaaauaaccaucugcaaugguucaaccauuguagaucaaaggcuggguagugaacugggguguuacacuaucaauagggugaagucauuuaagcuaugcgaaaacagugccacagguaaguccugugaaauagauaacacuccaguaaaaugcaagcaagguuuuugcuugaaaauaacccaagaaggaaggggccacgugaagcuuucaagagacucagaaguuguccuggacgccugcgauucaagcugugaaauaaugauaccaaagggcacuggagacauccugguugacugcucaggugggcagcagcacuucuuaaaagacaaccugauugaucugggaugccccaacaucccauuauuaggcaaaauggcaaucuacauuuguagaaugucaaaucauccuaaaacaacuauggcuuuucuuuuuugguuuagcuuugguuaugugauaaccugcauacuuuguaaagucauuuuuuaucuauugauaguuguuggaacuuuagggaaaaaguuuaaacaguauagagaguuaaaaccucagaccugcacaauaugugaaacaacuccugucaaugcaauagaugcugagaugcacgaucucaauuguaguuacaauauauguccuuauugugcaucuagguuaacuucagauggucuugccagacauguaaugcaguguccuaagcggaaggaaaaaauagaagaaaccgaauuauaccugaacuuagaaagaaucccuuggguugucagaaaacuacugcaggugucagaauccacugguguagcacuaaagaggagcaguuggcugauugugcuacuugugcuucucacaguuucauugucaccaguacaaucagcaccuaucggucaugggaagaccauagaaacguaucaaacuagagaaggguacacaaguauuugucuuuuugugcuaggaagcauuuuguuuauaguuucucaccuaaugaaggggcugguugacaguguugguaacaguuuuuuuccuggguuaucuaucugcaagacaugcucuauuggcaguauaaauggcuuugaaauugaaucucacaaauguuucuguagccuauuuuguugccccuacuguagacacugcucugccgauaaagaaauccauaaguugcauuugagcaucugcaaaaaaagaaaagcugggaguaaugucauguuggccgucuguaagcgcauguguuuuagggcaacuauggaagugagcaacaaggcucuacucauccgaagugucaucaacacuacuuuuguuguaugcauacuaauauuagcaguuuguguuguuagcaccucugcaguagagauggaaagccugccagcuggcacuugggagagagaggaagaccuaacaaacuucugccaucaagaaugccaggucacugaaacugaaugucucugucccuaugaagcucuuguacucagaaagcccuuauuuuuagacaguauugcuaagggcaugaagaaccugcugaauucaacaagcuuagaaacaagcuuaucaauugaggcaccauggggagcaauaaacguucaaucuacuuucaaaccuacugugucaacugcaaacauagcacuuaguuggagcucaguggaacacagagguaauaagaucuugguuucaggcagaucagagucaaucaugaagcuagaagaaagaacaggaaucagcugggauuugggaguagaagaugccucugaguccaaauuacuuacuguuuccgucauggacuuaucacagauguacucuccugucuuugaguaccuaucaggugacagacaaguagaggaauggccaaaggcaaccuguacaggcgauugcccggaaagauguggcugcacaucaucaaccugccuacacaaggaauggccucacucaagaaacuggagaugcaaccccacuugguguuggggagucggcaccggaugcaccuguuguggacuagauguaaaggaccuuuuuacagauuacauguuuguuaaauggaaggucgaauauauaaaaacagaggcuauaguguguguugagcuuacuagccaagaaagacaauguagcuugauugaggcaggcacaagauucaacuuagguccugugacuaucacauuaucagagccaagaaacauucagcaaaagcucccuccagaaauugucacauuacauccuagaauugaagaagguuuuuuugacuuaaugcauguacagaagguacuaucagcaagcacagugugcaagcuacagaguugcacacauggcguaccaggagacuuacaggucuaccacaucggaaacuuacuaaaaggagacaaagugaacgggcaucugauacauaaaguugaaccacauuucaacaccuccuggaugucuugggacggcugugaccuagauuacuacugcaauaugggggauuggcccucuugcacguauacuggaguuacccaacauaaucaugcugcauuuguaaaccuacuuaacauugaaacugauuacacaaagaacuuccacuuucacucuaagagagucacugcacauggggacacuccacaauuagauuuaaaagccagaccaaauuauggugcaggugaggucacugugcugguggaaguugcugacauggaguuacacacaaagaaaauugagauaucagguuugaaguuugcaagccuaacuugcacagguuguuaugcuuguagcucuggcaucucauguaagguuaggauccauguagaugaaccagaugagcuuacaguacaugugaagagugaagacccagacauaguugcugcuagcucaagucucauggcaagaaagcuugaauucgggacggauaguacauucaaagccuucucagccaugccuaaaaccuccuugugcuuuuacauuguugagagagaauacuguaaaagcugcaguaaagaagacacacaaaaguguguuaacgcaaagcuugagcgaccacagagcauuuuaauugagcacaaaggaacgauaauuggaaagcagaacgacacuugcacagcuaaagcaagcugcuggcuagagucagucaagaguuucuuuuauggacuaaagaacaugcuuaguggcauuuuuggcaauguuuucauagggauuuucuuauuccuugcuccuuuuauccuguuaauacuuuucuuuauguuuggguggagaauccuauucugcuuuaagugcugcaggagaacuagaggccuauuuaaguacagacaccucaaagaugaugaagaaaccgguuauaggaaaaucauugagagacuaaacaacaaaaaagguaaaaacaagcugcuugacggugaaagauuagcugauagaaagaucgcugagcuguucucuacaaaaacacacauuggc

SEQ ID NO: 3724 - RNA, 3495 nt, Artificial Sequence
  derived and/or modified CDS sequence (wt) from CCHVF(CCHVF SPU97/85)__DQ211633.1__Gn-NSm-Gc
uccgaggagucugauggugacuguauaucaagaacucaacuauugaggacagagacugcagaaauccacagugacaacuaugguggcccaggugacaaaauaacuaucugcaaugguucaacuauuguagaucaaagacuaggcagugaacugggguguuauacuaucaauaggguaaagucauuuaagcuuugcgaaaacagugccacaggaaaaucuugugaaauagauagcaccccaguuaagugcagacaagguuuuugcuugaaaaucacucaagaagggaggggccacgugaagcugucgagaggcucagaaauugucuuggacgccugcgauucaagcugugaaauaaugauaccaaagggcaccggagacaucuuaguugacuguucagguggacaacaacauuucuuaaaagauaauuugauugaucuuggaugucccaauaucccauuauuaggcagaauggccaucuacauuugcagaauguccaaucauccuaaaacaaccauggccuuucucuuuugguuuagcuuugguuaugugauaaccuguauccuuuguaaggugaucuuuuaccuauugauaguugcagggacaguagggaaaaaguucaaacaguauagagaguugagaccucagaccugcaccauaugugaaacaacuccugucaaugcaauagaugcugaaaugcaugaccucaacugcaguuacaauauauguccuuauugcgcaucuagauuaaccucagauggucuugccagacauguaaugcaaugccccaagcggaaggaaaaaauagaggaaacugaauuauacuuaaaccuagaaaggauucccuggguuguuaggaaauuauugcaaguuucagagucuaccgguguggcauugaagaggagcaguuggcugacagugcugcuuguguugcuuauaguuucauugucaccggugcagucagcaccuauuggucauggaaagacaauugaaacauaucaggccagagagggguauacaagcuucugccuuuuuauacuaggaagcaucuuguuuauagucucuugccuaguaaagggucugauugacagugucgguaacagcuucuucccuggacuguccauuugcaagacaugcucuauuggcaguguaaaugguuuugagauugaaucccacaaauguuacuguagucuauuuuguugcccuuauuguagacacugcucugccgauagagaaauccauaaguugcacuugagcaucugcaaaaaaagaaaaacugggagcaaugucauguuggccgucugcaagcgcaugugcuuuagagcaaccauagaaguuagcaauagggcuuuacuuauccggaguaucaucaauaccacuuuugcuguguguauacuaacacuagcaguuuguguugucagcaccucugcaguggagauggaaagucuaccagccggcaccugggagagagaggaagaccuaacaaacuucugucaucaggaaugccaagucacugagacugaaugccucuguccuuacgaagcccuuguacucagaaaacccuuauuuuuagacaguauuguuaaaggcaagaagaacuugcuaaacucaacaagcuuggaaacaagcuuaucaauugaagcaccauggggugcaauaaauguccaaucaaccuucaaaccuacugugucagcugcaaacauagcacuuagcuggagcucaguggaacacagaggcaacaagauuuugguuucaggcaggucagaaucaaucaugaagcuggaggaaaggacaggaaucagcugggaucugggaguagaagacgccucugaguccaaauugcucaccgucucugucauggacuugucacagauguauucccccgucuuugaguaccugucaggugauagacagguagaagaguggcccaaggcgaccuguacaggcgauugcccagaaagauguggcugcacaucaucaaccuguuugcacaaggaauggccccauucaaggaacuggagaugcaaccccacuugguguuggggggucggcacuggaugcaccuguuguggacuagauguaaaagaccucuuuacagauuacauguuugucaaguggaaaguugaauacauaaaaacagaggccauagugugcgucgaacuuacuagccaagaaagacaauguagcuugauugaagcaggcacaagauucaauuuagguccugugacuaucacauugucagagccaagaaacauucagcaaaagcucccuccagagauaaucacauugcauccuagaauugaagaaggcuuuuuugacuuaaugcaugugcaaaaagugcugucagcaagcacagugugcaagcuacagaguugcacacaugguguuccaggagaccuacaggucuaccacaucggaaacuuguuaaaaggagacaagguaaacgggcaucugauucacaagauugaaccacauuucaacacuuccuggaugucuugggauggcugugaccuagacuacuacugcaauaugggggacuggccuucuugcacauacacuggaguaacccaacauaaccaugcugcauuuguaaauuugcucaauaucgaaaccgauuauacaaaaaacuuucauuuucacuccaagagaguuacugcacauggagacacaccacaguuagacuugaaggccagaccaacuuauggugcaggggaggucacuguacuaguggagguugcugacauggaguugcacacaaagaaaauugagauaucaggcuugaaguuugcaagccuaucuugcacaggcugcuaugcuuguagcucugguaucuccuguaaggucaggauccauguagaugaaccagaugagcuuacaguacaugugaagagugaagacccagacauaguugcugcaggcucaagucucauggcaaggaagcuugaauuuggggcagauaguacauucaaagccuuuucagccaugcccaaaaccuccuugugcuuuuacauuguggagagagaauacuguaagagcugcaguagagaagacacacaaaaauguguuaacacuaaacuugagcgaccacagagcauuuugaucgaacauaaaggaacgauuauuggaaagcaaaacgacacuugcacagcuaaagcaagcugcuggcuagagucagucaaaaguuuuuucuacggauuaaagaguaugcuuaguggcauuuuuggcaacguuuucauagggauuuucuuauucauugcuccuuuuguccuguuaauacuuuucuuuauguuuggguggaggauucuguucugcuuuaagugcugcagaagaaccaggggccuauuuaaguacagacaccucaaggacgaugaagaaaccgguuacaggaaaaucauugagaggcuaaauaacaaaaagggaaaaaacaaacuacuugauggggaaaggcuagcugacaggaaaaucgccgaguuauucuccacaaaaucacauaucggc

SEQ ID NO: 3725 - RNA, 3495 nt, Artificial Sequence
  derived and/or modified CDS sequence (wt) from CCHVF(CCHVF SPU103/87)__DQ211634.1__Gn-NSm-Gc
uccgaggagucuagcgacgacuguauaucaagaacucaacuauugaggacagagacugcagagauccacggcgauaacuaugguggcccaggugacaagauaaccaucugcaauggcucaacuauuguagaccagagacuggguagugagcugggguguuacacuaucaauagaguaaagacauucaaacuaugcgaaaacagugcuacagggaagaguugugaaauagauagugucccaguuaaaugcaggcaggguuauugccuaaaaaucacucaggaaggaaggggucauguaaaauuaucuagaggcucagagguugucuuagaugcaugugacacaagcugugaaguaaugauacccaaaggcacuggugacauccuaguugacuguucaggugggcagcaacauuuucugaaagacaaucugauagaucuaggaugccccaaaauuccauugcuggguaaaauggcuauuuauauuugcagaaugucgaaucaccccaaaacaacuauggcuuuccucuucugguucagcuuuggcuaugugauaacuuguguacuuugcaaggccauuuuuuacuuguuaauaauuguuggaacacuaggaaaaaggcucaagcaguacagagaguuaaaaccucagaccugcaccauaugugagacaacuccugugaaugcaauagaugcugagaugcaugaccucaauugcaguuacaacauaugucccuauugugcaucuagacuaaccucagacgggcuugcuaggcaugugacacagugcccuaagcggaaggaaaaaguggaggaaacugaauuguacuugaacuuggaaagaauuccuuggguugugagaaggcuguugcagguaucagaguccacugguguggcauugaaaagaagcagcuggcugauugugcuacuggugcuguucacgguuucauugucaccgguucagucagcgcccauuagucaugggaagacaguugaggcauaccaggccagagagggguacacaggcaugugucucuuugugcugggaaguauccuguuuuuagucucuugucuaaugaaaggacugguugacagugucggcaacaccuucuucccuggacuguccauuugcaaaacgugcucuauaagcagcauuaauggcuuugaaauugagucgcauaggugcuauugcagcuuguuuuguugcccauacuguagacacugcucugcuaauaaagaaauucaucagcugcacuugagcaucugcaaaaaaaggaaaacaggaagcaaugucaugcuggcugucugcaagcgcaugugcuuuagggccaccauggaaguaagcaacagagcccuguuuauccguagcaucaucaacaccacuuuuguuuuaugcauacugauacuagcaguuuguguuguuagcaccucagcaguggagauggaaagccuaccagccggaaccugggagagagaagaagaccuaacaaauuucugucaucaggaaugccaaguuacggauacugaaugccucugcccuuaugaggcucuagugcucagaagaccccuauucuuagauaauauaguuaaaggcaugaaaaauuugcuaaacucaacaaguuuggagacaaguuuaucaauugaggcaccauggggagcaauaaauguucagucaaccuacaaaccaacuguaucaacugcaaacauagcgcuuaguuggagcucaguagaacacagaggcaauaagauacugguuucgggcagaucagaaucaauuaugaagcuggaagaaaggacaggaauaagcugggaucucgguguagaagacgccucugagucuaaacugcuuacagucucugucauggacuugucacagauguacucaccugucuucgaguacuuaucaggagacagacagguggaagaguggcccaaagcaacuuguacgggugauugcccagaaagauguggcugcacaucaucaaccugcuuacauaaagaauggccccauucaaggaauuggagauguaaccccacuuggugcugggguguagggacuggcugcaccuguuguggauuagacgugaaagaccucuuuacagauuauauguuugucaaguggaaaauugaauacauuaaaacagaagcaauaguguguguagaacuuacuagucaggaaagacaguguagcuugauugaagcgggcacaagguucaauuugggucccgugaccaucacauugucagaaccaagaaacauccagcaaaagcucccuucugaaauaaucacacugcaucccaggauugaggaggguuuuuuugaccugaugcauguacaaaaaguguugucggcaagcacaguguguaaguugcagaguugcacacauggugugccaggagaucuacaggucuaccacaucggaaauuuauuaaaaggggauaagguaaauggacaccuaguucauaaaauugagccacacuucaauacuucuuggauguccugggaugguugugaucuagacuauuauugcaacaugggagauuggccuucuugcacauacacaggaguuacccagcacaaucaugcuucauuuguaaaccugcucaacauugaaacugauuacacaaaaaacuuccacuuucacucuaaaagggucacugcacacggagacacaccacaacuggaucuuaaggcaagaccaaccuauggugcaggugagaucacuguauugguggaaguugcugacauggaguuacacacaaagaagauugaaauaucaggcuuaaaauuuacaagccugacuuguacaggcuguuaugcuuguaguucuggcaucucaugcaaaguuagaauucauguggaugaaccagaugaacuuacagugcauguuaaaagugaugauccagauguuguugcagcuagcucaagucucauggcaagaaagcuugaauuuggaacagacaguacauuuaaggcuuuuucagccaugccuaaaacuucucuauguuucuacauuguggaaagagaauacuguaagagcugcagugaagaagacacacaaaaauguguuaacacaaaacuugagcagccacagagcauuuugaucgaacauaaggguacuauaaucgggaagcaaaacaacacuugcaaggcuagggcggguugcugguuagagucaguuaagaguuuuuuuuacggccuaaagaacaugcucaguggcauuuuuggcaauguauuuauaggcauuuucuuauuucuugcccccuucauccuauuaauacuauucuuuauguuuggguggaggaucuuguuuuguuuuaaguguuguagaagaacuagaggccuguucaaguauagacaccugaaagacgaugaagaaacugguuauagaaagaucauugaaagacuaaacaacaaaaaagggaaaaauaaacugcuugauggugaaagacuugcugauagaagaauugccgaacuguucucuacaaaaacacacauuggc

SEQ ID NO: 3726 - RNA, 3495 nt, Artificial Sequence
  derived and/or modified CDS sequence (wt) from CCHVF(CCHVF SPU415/85)__DQ211635.1__Gn-NSm-Gc
uccgaggagucugauggugacuguauaucaagaacucaacuauugaggacagagacuacagaaauccacagugacaacuaugguggcccaggugacaaaauaacuaucugcaaugguucaacuauuguagaucaaagacuaggcagugaacugggguguuauacuaucaauagggugaagucauuuaagcuuugcgaaaacagugccacaggaaaaucuugugaaauagauagcaccccaguuaagugcagacaagguuuuugcuugaaaaucacucaagaagggaggggccacgugaagcugucgagaggcucggaaauugucuuggacgcuugcgauucaaacugugaaauaaugauaccaaagggcaccggagacaucuuaguugacuguucagguggacaacaacauuucuuaaaagauaauuugauugaucuuggaugucccaauaucccauuauuaggcaaaauggccaucuacauuugcagaauguccaaucauccuaaaacaaccauggccuuucucuuuugguuuagcuuugguuaugugauaaccuguauacuuuguaaggugaucuuuuaccuauugauaguugcagggacaguaggaaaaaaguucaaacaguauagagaguugagaccucagaccugcaccauaugugaaacaauuccugucaaugcaauagaugcugaaaugcaugaccucaacugcaguuacaauauauguccguauugcgcaucuagauuaaccucagauggucuugccagacauguaaugcaaugcccuaagcggaaggaaaaaguagaggaaacugaauuauacuuaaaccuagaaaggauucccuggguuguuaggaaauuauugcaaguuucagagucuaccgguguggcauugaagaggagcaguuggcugacagugcugcuuguguugcuuauagucucauugucaccggugcagucagcaccuauuggucauggaaagacaauugaaacauaucaggccagagaaggguacacaagcuucugccuuuuuauacuaggaagcaucuuguuuguagucucuugccuaguaaagggucuaauugacagugucgguaacagcuuuuucccuggauuguccauuugcaagacaugcucgauuggcaguauaaaugguuuugagauugaaucccacaaauguuacuguagucuauuuuguugcccuuauuguagacacugcucugccgauagagaaauccauaaguugcacuugagcaucugcaaaaaaagaaaaacugggagcaaugucauguuggccgucugcaagcgcaugugcuuuagagcaaccauagaaguuagcaauagggcucuacuuauccggaauaucaucaauacuacuuuuguuguguguauacugacacuagcaguuuguguugucagcaccucugcaguggagauggaaagucuaccagccggcacuugggagaaagaggaagaccuaacaaacuucugucaucaggaaugccaagucacugagacugaaugccucuguccuuacgaagcccuuguacucagaaaacccuuauuuuuagacaguauuguuaaaggcaugaagaacuugcuaaacucaacaagcuuggaaacaagcuuaucaauugaggcaccauggggugcaauaaauguccaaucaaccuucaaacccacugugucagcugcaaacauagcacuuagcuggagcucaguggaacacagaggcaacaagauuuugguuucaggcaggucagaaucaaucaugaagcuggaggaaaggacaggaaucagcugggaucugggaguagaagacgccucugaguccaaauugcucaccgucucugucauggacuugucacaaauguauucccccgucuuugaguaccugucaggugauagacagguagaagaguggcccaaggcgaccuguacaggcgauugcccagaaagauguggcugcacaucaucaaccuguuugcacaaggaauggccccauucaaggaacuggagaugcaaccccacuugguguuggggggucggcacuggaugcaccuguugugggcuagauguaaaagaccucuuuacagauuacauguuugucaaguggaaaguugaauacauaaaaacagaggccauagugugugucgaacuuacuagccaagaaaggcaauguagcuugauugaagcaggcacaagauucaauuuagguccugugacuaucacauuaucggagccaagaaacauucagcaaaagcucccuccagaaauaauuacauugcauccuagaauugaagaaggcuuuuuugacuuaaugcaugugcaaagagugcugucagcaagcacagugugcaagcuacagaguugcacacauggugugccaggagaccuacaggucuaccacaucggaaacuuguuaaaaggagacaagguaaacgggcaucugauucacaagauugaaccacauuucaacacuuccuggaugucuugggauggcugugaccuagauuacuacugcaauaugggggauuggccuucuugcacauacacuggaguaacccaacauaaccaugcugcauuuguaaauuugcucaauaucgaaaccgauuauacaaaaaacuuucauuuucacuccaagagaguuacugcacauggagacacaccacaauuagacuugaaggccagaccaacuuauggugcaggggagguuacuguacuaguggagguugcugacauggagcugcacacaaagaaaauugagauaucaggcuugaaguuugcaagucuaacuugcacaggcugcuaugcuuguagcucugguaucuccuguaaggucaagauccauguagaugaaccagaugagcuuacaguacaugugaagagugaagacccagacauaguugcugcaggcucaagucucauggcaaggaagcuugaauuuggggcagauaguacauucaaagccuuuucagccaugcccaaaaccuccuugugcuuuuauauuguggagagagaauacuguaagagcugcaguagagaggacacacgaaaauguguuaacacuaagcuugaucgaccacagagcauuuugaucgaacauaaaggaacgauuauuggaaagcaaaacaacacaugcacagcuaaagcaagcugcuggcuagagucagucaaaaguuuuuucuacggauugaagaauaugcuuaguggcauuuucgguaauguuuucauagggauuuucuuauucauugcuccuuuuguccuguuaauacuuuucuuuauguuuggguggaggauccuguucugcuuuaagugcugcagaagaaccagaggccuauuuaaguacagacaccucaaggacgaugaagaaaccgguuacaggaaaaucauugagaggcuaaauaacaaaaagggaaaaaacaaacuacuugauggggaaaggcuagcugauaggaaaaucgccgaguuauucuccacaaaaucacauaucggc

SEQ ID NO: 3727 - RNA, 3495 nt, Artificial Sequence
  derived and/or modified CDS sequence (wt) from CCHVF(CCHVF Turkey200310849)__DQ211636.1__Gn-NSm-Gc
uccgaagagccaggugaugacugcauaucaagaacucagcuauugaggacagaaacagcagagauccaugaugacaacuauggugguccaggugauaaaauaacuaucugcaacgguucaaccauuguagaucagagacugggcagugaacuaggguguuauaccaucaacagggugaagucauucaagcuaugcgaaaacagcgccacagggaaaaccugugagguagacagcacuccgguuaagugcaggcaagguuuuuguuuaaaaaucacccaagagggaaggggccacguaaaauuaucuagaggcucagagguuguccuggaugcuugcgacucaagcugugaaguaaugauaccuaaaggcacuggggauauccuaguggacuguucaggugggcagcaacauuucuuaaaagacaacuuaauugaccuagggugcccccauaucccgcuauuggguaagauggcuauuuacauuugcagaaugucaaaucauccuagaacaaccauggcuuuucucuucugguucagcuuuggcuauguuaucaccuguauaucuugcaaggcucuuuuuuauucauugauaauuauuggaacacuaggaaaaaagaucaagcaauauagggaacugaaaccucaaaccugcaccauaugugagacagcuccugucaaugcaauagaugcugaaaugcaugaccucaacuguaguuacaauauaugcccuuauugugcaucaagauugaccuccgaugggcuagccaggcauguaacgcaaugccccaagcggaaagagaagguugaagagacugaacuguaccugaaccuggaaagaauuccuuggauugucagaaagcuauugcaggugucagaguccacugguguggcauuaaaacgaagcagcuggcugauuguacugcuuguguuacuaacaguuucauugucaccgguucaaucagcaccuguuggucauggaaagacaaucgaaauauaucagaccagggaaggauucgcaagcaucugucucuuuauguuaggaagcauucuauuuauagucucuugcuuggugaaagggcuaguugacagugucagugacagcuucuuccccggccuaucugucuguaagacaugcucuauuggcaguguaaauggcuuugaaauugaaucgcacaaaugcuacuguagccuauuuugcugccccuacugcaggcacugcucugcugacagagaaauucaccaguuacacuugaguaucugcaaaaaaaggaaaacggggagcaaugucaugcuggccgucugcaaacgcaugugcuuuagggcaaccauagaagcaagcagaagagcccugcucauccgaagcauuaucaauaccacuuuuguaauaugcauucuaacauugacaaucuguguuguuagcaccucugcaguggagauggaaaaccuuccagcaggaacuugggagagggaggaagaucugacaaauuucugucaucaggaaugccagguaacugagacagaaugccucuguccauacgaagcucuugugcucagaaaaccucuuuucuuggacaguauaguuaaagguaugaaaaauuugcuaaacucaacaagcuuggaaacaagcuuaucaauugaggcaccauggggagcaauaaauguccagucaaccuuuaaaccagcuguaucgacugcaaacauagcacucaguuggagcucaguggagcacagaggcaacaagaucuuagucacaggcaggucugaaucaauuaugaaacuggaggaaaggacaggagucagcugggaucuagguguagaagaugccucugaauccaaauuacuuaccguuucuaucauggauuugucacaaauguauucuccuguuuuugaguacuugucaggagacagacagguugaagaauggcccaaagcaacuuguacaggugauugcccggagaggugugguugcacaucaucaaccugcuuacauaaagaauggccucacucaagaaacuggagauguaaucccacuuggugcuggggaguaggaaccggcugcaccugcugcgggguggauguaaaagaucuuuuuacagaucacauguuugucaaauggaaaguugaauacauaaaaacugaagcuauaguauguguugaacucaccagccaagaaagacagugcagucugauugaggcagguacuagauucaacuugggcccugugacuauuacccugucugagccaagaaacauucagcagaagcuuccuccugagauuaucacguugcaucccaaaauugaagaaggcuucuuugacuugaugcauguacaaaaaguguugucugcaaguacaguguguaaacugcagaguugcacacaugguauaccaggagaucuacaaguuuaccacauuggcaacuuguugaaaggggauagaguaaacgggcaucuaauucacaaaauugaaucacauuucaacaccucuuggauguccugggaugguugugacuuagacuacuacugcaacaugggggauuggccaucuugcacauacacaggagugacccagcauaaccaugcugcauuuguaaacuugcuuaacauugaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcauaccaagaaaguugaaauaucaggcuugaaauuugcaagucuggcuugcacggguugcuaugcuuguagcucuggcaucuccuguaaaguuagaauucauguagaugaaccagaugagcucacaguacauguaaagagcagugauccagaugugguugcagcuagcacaagucucauggcgaggaagcuugaauuugggacagacagcacauucaaggccuuuucagcuaugcccaaaaccucuuuauguuuuuacauuguggagagagaauacugcaagagcugcagugaagaugauacacaaaaauguguugacacaagacuugagcagccacagagcauacuaauugagcacaaaggaacgauaauuggaaagcagaaugauacuugcacagccaaggcaagcuguugguuagagucagucaagaguuuuuuuuauggauugaagaauaugcuuggcaguguuuuugguaaucuuuucauaggcauuuuguuauuccuugccccuuuuguccuguuggugcuuuucuuuauguuuggguggaaaaucuuguuuugcuuuaaauguugcaggaggaccagaggcuuauuuaaguauagacaccucaaagacgaugaggaaacaggcuacagaaggauuauugaaagacugaacagcaaaaaagggaaaaacaggcugcuugauggugauagacuggcugauaggaaaauugcugagcuguucuccacaaaaacacacauuggc

SEQ ID NO: 3728 - RNA, 3495 nt, Artificial Sequence
  derived and/or modified CDS sequence (wt) from CCHVF(CCHVF Iran-52)__DQ446215.1__Gn-NSm-Gc
uccgaagaaucuggugaugacugcauaucaagaacucagcuauugaggacagagacugcagagguccauggcgauaacuauggugguccaggugauaagauaaccaucuguaaugguucaacuguuguagaucaaagacuggguagugaacugggguguuacacuaucaauagagugaggucauucaagcuaugcgaaaacagugccacagggaagagcugugaaauagacaguaucccagucaaguguaagcaggguuauugccuaaaaaucacucaggaaggaaggggccaugugaaguuaucuagaggcucagaaguugucuuggauguaugugauucaagcugugaagugaugauaccuaagggcacuggugacauucuaguagauuguucaggugggcagcaacauuuuuuaaaagacaaccugguugaccuagggugucccaaaauuccguuacugggcaaaauggcuauuuauaucugcaggaugucgaaucaccccaagacaaccauggccuuccucuuuugguucagcuuuggcuaugugauaacuuguauacuuugcaaggccauuuuuuucuuauuaauaauuuuuggaacacuagggaaaagguucaagcaguacagagaguugaaaccccagaccugcaccauaugugagacaacaccuguaaaugcaauagaugcugaaaugcaugaucucaacugcaguuacaauauaugucccuauugugcgucuagacugacuucagaugggcuugcuaggcaugugacacaauguccuagacggaaggagaaaguggaggaaaccgaauuauaccugaauuuagagagaauucccuggguuguaagaaagcuauugcaggugucagaguccacugguacaguauuaaaaaggagcagcuggcuaauuguauuacuugugcuguucacaguuucauugucaccaguucaaucagcacccauuggucacgggaaaacaauugaaacauaccggguuagggaagaauacacaaguauuugccucuuuguacuaggaaguauccuguuuauagucucuuuucuaaugaaaggacugguugacgguguuggcaacaucuucuuuccugggcuguccgucuguaagacaugcucuauagguagcauuaauggcuuugaaauugagucucauaagugcuacuguagcuuguuuuguugcccuuacuguaggcacugcucugcugauggagaaauccaucagcugcacuugagcaucugcaaaaaaaggaaaacaggaaguaauguuaugcuggcuguuugcaaacgcauguguuucagggcaacuauggaaguaagcaacaaggcccuauuuauccguagcauuaucaacaccacuuuuguugugugcauacugauacuagcgguuuguguuguuagcaccucagcaguagagauggaaagccuaccagcugggaccugggaaagagaagaagaccuaacaaauuucugccaucaggaaugccaggucacagagacugagugccucugcccuuaugaagcucuagugcucagaaggccccuauuucuagauaguauagucaaagguaugaaaaaucugcuaaacucaacaagucuagaaacaagcuuaucaauugaggcaccauggggagcaauuaauguucagucaaccuacaaaccaacuguaucaacugcaaacauagcacuuaguuggagcucaguggaacacagaggcaauaagguuuuggucucaggcagaucagaaucaauuaugaagcuggaagaaaggacaggaaucagcugggaucuuggcguggaagaugccucugagucuaagcuacuuacaguuucagucauggacuugucucagauguacucuccugucuucgaguacuuaucaggugacagacaaguggaagaguggccuaaagcaaccugcacaggugacugcccagaaagauguggcugcacaucaucaaccugcuuacacaaagaguggccccacucaaggaauuggagauguaauccuacuuggugcugggguguagggacuggcugcaccuguugugguuuagaugugaaagaccuuuucacagauuacauguucgucaaguggaaaguugaguacauuaagacagaggccauaguauguguagaacuaaccagucaggaaagacaguguagcuugauugaggcgggcacaagauucaauuuagguucugugacuauuacauugucagaaccaaggaacauucaacaaaagcucccuccugaaauaaucacacugcaccccaagauugaggaagguuuuuuugaccuaaugcauguacaaaaagugcuaucggcaagcacaguguguaaguugcagaguugcacacauggugugccaggagaucugcaggucuaccacaucggaaaccuauuaaaaggggacagaguaaacggacaccugauucauaaaauugagcaacacuucaacacauccuggaugucuugggaugguugugaccuagacuacuacuguaacaugggagacuggccuuccugcacauauaccggagucacucagcauaaccaugcuucauuuguaaaccugcucaacauugaaacugauuauacaaaaaccuuucacuuucacucuaaaaggguuacugcacauggagacacaccacagcuagaucugaaggcaaggccaaccuauggugcaggugagaucaccgugcugguggaaguugcugacauggaguuacacacaaagaagauugaaauaucaggcuuaaaauuugcaggccuaacuugcacagguuguuaugcuuguaguucuggcaucucuuguaaaguuagaauucauguagaggaaccagaugaacuuacaguacauguuaaaagugaugacccagauguaguugcagcuagcucaagucucauggcgaggaagcuugaguuuggaacagacaguacauuuaaagcuuucucagccaugccuaaaaccucccuauguuucuacauuguggaaagagaauacuguaagagcugcaguaaagaagauacacaaaaauguguuaacacgaaacucgaacaaccacagagcauuuugaucgaacauaagggaacuauaauuggaaagcaaaacaauacuugcacggcuaaagcgaguugcugguuagagucaguuaagaguuuuuuuuauggucugaagaauaugcucgguggcauauuuggcaauguuuuuauaggcauuuucacauuucuuacccccuuuaucuuguuaauacuuuucuuuauguuuggguggaggauccuguuuugcuucaaguguugcagaagaaccagaggccuauucaaguacagacaccucaaagacgaugaagaaacugguuacagaaagaucauugaaagacugaacaacaaaaagggaaaaaacaggcugcuugauggugaaagacuugcugacagaaagauugcugaacuguucuccacaaaaacacacauuggc

SEQ ID NO: 3729 - RNA, 3495 nt, Artificial Sequence
  derived and/or modified CDS sequence (wt) from CCHVF(CCHVF Iran-53)__DQ446216.1__Gn-NSm-Gc
uccgaagaaucuggugaugacugcauaucaagaacucagcuauugaggacagagacugcagagguccauggcgauaacuauggugguccaggugauaagauaaccaucuguaaugguucaacuguuguagaucaaagacuggguagugaacugggguguuacacuaucaauagagugaggucauucaagcuaugcgaaaacagugccacagggaagagcugugaaauagacaguaucccagucaaguguaagcaggguuauugccuaaaaaucacucaggaaggaaggggccaugugaaguuaucuagaggcucagaaguugucuuggauguaugugauucaagcugugaagugaugauaccuaagggcacuggugacauucuaguagauuguucaggugggcagcaacauuuuuuaaaagacaaccugguugaccuagggugucccaaaauuccguuacugggcaaaauggcuauuuauaucugcaggaugucgaaucaccccaagacaaccauggccuuccucuuuugguucagcuuuggcuaugugauaacuuguauacuuugcaaggccauuuuuuucuuauuaauaauuuuuggaacacuagggaaaagguucaagcaguacagagaguuaaaaccccagaccugcaccauaugugagacaacaccuguaaaugcaauagaugcugaaaugcaugaucucaacugcaguuacaauauaugucccuauugugcgucuagacugacuucagaugggcuugcuaggcaugugacacaauguccuagacggaaggagaaaguggaggaaaccgaauuauaccugaauuuagagagaauucccuggguuguaagaaagcuauugcaggugucagaguccacugguacaguguuaaaaaggagcagcuggcuaauuguauuacuugugcuguucacaguuucauugucaccaguucaaucagcacccauuggucacgggaaaacaauugaaacauaccggguuagggaagaauacacaaguauuugccucuuuguacuaggaaguauccuguuuauagucucuuuucuaaugaaaggacugguugacgguguuggcaacaucuucuuuccugggcuguccgucuguaagacaugcucuauagguagcauuaauggcuuugaaauugagucucauaagugcuacuguagcuuguuuuguugcccuuacuguaggcacugcucugcugauggagaaauccaucagcugcacuugagcaucugcaaaaaaaggaaaacaggaaguaauguuaugcuggcuguuugcaaacgcauguguuucagggcaacuauggaaguaagcaacaaggcccuauuuauccguagcauuaucaacaccacuuuuguugugugcauacugauacuagcgguuuguguuguuagcaccucagcaguagagauggaaagccuaccagcugggaccugggaaagagaagaagaccuaacaaauuucugccaucaggaaugccaggucacagagacugagugccucugcccuuaugaagcuuuagugcucagaaggccccuauuucuagauaguauagucaaagguaugaaaaaucugcuaaacucaacaagucuagaaacaagcuuaucaauugaggcaccauggggagcaauuaauguucagucaaccuacaaaccaacuguaucaacugcaaacauagcacuuaguuggagcucaguggaacacagaggcaauaagguuuuggucucaggcagaucagaaucaauuaugaagcuggaagaaaggacaggaaucagcugggaucuuggcguggaagaugccucugagucuaagcuacuuacaguuucagucauggacuugucucagauguacucuccugucuucgaguacuuaucaggugacagacaaguggaagaguggccuaaagcaaccugcacaggugacugcccagaaagauguggcugcacaucaucaaccugcuuacacaaagaguggccccacucaaggaauuggagauguaauccuacuuggugcugggguguagggacuggcugcaccuguugugguuuagaugugaaagaccuuuucacagauuacauguucgucaaguggaaaguugaguacauuaagacagaggccauaguauguguagaacuaaccagucaggaaagacaguguagcuugauugaggcgggcacaagauucaauuuagguucugugacuauuacauugucagaaccaaggaacauucaacaaaagcucccuccugaaauaaucacacugcaccccaagauugaggaagguuuuuuugaccuaaugcauguacaaaaagugcuaucggcaagcacaguguguaaguugcagaguugcacacauggugugccaggagaucugcaggucuaccacaucggaaaccuauuaaaaggggacagaguaaacggacaccugauucauaaaauugagcaacacuucaacacauccuggaugucuugggaugguugugaccuagacuacuacuguaacaugggagacuggccuuccugcacauauaccggagucacucagcauaaccaugcuucauuuguaaaccugcucaacauugaaacugauuauacaaaaaccuuucacuuucacucuaaaaggguuacugcacauggagacacaccacagcuagaucugaaggcaaggccaaccuauggugcaggugaggucaccgugcugguggaaguugcugacauggaguuacacacaaagaagauugaaauaucaggcuuaaaauuugcaggccuaacuugcacagguuguuaugcuuguaguucuggcaucucuuguaaaguuagaauucauguagaugaaccagaugaacuuacaguacauguuaaaagugaugacccagauguaguugcagcuagcucaagucucauggcgaggaagcuugaguuuggaacagacaguacauuuaaagcuuucucagccaugccuaaaaccucccuauguuucuacauuguggaaagagaauacuguaagagcugcaguaaagaagauacacaaaaauguguuaacacgaaacucgaacaaccacagagcauuuugaucgaacauaagggaacuauaauuggaaagcaaaacaauacuugcacggcuaaagcgaguugcugguuagagucaguuaagaguuuuuuuuauggucugaagaauaugcucgguggcauauuuggcaauguuuuuauaggcauuuucacauuucuuacccccuuuaucuuguuaauacucuucuuuauguuuggguggaggauccuguuuugcuucaaguguugcagaagaaccagaggccuauucaaguacagacaccucaaagacgaugaagaaacugguuacagaaagaucauugaaagacugaacaacaaaaagggaaaaaacaggcugcuugauggugaaagacuugcugacagaaagauugcugaacuguucuccacaaaaacacacauuggc

SEQ ID NO: 3730 - RNA, 3495 nt, Artificial Sequence
  derived and/or modified CDS sequence (wt) from CCHVF(CCHVF Kosova Hoti)__EU037902.1__Gn-NSm-Gc
uccgaagagccaggugaugauugcauaucaaggacucagcuauugaggacagaaacagcagagauccaugacgauaacuauggugguccaggugacaaaauaacuaucugcaaugguucaaccauuguagaucagagacugggcagugaacuaggguguuacaccaucaacagggugaagucauucaagcuaugcgaaaacagcgccacagggaaaaccugugagauagacagcacuccaguuaagugcaggcaagguuuuuguuuaaaaaucacccaaaagggaaggggccacguaaaauuaucuagaggcucagagguugucuuggacgcuugcgacucaaacugugaaguaaugauaccuaaaggcacuggagauauccuaguggacuguucagguggacagcagcauuucuuaaaagacaacuugauugaccuggggugcccucauaucccacuauuggguaagauggccauuuacauuugcagaaugucaaaucauccuaaaacaaccauggcuuuucucuucugguucagcuuugguuaugugaucaccuguauauuuugcaaggcucuuuuuuauucauugauaauuauugggacacuaggaaaaaagaucaagcaauauagggaacugaaaccucaaacuugcaccauaugugaaacagcuccugucaaugcaauagaugcugaaaugcaugaccucaacuguaguuacaauauaugcccuuauugugcaucaagauugaccuccgaugggcuagcuaggcauguaaagcaaugcccuaagcgaaaggagaaagucgaggagacugagcuguaccugaaccuggaaagaauuccuugggucgucagaaagcuauugcaagugucagaguccacugguguggcauugaaacgaagcaguuggcugauugugcugcuuguguuacucacaguuucauugucaccgguucaaucagcaccuguuggucaugguaagacgaucgaaacauaucagaccagagaaggauucacaaguauuugucucuuuauguuaggaagcauccuauucauagucucuugcuuggugaaagggcugguugacagugucagugacagcuucuuccccggccugucugucugcaagacaugcuccauuggcaguauaaauggcuuugaaauugaaucgcauaaaugcuacuguagcuuauuuugcugccccuauuguagacacugcucugcugacagagaaauucaccaauugcacuugaauaucugcaaaaaaagaaaaacggggagcaaugucaugcuagcugucugcaagcgcaugugcuuuagggcaaccauagaagcaagcagaagagcccugcucauccgaaguauuaucaauaccacuuuuguaauaugcauucuaacauuaacaaucuguguuguuaguaccucugcaguagagauggaaaaccuuccagcaggcaccugggagagagaggaagaccugacaaauuuuugucaucaggaaugccagguaaccgagacggaaugccuuuguccauacgaagcucuugugcucaggaaaccucuuuucuuagacaguauagucaaagguaugaaaaauuugcuaaacucaacaagcuuagaaacaagcuuaucaauugaggcaccauggggagcaauaaauguccagucaaccuucaaaccaacagugucgacugcgaacauagcacucaguuggagcucaguggaacacagaggcaacaagaucuuagucacaggcaggucugagucaauuaugaaacuagaggaaaggacaggaaucagcugggaucuaggcguagaagaugccucugaauccaaauuacuuaccgucucuaucauggauuugucacagauguauuccccaguuuuugaguacuugucaggggacagacagguugaagaauggcccaaagcaacuugcacaggugacugcccacaaagguguggcugcacaucaucaaccugcuugcauaaagaauggccucauucaagaaacuggagauguaaucccacuuggugcuggggagugggaacuggcugcaccugcugcgggguggauguaaaagaccuuuuuacagaucacauguuugucaaauggaagguugaauauauaaaaacugaagccauaguguguguugagcucaccagccaagaaagacagugcagucugauugaggcagguacuagauucaacuugggcccugugacuauuacccugucugagccaagaaacauucagcagaagcuccccccugagaucauuacguugcaucccaaaauugaggaaggcuucuuugacuugaugcauguacaaaaaguguuguccgcaaguacaguguguaaacugcagaguugcacacaugguauaccaggagaucuacaaguuuaccacauuggcaauuuguugaaaggggauagagugaacgggcaucuaauucacaaaauugaaccacauuucaacaccucuuggauguccugggaugguugugacuuagacuacuacugcaacaugggggacuggccuucuuguacauacacaggagugacccagcauaaucaugcugcauuuguaaacuugcucaacauugaaacugauuacacaaaaaccuuccacuuccacucuaaaagagucacagcacauggugacacaccacaauuggacuuaaaagcaaggccgaccuacggugcaggagagaucacugugcugguugagguugcugacauggaguugcauaccaagaaaguugagauaucgggcuugaaauuugcaagucuggcuugcacagguugcuaugccuguagcucugguaucuccuguaaagucaggauucauguagaugaaccagaugagcucacagugcauguaaagagcagugauccagaugugguugcagcuggcacaagccucauggcaaggaagcuugaauuugggacagacagcacauucaaggccuuuucagcuaugcccaaaaccucuuuauguuuuuacauuguggagaaagaauacugcaagagcugcagugaagaugauacaaaaaaauguguugacacaaaacuugagcagccacagagcauacuaauugagcacagagggacgauaauuggaaagcagaaugauacuugcacagccaaggcaagcuguuggcuagagucagucaagaguuuuuuuuauggauugaagaauaugcuuggcaguguuuuugguaauuuuuucauagguauuuuguuauuccuugccccuuuuguccuguuggugcuuuucuuuauguuuggauggaaaaucuuguuuugcuuuaaauguugcaggaggaccagaggcuuguuuaaguauagacaccucaaagacgaugaggaaacaggcuacagaaggauuauugaaaggcugaacaacaaaaaagggaaaaauagacugcuugauggugaaagguuggcugauaggaaaauugccgagcuguuuuccacaaaaacacacauuggc

SEQ ID NO: 3731 - RNA, 3495 nt, Artificial Sequence
  derived and/or modified CDS sequence (wt) from CCHVF(CCHVF YL04057)__FJ562094.1__Gn-NSm-Gc
gcagaaggaggaagcagugacugcauuucaagaacucagcuaguuaaaacagagguugcagaaauucaugaggacaguuacggugggccuggugagaaaauaacaaucugcaaugguuccacaauuguagaucaaaggcuugguagggaauugggcuguuauacaaucaacagaguaagauccuacaagcuaugcgagaacagugccucagggaaaagcugugaaauagauagcaucccagucaaaugcaaacaaggguuuugccucaaaauaacccaagaaggaagaggucauguaaaacuguccagagggacagaaauuguucuagaugucugugauuccagcugugagcugaugauaccuaagggcacuggagacauuuuaguggauugcucaggagggcagcagcauuuuuuacaaaacaaucugauugacuugggaugccccaaugucccacuacuggguaaaauggccauauaugucugcaggaugucaaaccacccaaaaacuaccauggcauuucuguucugguucagcuuuggcuaugucauuacauguauagcaugcaggguacucuucuacuugcugauugccaucggaacaguagggaaaaagcuaaaacaguauagagagcugaaaccacaaacaugcauuguuugugaaucugucccuguuaaugcaauagaugcugaaaugcaugagcuuaauugcaguuacaauauaugcccauacugugcaucuagacugucuacagacgggcucaucaggcacguaacucagugucccaaacggagggagaagguggaagagacugagcuauucuugaacuuggaaagaauaccuuggcuggugagaaagcuccuucaaguaucagagucaacaggaauggcucuaaagaggagcuguuggaugaucacacuccucauucuacuauugguuucgauaucaccaguccaaucugcaccgguaggcaaagagagggcaaucgagaccuaucaagcaagagaaaccuacacaggcauaugccucuuuguguuaggaaguguucucuuugcgguauccuggcugacaaaggccuugauugauggcauaggcaauagcuucuucccuggacuuucugucugcaagacaugcuccauugguaguauaaauggauuugaaauagagucucauaaaugcuauugcagucuauucuguuguccuuacuguagagcuugcucauccgacaaaaacacucaccggaugcacuuaaauguuugcaaaaaaaggaaaauggguagcaaugucaugcuggcugucuguaaacguaugugcuuuagagcaaccauugaggcaagcaauaaagcuuuacugaucaggagcaucauaaauuccacuuuugugauuugcauauuaauccuaacaaucugugugguaagcaccuccgcaguugauauggaaaauuugccugcaggcaucugggagaaagaagaagaucuuacaaacuucugucaccaggagugucaagugacagaaacugaaugccucugcccguaugaggccaugguacucaggaagccacucuuccuggauagcauagccaagggaaagaaaagccuguugaacuccacaagcuuagaaacuagucugucaauugaagcuccguggggagcaaucaauguucagucaacuuucaaaccaacaguuucagcugcuaacauagcacuuagcuggaguucaguugaacacaggggcaacaaaauuuuaguuucagguagaucagagucaaucaugaaauuagaagaaagaacaggagucagcuggaaucuggguguagaagaugcuucugagucaaagacgcucacuguuuccgucauggaccugucacaaauguacucuccuguuuuugaguacuugucaggugacagacaaguggaggaauggccaaaggcaacuugcacaggugacuguccagagagaugcggcugcacuucgucaaccugcuuacauaaagaguggccacauucaagaaacuggcgauguaguccuaccugguguugggggguggggacuggcugcacuugcugugggcuggauguuaaggauuuuuuuacugacuacaugcugguaaaauggaaaguggaauauauaaagacagaagcuauagugugugucgagcugacuagucaagagaggcaguguaguuuaauugaagcaggcacaagauuuaaccuaggcccuguaacaauaacacuaucagagccaagaaauguccagcagaggcuuccucccgaaauuguaacacugcauccuaaaauagaggaagguuuuuuugauuugaugcauguacaaaaaauacugucugcaagcacaguuugcaagcuacagagcugcacacacggugugccgggcgauuuucaggucuaccaugucgguaaccugcugaggggagacaagguuaauggacacucaauucacaagauagaaccacauuuuaauacuucauggaugucaugggaugguugcgaucuggacuauuucugcaauaugggggacuggccuucaugcacauacacuggaguaacacagcauaaccgugcugcauuuaucaacaugcucaacauugagacugacuauacaaaaacuuuccacuuucauucgaagagggucacggcacauggagauacuccccagcuagaccugaaagcgagaccggcauauggugcuggcgaggucacuguucuaguggagguugcagacuuggaguugcacacaaagaaacuugaagugucagguuugaaaauugcaaguuugaccugcucuggguguuaugccugcagcucuggcaucuccugcaaaguuagaauccauguaaaugaaccagaugaauucacaguacauguaagaaguagcgacccagauguuguagcagcaggaucaagucuuauggcaaggaaaauagaguuuggggcugacaguacauucaaggccuuuucaucaaugcccaaggacuccuuaugcuuuuacauaguagaaaaggauuacugcagcagcugcaccgacgaugacacacaaaagugugucaacacgaagcuugaccauccacagagcauacucauugagcacaaaggaacaauaauuggcaagcaaaaugacacuuguucgaccaagacaagcugcuggcuagaaucaguuaaggguuuuuucuaugggcucaaaaacaugcugaguggcaucuuuggaaauguuuuuuuaggcauccucuuauuccuugcuccuuuuguacuacugauauuuuuuuucuuuuuuggguggaggcuucuguuuugucucaaauguugcagaagaacuagaggacuguugaaauauaagcaccuuaaggacgaagaggaggcuggauacaaaaaaaucauugaaaggcuaaauggcaaaaaagguaaaagucaauuguuugauggugaaaggcuugcagacaggaagauugcugagcuuuuuucuacuaaaauucacauaggu

SEQ ID NO: 3732 - RNA, 3495 nt, Artificial Sequence
  derived and/or modified CDS sequence (wt) from CCHVF(CCHVF V42/81)__GU477490.1__Gn-NSm-Gc
uccaaagagccaggugaugacuguauaucaagaacucagcuaaugaggacagaaacagcagagauccaugaugacaacuauggugguccaggugauaaaauaacuaucugcaaugguucaaccauuguggaucagagacugggcagugaacuaggguguuauaccaucaacagggugaagucauucaagcuaugugaaaacagcgccacagggaaagccugugaaguggacagcacuccgguuaagugcaggcaggguuuuuguuuaaaaaucacccaagagggaaggggccauguaaaguuaucuagaggcucagagguugucuuggaugcuugcgacucaagcugugaaguaaugauaccuaaaggcacuggagauauccuaguggacuguucagguggacagcaacauuucuuaaaggacaacuuaauugaccuagagugcccucauaucccgcuauuagguaaguuggccauuuacauuugcagaaugucaaaucauccuagaacaacuauggcuuuucucuucugguucggcuuuggcuaugugaucaccuguauacucugcaaggcucuuuuuuauucauugauaauuauugggacacuagggaaaaagaucaagcaauauagggaacugaaaccucaaacuugcaccauaugugagacagcuccugucaaugcaauagaugcugaaaugcaugaccuuaacuguaguuacaauauaugcccuuauugugcaucaagauugaccuccgaugggcuagcuaggcauguaacgcaaugccccaagcgaaaagagaaaguugaggagacugaacuguacuugaaucuggagagaauuccuuggauugucaggaagcuccugcaagugucggaguccacuggcgugguauugaaacgaagcaguuggcugauugugcugcuuguguuacucacaguuucauugucaccaguucagucagcaccuguuggucaugguaagacaauugaaacauaucagaccagagaaggauucacaagcaucugucucuuuauguuaggaagcauccuauuuauagucucuugcauagugaaggggcugguugacagugucagugacagcuucuuccccggccugucugucuguaagacaugcucuaucagcaguauaaauggcuuugaaauugaaucgcauaaaugcuacuguagcuuauuuugcugccccuacuguaggcacugcucugcugacagagaaauucaccaguuacacuugaguaucugcaggaaaagaagaacggggagcaaugucaugcuggcugucugcaaacgcaugugcuuuagggcaaccauagaaguaagcagaagagcccugcucauccgaagcaucaucaauaccacuuuuguaauauguauucuaacauuaacaaucuguguuguuagcacuucugcaguagagauggaaaaccucccagcaggcacuugggagagagaggaagaccuaacaaauuucugucaucaggaaugccagguaaccgagacggagugccucuguccauacgaagcucuugugcucagaaaaccucuuuucuuagacaguauaguuaaagguaagaaaaauuuguuaaacucaacaaguuuggaaacaagcuuaucaauugaagcaccauggggagcaauaaauauccagucaaccuuuaaaccaacaguaucggcugcaaacauagcacucaguuggagcucaguggagcacagaggcaacaagaucuuagucucaggcaggucugaaucaauuaugaaacuagaggaaagaacaggagucagcuggaaucuagguguagaagaugccucugaauccaaauuacuuaccgucucuaucauggauuugucacaaauguauuccccuguuuuugaguacuugucaggagacagacagguugaagaauggccuaaagcaacuuguacaggugacugcccagaaaggugugguugcacaucaucaaccugcuugcauaaagaauggccucacucaagaaacuggagaugcaauccuacuuggugcugggggguaggaaccggcugcaccugcugcggaguggauguaaaagaccuuuuuauagaucacauguuuguuaaauggaagguugaauauauaaaaacugaagccauaguauguguugagcucaccagccaagaaagacagugcagucugauugaggcagguacuagauucaacuugggcccugugacuauuacccuauccgagccaagaaacauucagcagaagcuucccccugagauuaucacguugcaccccaaaauugaagaaggcuucuuugacuugaugcauguacaaaaaguguugucugccaguacaguguguaaacugcaaaguugcacacaugguauaccaggagaucugcaagucuaccacauuggcaaccuauugaaaggggauagaguaaacgggcaucuaauucacaaaaucgaaccacauuuuaacaccucuuggauguccugggaugguugugaccuagacuacuacugcaacaugggggauuggccuucuugcacauacacaggagugacccagcacaaucaugcugcauuuguaaacuugcuuaacauugaaacugauuacacgaaaacuuuccacuuccacucuaaaagaguuacagcacauggugaaacaccacaauuagacuuaaaagcaaggccggcauacggugcaggugagaucacugugcugguugagguugcugacauggaguugcauaccaagaaaguugagauaucaggcuugaaauuugcaagucuggcuugcacggguugcuaugcuuguagcucuggcaucuccuguaaagucaggauucauguagaugaaccagaugagcucacaguacaugugaagagcaaugauccagaugugguugcagcuagcacaagucucauggcaaggaagcuugaaucugggacagacagcacauuuaaggccuuuucagcuaugcccaaaaccucuuuauguuuuuacauuguggagagagaauacugcaagagcugcagugaagaugauacacagaaauguguugaaacaaaacuugaacagccacaaagcauacuaauugaacacaaaggaacgauaauuggaaagcagaaugauacuugcacagccaaggcaagcuguuggcuggaaucagucaagaguuuuuuuuauggauugaagaacaugcuuggcaguguuuuugguaauuuuuucauaggcauuuuguuauuccuugcccccuuuguccuguuaguacuuuucuuuauguuuggauggaaaaucuuguuuugcuuuaaauguugcaggaggaccagaggcuuguuuaaguauagacaccucaaagaagaugaggaaacaggcuacagaaggauuauugagagacugaacagcaaaaaagggaaaaacagacugcuugauggugaaagguuggcugauaggaaaauugcugagcuguucucuacaaaaacacacauuggc

SEQ ID NO: 3733 - RNA, 3495 nt, Artificial Sequence
  derived and/or modified CDS sequence (wt) from CCHVF(CCHVF 79121M18)__GU477493.1__Gn-NSm-Gc
gcagaaggaggaagcagugacugcauuucaagaacucagcuaguuaaaacggagguugcagaaauucaugaggacaguuacggugggccuggugagaaaauaacaaucugcaaugguuccacaauuguagaucaagggcuugguagugaauugggcuguuauacaaucaacagaguaagauccuacaagcuaugcgagaacagugccucagggaaaagcugugaaauagauagcaucccagucaaaugcaaacaaggguuuugccucaaaauaacccaagaaggaagaggucauguaaaacuguccagagggacagaaauuguucuagaugucugugauuccagcugugagcugaugauacccaagggcacuggagacauuuuaguggauugcucaggagggcaacagcauuuuuuacaaaacaaucugauugacuugggaugccccaaugucccauuacuggguaaaauggccauauaugucugcagaaugucaaaccacccaaaaacuaccauggcauuucuguucugguucagcuuuggcuaugucaucacauguauagcaugcaggguacucuucuacuugcugauugccaucggaacaguagggaaaaagcuaaaacaguauagagagcugaaaccacaaacaugcauugucugugaaucugucccuguuaaugcaauagaugcugaaaugcaugagcuuaauugcaguuacaauauaugcccauacugugcaucuagacugucuacagacgggcucaucaggcacguaacucagugucccaaacggagggagaagguggaagagacugagcuauucuugaacuuggaaagaauaccuuggcuggugagaaagcuccuucaaguaucagagucaacaggaauggcucuaaagagaagcuguuggaugaucacacuccucauucuacuauugguuucgauaucaccaguccaaucugcaccgguaggcaaagagagggcaaucgagaccuaucaagcaagagaaaccuacacaggcauaugccucuuuguguuaggaaguguucucuuugcgguauccuggcugacaaaggccuugauugauggcaucggcaacagcuucuccccuggacuuucugucugcaagacaugcuccauugguaguauaaauggauuugaaauagagucucauaaaugcuauugcagucuauucuguuguccuuacuguagagcuugcucauccgacaaaaacacucaccggaugcacuuaaauguuugcaaaaaaaggaagauggguagcaaugucaugcuggcugucuguaaacguaugugcuuuagagcaaccauugaggcaagcaauaaggcuuuacugaucaggagcaucauaaauuccacuuuugugauuugcauauuaauccuaacaaucugugugguaagcaccuccgcaguugauauggaaaauuugccugcaggcaucugggagaaagaagaagaucuuacaaacuucugucaccaggagugucaagugacagaaacugaaugccucugcccguaugaggccaugguacucaggaagccacucuuccuggauagcacagccaagggaaugaaaagccuguugaacuccacgagcuuagaaacaagucugucaauugaagcuccguggggagcaaucaauguccagucaacuuucaaaccaacaguuucagcugcuaacauagcacuuagcuggaguucaguugaacacaggggcaacaaaauuuuaguuucagguagaucagagucaaucaugaaauuagaagaaagaacaggagucagcuggaaucuggguguagaagaugcuucugagucaaagacgcuuacuguuuccgucauggaccugucacaaauguacucuccuguuuuugaguacuugucaggugacagacaaguggaggaauggccaaaggcaacuugcacaggugacuguccagagagaugcggcugcacuucgucaaccugcuuacauaaagaguggccacauucaagaaacuggcgauguaauccuaccugguguugggggguggggacuggcugcacuugcugugggcuggauguaaaggauuuuuuuacugacuacaugcugguaaaauggaaaguggaauauauaaagacagaagcuauagugugugucgagcugacuagucaagagaggcaguguaguuuaauugaagcaggcacaagauuuaaccuaggcccuguaacaauaacccuaucagagccaagaaauguccagcagaggcuuccucccgaaauuguaacacugcauccuaaaauagaggaagguuuuuuugauuugaugcauguacaaaaaauacugucugcaagcacaguuugcaagcuacagagcugcacacacggugugccgggcgauuuucagaucuaccaugucgguaaccugcugaggggagacaagguuaauggacacucaauucacaagauagaaccacauuuuaauacuucauggaugucaugggaugguugcgaucuggacuauuucugcaauaugggggacuggccuucaugcacauacacuggagugacacagcauaaccgugcugcauuuaucaacaugcucaacauugagacugacuauacaaaaacuuuccacuuucauucgaagagggucacggcacauggagauacuccccagcuagaccuaaaagcgagaccggcauauggugcuggcgaggucacuguucuaguggagguugcagacuuggaguugcacacaaagaaacuugaagugucagguuugaaaauugcaaguuugaccugcucuggguguuaugccugcagcucuggcaucuccugcaaaguuagaauccauguaaaugaaccagaugaauuuacaguacauguaagaaguagcgacccagauguuguagcagcaggaucaagucuuauggcaaggaaaauagaguuuggggcugacaguacauucaaggccuuuucaucaaugcccaaggacuccuuaugcuuuuacauaguagaaaaggauuacugcagcagcugcaccgacgaugacacacaaaagugugucaacacgaagcuugaccauccacagagcauacucauugagcacaaaggaacaauaauuggcaagcaaaaugacacuuguucgaccaagacaagcugcuggcuagaaucaguuaaggguuuuuucuaugggcuaaaaaacaugcuaaguggcaucuuuggaaauguuuuuuuaggcaucuucuuauuccuugcuccuuuugugcuacugauauuuuuuuucuuuuuuggguggaggcuucuguuuugucucaaauguugcagaagaacuagaggacuguugaaauacaagcaccuuaaggaugaagaggaggcuggauacaaaaaaaucauugaaaggcuaaauggcaaaaaagguaaaagucaauuguuugauggugaaaggcuugcagacaggaagauugcugagcuuuuuucuacuaaaauucacauaggu

SEQ ID NO: 3734 - RNA, 3495 nt, Artificial Sequence
  derived and/or modified CDS sequence (wt) from CCHVF(CCHVF Afg09-2990)__HM452306.1__Gn-NSm-Gc
uccgaagaaucuggugaugacugcauaucaagaacucagcuauugaggacagagacugcagagguccauggcgauaacuauggugguccaggugauaagauaaccaucuguaaugguucaacuguuguagaucaaagacuggguagugaacugggguguuacacuaucaauagagugaggucauucaagcuaugcgaaaacagugccacagggaagagcugugaaauagacaguaucccagucaaguguaagcaggguuauugccuuaaaaucacucaggaaggaaggggccaugugaaguuaucuagaggcucagaaguugucuuggauguaugugauucaagcugugaagugaugauaccuaagggcacuggugacauucuaguagauuguucaggugggcagcaacauuauuuaaaagacaaccugguugaccuagggugucccaaaauuccguuacugggcaaaauggcuauuuauaucugcaggaugucgaaucaccccaagacaaccauggccuuccucuuuugguucagcuuuggcuaugugauaacuuguauacuuugcaaggccauuuuuuucuuauugauaauuuuuggaacacuagggaaaagguucaagcaguacagagaguugaaaccccagaccugcaccauaugugagacaacaccuguaaaugcaauagaugcugaaaugcaugaucucaacugcaguuacaauauaugucccuauugugcgucuagacugacuucagaugggcuugcuaggcauguaacacaauguccuagacggaaggagaaaguggaggaaaccgaauuauaccugaauuuagagagaauucccuggguuguaagaaagcuauugcaggugucagaguccacugguacaguauuaaaaaggagcagcuggcuaauuguauuacuugugcuguucacaguuucauugucaccaguucaaucagcacccauuggucacgggaaaacaauugaaacauaccggguuagggaagaauacacaaguauuugccucuuuguacuagggaguauccuguuuauagucucuuuucuaaugaaaggacugguugacgguguuggcaacaucuucuuuccugggcuguccgucuguaagacaugcucuauagguagcauuaauggcuuugaaauugagucucauaagugcuacuguagcuuguuuuguugcccuuacuguaggcacugcucugcugauggagaaauccaucagcugcacuugagcaucugcaaaaaaaggaagacaggaaguaauguuaugcuggcuguuugcaaacgcauguguuucagggcaacuauggaaguaagcaacaaagcccuauuuauccguagcauuaucaacaccacuuuuguugugugcauacugauacuagcgguuuguguuguuagcaccucagcaguagagauggaaagcuuaccagcugggaccugggaaagagaagaagaccuaacaaauuucugccaucaggaaugccaggucacagagacugagugccucugcccuuaugaagcucuagugcucagaaggccccuauuucuagauaguauagucaaagguaugaaaaaucugcuaaacucaacaagucuagaaacaagcuuaucaauagaggcaccguggggagcaauuaauguucagucaaccuacaaaccaacuguaucaacugcaaacauagcacuuaguuggagcucaguggaacacagaggcaauaagguuuuggucucaggcagaucagaaucaauuaugaagcuggaagaaaggacaggaaucagcugggaucuuggcguggaagaugccucugagucuaagcuacuuacaguuucaguuauggacuugucucagauguacucuccugucuucgaguacuuaucaggugacagacaaguggaagaguggccuaaagcaaccuguacaggugacugcccagaaagauguggcugcacaucaucaaccugcuuacacaaagaguggccccacucaaggaauuggagauguaauccuacuuggugcugggguguagggacuggcugcaccuguugugguuuagaugugaaagaccuuuucacagauuacauguucgucaaguggaaaguugaguacauuaagacagaggccauaguauguguagaacuaaccagucaggaaagacaguguagcuugauugaggcgggcacaagauucaauuuagguucugugacuauuacauugucagaaccaaggaacauucaacaaaagcucccuccugaaauaauuacacugcaccccaagauugaggaagguuuuuuugaccuaaugcauguacaaaaagugcuaucggcaagcacaguguguaaguugcagaguugcacacauggugugccaggagaucugcaggucuaccacaucggaaaccuauuaaaaggggacagaguaaacggacaccugauucauaaaauugagcaacacuucaacacauccuggaugucuugggaugguugugaccuagacuacuacuguaacaugggagacuggccuuccugcacauauaccggagucacucagcauaaccaugcuucauuuguaaaccugcucaacauugaaacugauuauacaaaaaccuuucacuuucacucuaaaaggguuacugcacauggagacacaccacaacuagaucugaaagcaaggccaaccuauggugcaggugagaucaccgugcugguggaaguugcugacauggaguuacacacaaagaagauugaaauaucaggcuuaaaauuugcaggccuaacuugcacagguuguuaugcuuguaguucuggcaucucuuguaaaguuagaauucauguagaugaaccagaugaacuuacaguacauguuaaaagugaugacccagauguaguugcagcuagcucaagucucauggcgaggaagcuugaauuuggaacagacaguacauuuaaagcuuucucagccaugccuaaaaccucccuauguuucuacauuguggaaagagaauacuguaagagcugcaguaaagaagauacacaaaaauguguuaacacgaaacucgaacaaccacagagcauuuugaucgaacauaagggaacuauaauuggaaagcaaaacaauacuugcacggcuaaagcgaguugcugguuagagucaguuaagaguuucuuuuauggucugaagaauaugcucgguggcauauuuggcaauguuuuuauaggcauuuucacauuucuuacccccuuuaucuuguuaauacuuuucuuuauguuuggguggaggauccuguuuugcuucaaguguugcagaagaaccagaggccuauucaaguacagacaccucaaagacgaugaagaaacugguuacagaaagaucauugaaagacugaacaacaaaaaaggaaaaaacaggcugcuugauggugaaagacuugcugacagaaagauugcugaacuguucuccacaaaaacacacauuggc

SEQ ID NO: 3735 - RNA, 3495 nt, Artificial Sequence
  derived and/or modified CDS sequence (wt) from CCHVF(CCHVF Sudan Al-Fulah 3-2008)__HQ378184.1__Gn-NSm-Gc
uccgaagaacccagugaugacugcauaucaagaacucaacuauugaggacagagacugcagaaauccacggcgacaacuaugguggcccgggugacaaaauaaccaucugcaacggcucaacuauuguagaccaaagacugggcagugaguuaggguguuacacuaucaauagagugaagucauucaagcuaugugaaaauagugccacugggaagagcugugugauagacagugucccaguuaaaugcaggcaggguuauugccuaaggauuacucaagaaggaaggggccauguaaaauuaucuaggggcucagagguugucuuagaugcaugcgauacaagcugugaaauaaugauaccuaagggcaccggugacauccuaguugacuguucaggugggcagcaacauuuucuaaaggacaauuugguagaucuaggaugccccaaaaucccauuacugggcaaaauggcuaucuacauuugcagaaugucgaaucaccccaaaacaaccauggcuuuccucuucugguucagcuuuggcuauguaauaacuuguauacuuugcaaggccaucuuuuacuuguuaauaauuauuggaacacuagggaaaagguucaggcaguauagagaguuaaagccucagaccugcaccauaugugagacaacuccuguaaaugcaauagaugcugagaugcaugaccucaauugcaguuacaacauuugucccuacugugcaucuagacuaaccucggaugggcuugcuaggcaugugacacagugcccuaagcggaaggagaaaguggaagaaacugaacuguacuugaacuuagaaagaauuccuuggguugugagaaagcuguugcagguaucagaguccaccgguguggcauugaaaagaagcagcuggcugauugugcugcuugugcuguucacgguuucauugucgccaguucaaucagcacccauuggucacgggaagacgauugaggcauaccgugccagggagggauacacaaguauaugucucuuuguacuaggaaguauccuauuuauagucucuugccuaaugaaaggguugguugacaguguuggcaacuccuucuucccuggacuguccauuugcaaaacgugcuccauaagcagcauuaauggcuuugaaauugagucccauaagugcuauugcagcuuguucuguugccccuauuguaggcacugcucugcugauaaagaaauucacaagcugcacuugagcaucugcaaaaaaaggaaaacaggaaguaaugucauguuggcuguuugcaagcgcauguguuucagggccaccauggaaguaaguaacagagcccuguuuauucguagcaucaucaauaccacuuuuguuuugugcauacugauacuagcaguuuguguuguuagcaccucagcaguggagauggaaaaccuaccagccgggacuugggaaagagaagaagaccuaacaaauuucugucaucaggaaugccaaguuacagagacugaaugccucugcccuuaugaagcucuaguacucagaaggccucuauuccuagacaguauaguuaaaggcaugaaaaaucugcuaaacucaacaaguuuagaaacaagucugucaauugaggcaccauggggggcaauaaauguucagucaaccuacaagccaacugugucgacugcaaauauagcacucagcuggagcucaguggaacacagaggcaauaagaucuugguuucaggcagaucagaaucaauuaugaagcuggaagaaaggacagggaucagcugggaucucggcguagaagacgccucugagucuaaacugcuuacagucucuguuauggauuugucucagauguacucuccugucuucgaguacuuaucaggagacagacagguggaggaguggcccaaagcaacuugcacaggugacugcccagaaagauguggcugcacaucaucaacaugucugcacaaagaauggccccacucaagaaauuggagaugcaaucccacuuggugcugggguguagggacuggcugcaccugcuguggauuagaugugaaagaccuuuuuacagauuauauguuugucaaguggaaaguugaauacaucaagacagaggccauaguguguguagaacucaccagucaggaaaggcaguguagcuugauugaagcaggcacaagguucaauuuagguccugugaccaucacacugucagaaccaagaaacauccaacagaagcucccuccugaaauaaucacacuacauccuaggauugaagaagguuuuuuugaccugaugcacguucagaaaguguuaucagcaagcacaguguguaaguugcagaguugcacacaugguguaccaggagaccuacaggucuaccacaucggaaauuuauuaaaaggggacaagguaaauggacaucuaauucauaaaauugagccacacuucaacacuuccuggauguccugggaugguugugaccuagacuacuacugcaacaugggagauuggccuucuugcacauacacaggagucacccaacacaaucaugcuucauuuguaaaccugcucaacauugaaacugauuacacaaaaaacuuccacuuucacucuaaaagggucacugcacacggagacacaccacaacuggaucuuaaggcaagaccaaccuauggugcaggugagauuacuguacugguagaaguugcugacauggaguuacacacaaagaagauugaaauaucgggcuuaaaauuugcaagcuugacuugcacagguuguuaugccuguagcucuggcaucucaugcaaaguuagaauucauguagacgaaccagaugaacuuacagugcauguuaaaagugaugauccagauguaguugcagcuagcucaagccucauggcaagaaagcuugaauuuggaacagacaguacauuuaaagcuuuuucagccaugccuaaaacuucgcuauguuucuacauuguugaaaaagaauacugcaagagcugcagugaagaagacacaaaaaaauguguuaacacaaaacuugagcaaccacagagcauuuugaucgaacacaagggaacuauaaucggaaagcaaaacagcacuugcacagccaaggugaguugcugguuagagucagccaagaguuuuuuuuauggucuaaaggacaugcuuaguggcauuuuuggcaaugucuuuauagguauuuucuuauuccuugcccccuucguccuguuagugcuguucuuuauguuuggguggaggauccuacuuugcuuuagauguuguagaagaacuagaggccuguucaaguauagacaccucaaggacgaugaagaaacugguuauagaaggauuauugaaagacuaaacaauaaaaagggaaaaaacaaacugcuugauggugaaagacuugcugauagaaaaauugcugaacuguucuccacaaaaacacacauuggu

SEQ ID NO: 3736 - RNA, 3495 nt, Artificial Sequence
  derived and/or modified CDS sequence (wt) from CCHVF(CCHVF Sudan AB1-2009)__HQ378187.1__Gn-NSm-Gc
ucugaagaacccagugaugacuguauaucaagaacucaacuacugaggacagagacugcagagauccacggcgauaacuaugguggcccgggugacaaaauaaccaucugcaauggcucaacuauuguagaccaaagacugggcagugaacuaggguguuacaccaucaauagaguaaagucauucaagcuaugcgaaaacagugccacagggaagaauugugaaauagacagugucccaguuaaaugcaggcaggguuauugccuaagaaucacucaggaagggaggggccacguaaaauuaucuaggggcucagagguugucuuagaugcaugcgacacaagcugugaaauaaugauaccuaagggcacuggugacauccuaguugacuguucaggcgggcagcaacauuuucuaaaggacaauuugauagaucuaggaugccccaaaauuccauuauugggcaaaauggcuauuuacauuugcagaaugucgaaccaccccaaaacaaccauggcuuuccucuucugguucagcuuuggcuauuuaauaaccugcauacuuugcaaggccauuuuuuacuuguugauaauuauuggaacacuagggaaaaggcucaagcaguauagagaguugaaaccucagaccugcaccauaugugagacaacuccuguaaaugcaauagaugcugagaugcaugaccucaauugcaguuacaacauuugccccuacugugcaucuagacuaaccucagaugggcuugcuaggcaugugauacaaugcccuaagcggaaggagaaaguggaagaaacugaacuguacuugaaccuagaaagaauuccuuggguuguaagaaagcuguugcaggugucagagucaacugguguagcauugaaaagaagcaguuggcugauugugcugcuugugcuauucacuguuucauugucaccaguucaaucagcacccauuggucaagggaagacaauugaagcauaccgggccagggagggguacacaaguauaugucucuuuguacuaggaaguauccuauuuauaguuucuugccuaaugaaagggcugguugacaguguuggcaacuccuucuucccuggacuguccauuugcaaaacgugcuccauaagcagcauuaauggcuuugaaauugagucccauaagugcuauugcagcuuauucuguugccccuauuguaggcacuguucuaccgauaaagaaauucauaagcugcacuugagcaucugcaaaaaaaggaaaacaggaaguaaugucauguuggcugucugcaagcgcauguguuucagggccaccauggaaguaagcaacagagcccuguuuauccguagcaucaucaacaccacuuuuguuuugugcauacugauacuagcaguuuguguuguuaguaccucagcaguggagauggaaaaccuaccagcagggaccugggaaagagaagaagaccugacaaauuucugucaucaggaaugucagguuacagagacugaaugccucugcccuuaugaagcucuaguacucagaaagccuuuauucuuagauaguauagcuaaaggcaugaaaaaucugcuaaauucaacaaguuuagaaacgaguuuaucaauugaggcaccauggggagcaauaaauguucagucaaccuacaaaccaacugugucaacugcaaacauagcacucaguuggagcucaguggaacacagaggcaauaagaucuugguuucaggcagaucagaaucaauuaugaagcuggaagaaaggacaggaaucagcugggaucuuggcguagaagaugccucugagucuaaacugcuuacagucucugucauggacuugucucagauguacucuccugucuucgaguacuuaucaggugacagacagguggaagaguggcccaaagcaaccuguacaggugacugcccagaaagauguggcugcacaucaucaaccuguuugcacaaagaauggccucacucaagaaauuggagaugcaaucccaccuggugcugggguguagggacuggcugcaccuguuguggauuagaugugaaggaccuuuuuacagauuacauguuugucaaguggaaaguugaauacaucaagacagaggccauaguguguguagaacuuacuagucaggaaaggcaguguagcuugauugaagcgggcacaagguucaauuuggguccugugaccaucacacugucagaaccaagaaacauccaacaaaaacucccuccugaaauaaucacacuacauccuaggaucgaagaagguuuuuuugaccugaugcauguacaaaagguguuaucggcaagcacaguguguaaguugcagaguugcacacauggugugccaggagaccuacaggucuaccacaucggaaauuuauuaaaaggggauaagguaaaugggcaucuaauucauaaaauugagccacacuucaacaccuccuggauguccugggaugguugugaccuagacuacuacugcaacaugggagauuggccuuccugcacauacacaggggucacccaacacaaucaugcuucauuuguaaacuuacucaacauugaaacugauuacacaaagaauuuccacuuucacucuaaaagggucacugcacacggagauacaccacaacuagaucuuaaggcaagaccaaccuauggugcaggugagaucacuguucugguagaaguugcugacauggaguuacauacaaagaagauugagauaucaggcuuaaaauuugcaagcuugacuugcacagguuguuaugcuugcagcucugguaucucaugcaaaguuagaauucauguggaugaaccagaugaacuuacaguacauguuaaaagugaugauccagaugugguugcagcuagcucaagucucauggcaagaaagcuugaauuuggaacagacaguacauuuaaagcuuucucggccaugccuaaaacuucuuuauguuucuacauuguugaaagggaacacuguaagagcugcaaugaagaagacacaaaaaaauguguuaacacaaaacuugagcaaccacaaagcauuuugaucgaacacaagggaaccauaaucggaaagcagaacagcacuugcacggcuagggcgaguugcugguuggagucagucaagaguuucuuuuauggccuaaagaacaugcuuaguggcauuuuuggcaaugucuuuaugggcaucuucuuauuccuugcccccuucauccuguuaauacuauucuuuauguuuggguggaggauccuauucugcuuuaaauguuguagaagaaccagaggccuguucaaguauagacaccucaaagacgaugaagaaacugguuauagaaggauuauugaaagacuaaacaauaaaaaaggaaaaaacaaacugcuugauggugaaagacuugcugauagaagaauugccgaacuguucucuacaaaaacacacauuggc

SEQ ID NO: 3737 - RNA, 3495 nt, Artificial Sequence
  derived and/or modified CDS sequence (wt) from CCHVF(CCHVF NIVA 118595)__JN572083.1__Gn-NSm-Gc
uccgaagaaucuggugaugacugcauaucaagaacucagcuauuaaggacagagacugcagagguccauggcgacaacuauggugguccgggugauaagauaaccaucugcaaugguucaacuguuguagaucaaagacuggguagugaacugggguguuacacuaucaauagagugaaguccuuuaagcuaugcgaaaacagugccacagggaagagcugugaaauagacaguaucccaguuaaguguaggcaggguuauugccuaaaaaucacucaggaaggaaggggccauguuaaauuaucuagggguucagaaguugucuuggaugcaugugacucaagcugugaagugaugauaccuaagggcacuggugacauucuaguagauuguucaggugggcagcaacauuuuuuaaaggacaaccugauugaucuaggaugucccaaaauuccauuauugggcaaaauggcuauuuauaucugcagaaugucgaaucaccccaaaacaaccauggccuuucucuuuugguucagcuucggcuaugugauaacuuguauacuuugcaagguaauuuuuuacuuauuaauaauuuuuggaacacuagggaaaagguucaagcaguacagagaguugaaaccccagaccugcaccauaugugagacaacaccugugaaugcaauagaugcugaaaugcaugaucuuaacugcaguuacaauauaugucccuauugugcgucuaggcuaacuucagaugggcucgcuaggcauguaacacaaugcccuaagcggaaggagaagguggaagagaccgaauuguacuugaacuuagagagaauuccuuggguuguaagaaagcuauugcaggugucagaguccacuggcauagcauuaaaaaggagcagcuggcuaauugugcugcuuguguuauucacaguaucaauaacaccgguucaaucagcgcccauuggucacgggaagacaauugaagcguaccgggcuagggaggaauacacaagcauuugucucuuugugcugggaagugucuuguuuguggucucuugucuaaugaaaggacugguugacaguguuggcaauaucuucuuuccugggcuguucauuuguaagacauguucuauagguagcauuaauggcuuugaaauugagucucauaagugcuauuguagcuuguuuuguugcccuuacuguaggcacugcucugcugauagagaaauucaucagcugcacuugagcaucugcaaaaaaaggaagacaggaaguaaugucaugcuggcuguuugcaaacgcauguguuucagaacaacuauggaaguaagcaacaaagcccuauuuguccgaagcaucaucaacaccacuuuuguugugugcauacugauacuagcagucuguguuguuagcacuucagcaguagagauggaaagccuaccagcugggaccugggaaagagaagaagaccuuacaaauuucugccaucaggaaugccaggucacggagacugagugccucugccccuaugaagcucuagugcucagaaggccccuauuucuagauaguauagucaaagguaugaaaaaucugcuaaacucaacaagucuagaaacaagcuuaucaauugaggcaccguggggagcaauuaauguucagucaaccuacaaaccaacuguaucagcagcaaacauagcacucaguuggagcucaguggaacacagaggcaauaagauuuuggucucaggcagaucagaaucaauuaugaagcuggaagaaaggacaggaaucagcugggaucucggcguagaagaugccucugagucuaagcuacuuacagucucagucauggacuugucucagauguacucuccugucuucgaguauuuaucaggugacagacaaguggaagaguggccuaaagcgaccuguacaggugacugcccagaaagauguggcugcacaucaucaaccugcuuacacaaagaguggccccacucaaggaauuggagauguaauccuacuuggugcugggguguagggacuggcugcaccugcuguggauuggaugugaaagaccuuuucacagauuacauguucgucaaguggaaaguugaguacauuaagacagaggccauaguauguguagaacuaaccagucaggaaagacaguguagcuugauugaggcgggcacaagauuuaauuuagguucugugaccauuacauugucagaaccaaggaacauucaacaaaagcucccuccugaaauaaucacacugcauccuagaauugaggaagguuuuuuugaccuaaugcaugugcaaaaagugcuaucagcaagcacaguguguaaguuacaaagcugcacacauggugugccaggagaucuacaggucuaccacauuggaaaccuauuaaaaggggacagaguaaacggacaccuaauucacaaaauugaacaacaccucaacacuucuuggauguccugggaugguugugaucuagacuacuacugcaauaugggagacuggccuucuugcacauauacaggagucacccaacauaaucaugcuucauuuguaaaccugcucaacauugaaacugauuacacaaaaaccuuccacuuucacucuaaaaggguuacugcacauggagacacaccacagcuagaucugaaggcaaggccaaccuauggugcaggugagaucacuguacugguggaaguugccgauauggaguuacacacaaagaagauugaaauaucaggcuugaaguuugcaagccuauccugcacagguuguuaugcuuguaguucuggcaucuccugcaaagucagaauucauguagaugaaccagaugaacuuacaguacauguuaaaagugaugauccagauguaguugcagcuagcucaagucucauggcaaggaagcuugaaucuggaacagacaguacauuuaaagcuuuuucagccaugccuaaaacuuccuugugcuucuacauuguagagagagaauacuguaagggcugcaguaaagaagacacacaaaaauguguuaacacgaaacucgagcaaccacagagcauuuugaucgaacacaagggaacuauaauuggaaagcaaaacaauacuugcacagcuaaggcaaguugcugguuagagucaguuaagaguuuuuuuuauggucugaagaauaugcuuaguggcauuuuuggcaauguuuuuuuaggcauuuucucauuucuugcccccuuuguccuauuaauacuuuucuuuauguuuggguggaggauccuguuuugcuucaaguguugcagaagaaccagaggccuauucaaguacagacaccucaaagacgaugaagaaacugguuacagaaagaucauugaaagacugaacaacaaaaaggggaaaaacaaacugcuugauggugaaaggcuugcugacagaaaaauugccgaacuguucuccacaaaaacacacauuggc

SEQ ID NO: 3738 - RNA, 3495 nt, Artificial Sequence
  derived and/or modified CDS sequence (wt) from CCHVF(CCHVF NIV 112143)__JN572085.1__Gn-NSm-Gc
uccgaagaaucuggugaugacugcauaucaagaacucagcuauuaaggacagagacugcagagguccauggcgacaacuauggugguccgggugauaagauaaccaucugcaaugguucaacuguuguagaucaaagacuggguagugaacugggguguuacacuaucaauagagugaaguccuuuaagcuaugcgaaaacagugccacagggaagagcugugaaauagacaguaucccaguuaaguguaggcaggguuauugccuaaaaauuacucaggaaggaaggggccauguuaaauuaucuaggggcucagaaguugucuuggaugcaugugacucaagcugugaagugaugauaccuaagggcacuggugacauucuaguagauuguucaggugggcagcaacauuuuuuaaaggacaaccugauugaucuaggauguccuaaaaucccauuauugggcaaaauggcuauuuauaucugcagaaugucgaaucaccccaaaacaaccauggccuuucucuuuugguucagcuucggcuaugugauaacuuguauacuuugcaagguaauuuuuuacuuauuaauaauuuuugggacacuagggaaaagguucaagcaguacagagaguugaaaccccagaccugcaccauaugugagacaacaccugugaaugcaauagaugcugaaaugcaugaucuuaacugcaguuacaauauaugucccuauugugcgucuaggcuaacuucagaugggcucgcuaggcauguaacacaaugcccuaagcggaaggagaagguggaagagaccgaauuguacuugaacuuagagagaauuccuuggguuguaagaaagcuauugcaggugucagaguccacuggcauagcauuaaaaaggagcagcuggcuaauugugcugcuuguguuauucacaguaucaauaacaccgguucaaucagcgcccauuggucacgggaagacaauugaagcguaccgggcuagggaggaauacacaagcauuugucucuuugugcugggaagugucuuguuuguggucucuugucuaaugaaaggacugguugacaguguuggcaauaucuucuuuccugggcuguucauuuguaagacauguucuauagguagcauuaauggcuuugaaauugagucucauaagugcuauuguagcuuguuuuguugcccuuacuguaggcacugcucugcugauagagaaauucaucagcugcacuugagcaucugcaaaaaaaggaagacaggaaguaaugucaugcuggcuguuugcaaacgcauguguuucagagcaacuauggaaguaagcaacaaagcccuauuuguccgcagcaucaucaacaccacuuuuguugugugcauacugauacuagcaaucuguguuguuagcacuucagcaguagagauggaaagccuaccagcugggaccugggaaagagaagaagaccuuacaaauuucugccaucaggaaugccaggucacggagacugagugccucugccccuaugaagcucuagugcucagaaggccccuauuucuagauaguauagucaaagguaugaaaaaucugcuaaacucaacaagucuagaaacaagcuuaucaauugaggcaccguggggagcaauuaauguucagucaaccuacaaaccaacuguaucagcagcaaacauagcacucaguuggagcucaguggaacacagaggcaauaagauuuuggucucaggcagaucagaaucaauuaugaagcuggaagaaaggacaggaaucagcugggaucucggcguagaagaugccucugagucuaagcuacuuacagucucagucauggacuugucucagauguacucuccugucuucgaguauuuaucaggugacagacaaguggaagaguggccuaaagcgaccuguacaggugacugcccagaaagauguggcugcacaucaucaaccugcuuacacaaagaguggccccacucaaggaauuggagauguaauccuacuuggugcugggguguagggacuggcugcaccugcuguggauuggaugugaaagaccuuuucacagauuacauguucgucaaguggaaaguugaguacauuaagacagaggccauaguauguguagaacuaaccagucaggaaagacaguguagcuugauugaggcgggcacaagauuuaauuuagguucugugacuauuacauugucagaaccaaggaacauucaacaaaagcucccuccugaaauaaucacacugcauccuagaauugaggaagguuuuuuugaccuaaugcaugugcaaaaagugcuaucagcaagcacaguguguaaguuacaaagcugcacacauggugugccaggagaucuacaggucuaccacauuggaaaccuauuaaaaggggacagaguaaacggacaccuaauucacaaaauugaacaacaccucaacacuucuuggauguccugggaugguugugaucuagacuacuacugcaauaugggagacuggccuucuugcacauauacaggagucacccaacauaaucaugcuucauuuguaaaccugcucaacauugaaacugauuacacaaaaaccuuccacuuucacucuaaaaggguuacugcacauggagacacaccacagcuagaucugaaggcaaggccaaccuauggugcaggugagaucacuguacugguggaaguugccgauauggaguuacacacaaagaagauugaaauaucaggcuugaaguuugcaagccuauccugcacagguuguuaugcuuguaguucuggcaucuccugcaaaguuagaauucauguagaugaaccagaugaacuuacaguacauguuaaaagugaugauccagauguaguugcagcuagcucaagucucauggcaaggaagcuugaauuuggaacagacaguacauuuaaagcuuuuucagccaugccuaaaacuuccuugugcuucuacauuguagagagagaauacuguaagggcugcaguaaagaagacacacaaaaauguguuaacacgaaacucgagcaaccacagagcauuuugaucgaacacaagggaacuauaauuggaaagcaaaauaauacuugcacagcuaaggcaaguugcugguuagagucaguuaagaguuuuuuuuauggucugaagaauaugcuuaguggcauuuuuggcaauguuuuuuuaggcauuuucucauuucuugcccccuuuguccuauuaauacuuuucuuuauguuuggguggaggauccuguuuugcuucaaguguugcagaagaaccagaggccuauucaaguacagacaccucaaagacgaugaagaaacugguuacagaaagaucauugaaagacugaacaacaaaaaggggaaaaacaaacugcuugauggugaaaggcuugcugacagaaaaauugccgaacuguucuccacaaaaacacacauuggc

SEQ ID NO: 3739 - RNA, 3495 nt, Artificial Sequence
  derived and/or modified CDS sequence (wt) from CCHVF(CCHVF SCT ex Afghanistan)__KC344856.1__Gn-NSm-Gc
ucugaagagucuggugacgacuguauaucgaggacucagcuauugaggacagagacugcagagguccauaaugauaacuauggugguccaggugacaaaauuaccaucugcaacgguucaaccauuguagaucagagacuuggcagugaacugggguguuauacuaucaacagagugaagucauucaagcuaugcgaaaauagcgccacgggaaaguccuguaaaauagacagcaccccgguuaagugcaggcaagguuuuugcuuaaaaaucacucaggaaggaaggggccaugugaagcuaucgagaggcucagaaguugucuuagaugccugcgauucaagcugugaaauaaugauaccgaagggcacuggagacauccuaguggacuguucaggugggcagcaacauuucuuaaaagauaauuugauugaucuaggaugcccuaacauuccacuauuagguaaaauggcuaucuauauuuguagaaugucaaaucaucccaaaacaacuauggcuuuucucuuuugguucaguuuugguuauguaauaacauguauauuuugcaaagucauuuuuuauuuauugauaguuguggggacauugggaaaaaaguucaaacaguaucgagagcugaaaccucagacuuguacaauaugugaaacaacuccuaccaaugcaauagaugcugaaaugcacgaucuuaacugcaguuacaauauauguccuuauugugcaucuagauuaaccucggacgggcuugccaggcaugugacacaaugcccuaagcgaaaggaaaaaguagaagagacugaguuguacuugaacuuggaaagaauuccuuggauugucagaaaacuacugcaggugucagagucuacagguguggcacugaagaggagcaguuggcuaauuguguuacuugugcuacuuacaguuucauugucaccgguucaaucggcacccaucgggcauggaaagacaauugagacauaucagaccagagagggguauauaaguguuugccuguuugugcuagggggcauacuguuuguagucuccugccugaucaaaggacugguugacagugucggcaacaguuuuuuuccuggguuaucuauuugcaagacauguucuaucggcaguguaaauggcuuugaaauugaaucccauaaauguuacuguagcuuacuuuguugcccuuauuguagacacugcucuacugauagggagauccaccaauugcacuugagcaucugcaaaaaaagaaggacagggggcaaugucauguuggcugucugcaagcgcaugugcuucagagcaacuauggaaguaagcaacaagguccuauuuauccgaaacaucaucaauaccaccuuuguuauaugcauacugauauuagcagucugugucguuagcaccucugcaguagagauggaaagccuacccgccggcacuugggaaagggaagaagaccuaacaaacuucugccaccaagaaugccaagucacagagacugaaugucucuguccuuacgaagcucuuguacucaggaaaccccuuuucuuaaacaguauagucaagggcaugaaaaaccugcuaaauucaacuaacuuggaaacaagcuuaucaaucgaagcaccauggggagcaauaaauguccagucaaccuuuaaacccacuguaucaacugcaaacauagcacucagcuggaguucaguggaacacagagguaauaaaauucuagucucaggcagaucagagucaauuaugaagcuagaagaaaggacaggaaucagcugggauuugggcguagaagaugccucugagucuaaaucgcuuacuguuucugucauggauuuaucacagauguauucuccugucuucgaguaucugucaggugacagacagguagaggaguggccuaaagcaaccugcacaggcgauugcccggagagauguggcugcacaucaucaaccugcuuacacaaggaauggccccauucaaggaauuggagaugcaaccccacuugguguuggggagucggcacuggaugcaccugcugugggcuagaugugaaagaccuuuucacagauuauauguuugucaaguggaagguugaauacauaaagacagaggccauaguguguguugagcucacuagccaagaaaggcagugcagcuugauugaggcaggaacaagguucaacuuagguccugugaccaucacguugucagagccaagaaacauucagcagaagcuuccuccugaaauaaucacauugcauccuagaauugaggaaggcuuuuucgaucuaaugcauguacaaaaggugcugucugcaaguacagugugcaagcugcaaagcugcacacaugguguuccaggagacuugcaggucuaccacauuggcaacuuguuaaaaggggauaaguuaaacgggcauaugauucacaaaauugagccacacuucaauaccucuuggauguccugggauggcugugaccuagacuauuacuguaauaugggggauuggcccucuugcacauacacuggggugacccaacauaaccaugcugcuuuuguuaacuuacuuaacaucgaaacugauuacacaaagaacuuccacuuucacucuaaaagaguuacugcacauggagacacaccacaauuggacuugaaagcuagaccaacuuacggugcgggugaaaucacuguacuaguggaaguugcugacauggaguuacacacaaaaaagauugauauaucagguuugaaauuugcaagucuaacuugcgcggguugcuaugcuuguagcucuggcaucuccuguaaagucaggauucauguagaugaaccugaugagcuuacaguacaugugaaaagugaagauccggacauuguugcagcuagcacaagccucauugcaaggaagcucgaacuugggacagacagcacauucaaggccuucucagccaugcccaaaaccuccuugugcuucuacauuguggagagagaauacuguaagagcugcagcaaagaggacacacagaaauguguuaacacaaagcuugagcacccacaaggcauuuuaauugagcacaaaggaacaauaaucggaaagcaaaaugacaccugcacagccaaagcaggcugcugguuggagucagucaagaguuuuuuuuauggauugaagaacaugcuuaguggcaucuucggcaacguuuuuauagguauuuucuuauuccuugcuccuuuuguucuauugauacucuucuuuauguuuggguggagacuccuguuuugcuuuaaguguuguagaagaaccagagguuuauucaaguacagacaucucaaggaagaugaagaaucugguuauagaagaaucauugaaagauuaaacaacaaaaaaggaaagaacaagcugcuugauggugaaagacuagcugauagaaggaucgcugagcuguucuccacaaaaacacauauuggu

SEQ ID NO: 3740 - RNA, 3495 nt, Artificial Sequence
  derived and/or modified CDS sequence (wt) from CCHVF(CCHVF Zahedan 2007)__KC867273.1__Gn-NSm-Gc
uccgaagaaucuggugaugacugcauaucaagaacucagcuauugaggacagagacugcagagguccauggcgauaacuauggugguccaggugauaagauaaccaucuguaaugguucaacuguuguagaucaaagacuggguagugaacugggguguuacacuaucaauagagugaggucauucaagcuaugcgaaaacagugccacagggaagagcugugaaauagacaguaucccagucaaguguaagcaggguuuuugccuaaaaaucacucaggaaggaaggggccaugugaaguuaucuagaggcucagaaguugucuuggauguaugugauucaagcugugaagugaugauaccuaagggcacuggugacauucuaguggauuguucaggugggcagcaacauuuuuuaaaagacaaccugguugaccuagggugucccaaaauuccguuacugggcaaaauggcuauuuauaucugcaggaugucgaaucaucccaagacaaccauggccuuccucuuuugguucagcuuuggcuaugugauaacuuguauacuuugcaaggccauuuuuuucuuauuaauaauuuuuggaacacuagggaaaagguucaagcaguacagagaguugaaaccccagaccugcaccauaugugagacaacaccuguaaaugcaauagaugcugaaaugcaugaucucaacugcaguuacaauauaugucccuauugugcgucuagacugacuucagauggacuugcuaggcaugugacacaauguccuagacggaaggagaaaguggaggaaaccgaauuauaccugaauuuagaaagaauucccuggguuguaagaaagcuauugcaggugucagaguccacugguacaguauuaaaaaggagcagcuggcuaauuguauuacuugugcuguucacaguuucauugucaccaguucaaucagcacccauuggucacgggaaaacaauugaaacauaccggguuagggaagaauacacaaguauuugccucuuuguacuaggaaguauccuguuuauagucucuuuucuaaugaaaggacugguugacgguguuggcaacaucuucuuuccugggcuguccgucuguaagacaugcucuauagguagcauuaauggcuuugaaauugagucucauaggugcuacuguagcuuguuuuguugcccuuacuguaggcacugcucugcugauggagaaauccaucagcugcacuugagcaucugcaaaaaaaggaagacaggaaguaacguuaugcuggcuguuugcaaacgcauguguuucagggcaacuauggaaguaagcaacaaaguccuauuuauccguagcauuaucaacaccacuuuuguugugugcauacugauacuagcgguuuguguuguuagcaccucagcaguagagauggaaagccuaccagcugggaccugggaaagagaagaagaccuaacaaauuucugccaucaggaaugccaggucacagagacugagugccucugcccuuaugaagcucuagugcucagaaggccccuauuucuagauaguauagucaaagauaugaaaaaucugcuaaacucaacaagucuagaaacaagcuuaucaauugaggcaccauggggagcaauuaauguucagucaaccuacaaaccaacuguaucaacugcaaacauagcacuuaguuggagcucaguggaacacagaggcaauaagguuuuggucucaggcagaucagaaucaauuaugaagcuggaagaaaggacaggaaucagcugggaucuuggcguggaagaugccucugagucuaagcuacuuacaguuucagucauggacuugucucagauguacucuccugucuucgaguacuuaucaggugacagacaaguggaagaguggccuaaagcaaccugcacaggugacugcccagaaagauguggcugcacaucaucaaccugcuuacacaaagaguggccccacucaaggaauuggagauguaauccuacuuggugcugggguguagggacuggcugcaccuguugugguuuagacgugaaagaccuuuucacagauuacauguucgucaaguggaaaguugaguacauuaagacagaggccauaguauguguagaacuaaccagucaggaaagacaguguagcuugauugaggcgggcacaagauucaauuuagguucugugacuauuacauugucagagccaaggaacauucaacaaaagcucccuccugaaauaaucacacugcaccccaagauugaggaagguuuuuuugaccuaaugcauguacaaaaagugcuaucggcaagcacaguguguaaguugcagaguugcacacauggugugccaggagaucugcaggucuaccacaucggaaaccuauuaaaaggggacagaguaaacggacacuugauucauaaaauugagcaacacuucaacacauccuggaugucuugggaugguugugaccuagacuacuacuguaacaugggagacuggccuuccugcacauauaccggagucacucagcauaaccaugcuucauuuguaaaccugcucaacauugaaacugauuauacaaaaaccuuucacuuucacucuaaaaggguuacugcacauggagacacaccacaacuagaucugaaggcaaggccaaccuauggugcaggugagaucaccgugcuuguggaaguugcugacauggaguuacacacaaagaagauugaaauaucaggcuuaaaauuugcaggccuaacuugcacagguuguuaugcuuguaguucuggcaucucuuguaaaguuagaauucauguagaugaaccagaugaacuuacaguacauguuaaaagugaugacccagauguaguugcagcuagcucaagucucauggcgaggaagcuugaauuuggaacagacaguacauuuaaagcuuucucagccaugccuaaaaccucccuauguuucuacauuguggaaagagaauacuguaagagcugcaguaaagaagauacacaaaaauguguuaacacgaaacucgaacaaccacagagcauuuugaucgaacauaagggaacuauaauuggaaagcaaaacaauacuugcacggcuaaagcgaguugcugguuagagucaguuaagaguuuuuuuuauggucugaagaauaugcucgguggcauauuuggcaauguuuuuauaggcauuuucacauuucuuacccccuuuaucuuguuaauauuuuucuuuauguuuggguggaggauccuguuuugcuucaaguguugcagaagaaccagaggccuauucaaguacagacaccucaaagacgaugaagaaacugguuacagaaagaucauugaaagacugaacaacaaaaagggaaaaaacaggcugcuugauggugaaagacuugcugacagaaagauugcugaacuguucuccacgaaaacacacauuggc

SEQ ID NO: 3741 - RNA, 3495 nt, Artificial Sequence
  derived and/or modified CDS sequence (wt) from CCHVF(CCHVF SPU 44/08)__KJ682805.1__Gn-NSm-Gc
ucugaagagucuaaugaugacuguuuaucaaggacucagcuauugaggacagagaaugcggaaauucacagugacaacuauggugguccaggugacaagauaacuaucugcaacgguucaacuauuguagaucagagauugggcagugaacuaggguguuacacuaucaauagagugaaaucauuuaagcucugcgaaaacagugcuacagguaaaucuugugaaauagauagcaccccagucagauguaggcaggguuuuugcuugaaaauuacucaggagggaaggggccacgugaagcuaucaagaggcucagaaguugucuuggacgccugugacucaagcugugaaauaaugauaccaaagggcacuggggacauccuaguugacugcucaggugggcagcaacauuuccuaaaagauaaccugguugauuuaggaugccccaacaucccacuguuaggcaaaauggccaucuacauuuguagaaugucaaaucaucccaagacaacuauggcuuuccuuuuuugguuuagcuuugguuaugugauaaccuguauacuuuguaaagcaaucuucuaucuauuaauaguuguagggacauuaggaaaaaaguucaaacaguacagagaguuaaaaccucagaccuguaccauaugugaaacaaauccuguuaaugcaauagaugcugagaugcacgaccucaacugcaguuacaauauauguccuuauugugcaucuagguuaaccucagauggucuugccagacauguaaugcaaugccccaaacggaaggaaaaaauagaagaaaccgaauuauauuuaaacuuagaaagaaucccuuggguuguuaggaaauuacugcaggugucagaauccaccgguguagcacuaaagaggaguaguuggcugguuauacuacuugugcugcucacaguuucauugucaccaguacaaucagcacccaucagccauggagagacagucgaaguauaucaaaccagagaaggguacacaaguauuugccuuuuuguacuaggaagcauccuguuuuugguauccugccugaugaggggguugguugacagugucagcaauagcuuuuucccuggcuuguccauuuguaagacauguucuauuggcaguauaaacggcuuugaaauugaaucucacaaauguuacuguagccuauuuugcugccccuacuguagacacugcucugccgacauagaaauacauaaguugcacuugagcaucugcaagaaaaggaaaacugggaguaaugucauguuagccgucuguaagcgcaugugcuuuagggcaacuguggaaguuagcaauaaagcuuuacuuauccgaaacaucaucaacaccacuuuuguugugugcauacugauauuagcaguuuguguugucagcaccucugcaguggagauggaaaaucugccagcaggcacuugggaaaaagaggaagaccugacaaauuucugucaucaggaaugccaagucacugagacugaaugccucuguccuuaugaagcucuugugcucaggaaacccuuguuuuuggacaguauuguuaaaggcaugaagaacuugcuaaauucaacaagccuagaaacaagcuuaucaauugaggcaccauggggggcaauaaauguccaaucaacuuucaaaccaacugugucagcugcaaacauagcgcuuaguuggagcucaguagaacauagaggcaauaaaauuuugguuucaggcagaucagagucaaucaugaaauuagaggaaaggacaggaauuagcugggaucuggguguggaagacgccucugaguccaaauugcucacugucucuguaauggacuugucacaaauguauucuccugucuuugaguaccuaucaggugauagacaaguggaagaauggcccaaggcaaccugcacaggagauugcccagaaagaugcggcugcacgucaucaaccugccuacacaaggaauggccccauucaagaaacuggagaugcaacccuacuugguguuggggagucggcacuggaugcaccuguugugggcuggaugugaaagaccucuuuacagauuacauguuugucaaguggaaaguugacuacauuaaaacagaagcuauaguguguguugagcuuacuagccaggaaagacaauguagcuuaauugaggcaggcacaagauucaacuuggguccugugaccaucacauugucagagccaagaaacauucagcagaagcucccuccagaaauaguuacauugcauccuaggauugaagaaggcuucuuugacuuaaugcauauacaaaaagugcuaucagcaaguacaguauguaagcuacagaguugcacacauggcgugccaggagaccuacagaucuaccacauuggaaacuuguuaaaaggagacaaggugaacgggcaccugauucacaaaauugaaccacacuucaacaccuccuggaugucuugggacggcugugaccuagacuacuacuguaauaugggggauuggccgucuugcucauauacuggcguaacccaacacaaucaugcugcauuuguaaacaugcucaacaucgaaacugauuauacaaaaaacuuccacuuucacucuaagagaguuacagcacauggggacacaccacaauuagauuuaaaagcuagaccaacuuauggugcaggugaaaucacugugcugguagagguugcugacauggaguugcauacaaagaaaauugagauaucagguuugaaguuugcaagcuuaacuugcacaggcuguuaugcuuguaguucuggcaucuccuguaagguuaggauccauguagaugaaccagaugagcuuacaguacaugugaagagcgaggauccagacauaguugcugcuaguucaagucucauggcuaggaagcuugaauuugggacagauagcacauuuaaagccuuuucagccaugcccaaaaccuccuugugcuuuuacauuguggagagggaauacugcaaaagcuguaguaaagaagacacacaaaaaugugucaacacaaagcuugaacaaccacaaagcauuuuaaucgagcacaaagggacgauaaucggaaagcagaacgacacuuguacagccaaagcaaguugcugguuagagucaauuaagaguuuuuuuuauggacuaaagaauaugcuuaguggcauuuuuggcaauguuuucauagggauuuucuuauuccucgcuccuuuuaucaugcuaauacuuuucuucauguuuggauggaggauccuguucugcuucaaguguugcagaagaacuagaggcuuauuuaaguauagacaccucaaagacgaugaagaaaucgguuacaggaaaaucauugagaggcuaaacaacaaaaaagggaaaaacaaacuacuugacggugaaagacuagcugauaggaagaucgcugagcuguucucuacaaaaacacacauuggc

SEQ ID NO: 3742 - RNA, 3495 nt, Artificial Sequence
  derived and/or modified CDS sequence (wt) from CCHVF(CCHVF SPU 383/87)__KJ682806.1__Gn-NSm-Gc
ucugaagagucuaaugaugacuguuuaucaaggacucagcuauugaggacagagaaugcggaaauucacagugacaacuauggugguccaggugacaagauaacuaucugcaacgguucaacuauuguagaucagagauugggcagugaacuaggguguuacacuaucaauagagugaaaucauuuaagcucugcgaaaacagugcuacagguaaaucuugugaaauagauagcaccccagucagauguaggcaggguuucugcuugaaaauuacucaggagggaaggggccacgugaagcuaucaagaggcucagaaguugucuuggacgccugcgacucaagcugugaaauaaugauaccaaagggcacuggggacauccuaguugacuguucaggugggcagcaacauuuccuaaaagauaaccugguugauuuaggaugccccaacaucccacuguuaggcaaaauggcaaucuacauuuguagaaugucaaaucaucccaagacaacuauggcuuuccuuuuuugguuuagcuuugguuaugugauaaccuguauacuuuguaaaguaaucuucuaucuauuaguaguuguagggacauuagggaaaaaguucaaacaguacagagaguuaaaaccucagaccuguaccauaugugaaacgaauccuguuaaugcaauagaugcugagaugcacgaccucaacugcaguuacaauauauguccuuauugugcaucuagguuaaccucagauggucuugccagacauguaauacaaugccccaaacggaaggaaaaaauagaagaaaccgaauuauauuuaaacuuggaaagaaucccuuggguuguuaggaaauuacugcaggugucagaauccaccgguguagcacuaaagaggaguaguuggcugguuauacuacuugugcuacucacaguuucauugucaccaguacaaucagcaccuaucagccauggagagacagucgaaguauaucaaaccagagaaggguacacaaguauuugccuuuuuguacuaggaagcauccuguuuuugguauccugccugaugaagggguugguugacagugucggcaauagcuuuuucccuggcuuguccauuuguaagacauguucuauuggcaguauaaacggcuuugaaauugaaucucacaaauguuacuguagccuauuuugcugccccuacuguagacacugcucugccgauauagaaauacauagguugcacuugagcaucugcaagaaaaggaaaacugggaguaaugucauguuagccgucuguaagcgcaugugcuuuagggcaacuguggaaguaagcaauaaagcuuuacuuauccgaaacaucaucaacaccacuuuuguugugugcauacugauauuagcaguuuguguugucagcaccucugcaguggagauggaaaaccugccagcaggcacuugggaaaaagaggaagaccugacaaauuucugucaucaggaaugccagguuacugagacugaaugccucuguccuuaugaagcucuugugcucaggaaacccuuguuuuuggacaguauuguuaagggcaugaagaacuugcuaaauucaacaagccuagaaacaagcuuaucaauugaggcaccauggggggcaauaaauguccagucaacuuucaaaccaacugugucagcugcaaacauagcgcuuaguuggagcucaguagaacauagaggcaauaaaauuuugguuucaggcagaucagagucaaucaugaaauuagaggaaaggacaggaauuagcugggaucuggguguggaagacgccucugaguccaaauugcucacugucucuguaauggacuugucacaaauguauucuccugucuuugaguaccuaucaggugauagacaaguggaggaauggcccaaggcaaccugcacaggagauugcccagaaagaugcggcugcacgucaucaaccugccuacacaaggaauggccccauucaagaaacuggagaugcaacccuacuugguguuggggagucggcacuggaugcaccuguugugggcuggaugugaaagaccucuuuacagauuacauguuugucaaguggaaaguugacuacauuaaaacagaagcuauaguguguguugagcuuacuagccaggaaagacaauguagcuuaauugaggcaggcacaagauucaacuuggguccugugacuaucacauugucagagccaagaaacauucagcagaagcucccuccagaaauagucacauugcauccuaggauugaagaaggcuucuuugacuuaaugcauauacaaaaagugcuaucagcaaguacaguauguaagcuacagaguugcacacauggcgugccaggagaccuacagaucuaccacauuggaaacuuguuaaaaggagacaaggugaacgggcaccugauucacaaaauugaaccacacuucaacaccuccuggaugucuugggacggcugugaccuagacuacuacuguaauaugggggauuggccaucuugcucauauacuggcguaacccaacacaaucaugcugcauuuguaaacaugcucaacaucgaaacugauuauacaaaaaacuuccacuuucacucuaagagaguuacagcacauggagacacaccacaauuagauuuaaaagcuagaccaacuuauggugcaggugaaaucacugugcugguagagguugcugacauggaguugcauacaaagaaaauugagauaucagguuugaaguuugcaagcuuaacuugcacaggcuguuaugcuuguaguucugguaucuccuguaagguuaggauccauguagaugaaccagaugagcuuacaguacaugugaagagcgaggauccagacauaguugcugcuaguucaagucucauggcuaggaagcuugaauuugggacagauagcacauuuaaagccuuuucagccaugcccaaaaccuccuugugcuuuuacauuguggagagggaauacugcaaaagcuguaguaaagaagacacacaaaaaugugucaacacaaagcuugaacaaccacaaagcauuuuaaucgagcacaaagggacgauauuuggaaagcagaacgacacuuguacagccaaagcaaguugcugguuagagucaguuaagaguuuuuuuuauggacuaaagaauaugcuuaguggcauuuuuggcaauguuuucauagggguuuucuuauuccucgcuccuuuuaucaugcuaauacuuuucuucauguuuggauggaggauccuguucugcuuuaaguguugcagaagaacuagaggcuuauuuaaguauagacaccucaaagacgaugaagaaaucgguuacaggaaaaucauugagaggcuaaacaacaaaaaagggaaaaacaaacugcuugacggugaaagacuagcugauaggaagauugcugagcuguucucuacaaaaacacacauuggc

SEQ ID NO: 3743 - RNA, 3495 nt, Artificial Sequence
  derived and/or modified CDS sequence (wt) from CCHVF(CCHVF SPU 130/89)__KJ682807.1__Gn-NSm-Gc
ucugaagagccuaauuaugacuguuuaucaaggacucagcuauugaggacagagaaugcggaaauucacagugacaacuauggugguccaggugacaagauaacuaucugcaacgguucaacuauuguagaucagagauugggcagugaacuaggguguuacacuaucaauagggugaaaucauuuaagcucugcgaaaacagugcuacagguaaaucuugugaaauagauagcaccccagucagauguaggcaggguuuuugcuugaaaauuacucaggagggaaggggccacgugaagcuaucaagaggcucagaaguugucuuggacgccugugacucaagcugugaaauaaugauaccaaagggcacuggggacauccuaguugacuguucaggugggcagcaacauuuccuaaaagauaaccugguugauuuaggaugccccaacaucccacuguuaggcaaaauggccaucuacauuuguagaaugucaaaucaucccaagacaaccauggcuuuccuuuuuugguuuagcuuugguuaugugauaaccugcauacuuuguaaaguaaucuucuaucuauuaauaguuguagggacauuaggaaaaaaguucaaacaguacagagaguuaaaaccucagaccuguaccauaugugaaacgaauccuguuaaugcaauagaugcugagaugcaugaccucaacugcaguuacaauauauguccuuauugugcaucuagguuaaccucagauggucuugccagacauguaaugcaaugccccaaacggaaggaaaaaauagaagaaaccgaauuauauuugaacuuagaaagaaucccuuggguuguuaggaaauuacugcaggugucagaauccaccgguguagcacuaaagaggaguaguuggcugguuguacuacuugugcuacucacaguuucauugucaccaguacaaucagcaccuaucagccauggagagacagucgaaguauaucaaaccagagaaggguacacaaguauuugccuuuuuguacuaggaagcauccuguuucugguguccugccugaugaagggguugguugacagugucggcaauaguuuuuucccuggcuuguccauuuguaagacauguucuauuggcaguauaaacggcuuugaaauugaaucucacaaauguuacuguagccuauuuugcugccccuacuguagacacugcucugccgauauagaaauacauaaguugcacuugagcaucugcaagaaaaggaaaacugggaguaaugucauguuagccgucuguaagcgcaugugcuuuagggcaacuguggaaguaagcaauaaagcuuuacuuauccgaaacaucaucaacaccacuuuuguugugugcauacugauauuagcaguuuguguugucagcaccucugcaguggagauggaaaaccugccagcaggcacuugggaaaaagaggaagaccugacaaauuucugucaucaggaaugccaggucacugagacugaaugccucugcccuuaugaagcucuugugcucaggaaacccuugucuuuggacaguauuguuaaaggcaugaagaacuugcuaaauucaacaagccuagaaacaagcuuaucaauugaggcaccauggggggcaauaaauguccagucaacuuucaaaccaacugugucagcugcaaacauagcgcuuaguuggagcucaguagaacauagaggcaauaaaauuuugguuucaggcagaucagagucaaucaugaaauuagaggaaaggacaggaauuagcugggaucuggguguggaagacgccucugaguccaaauugcucacugucucuguaauggacuugucacaaauguauucuccugucuuugaguaccuaucaggugauagacaaguggaggaauggcccaaggcaaccuguacaggagauugcccagaaagaugcggcugcacgucaucaaccugccuacacaaagaauggccccauucaagaaacuggagaugcaacccuacuugguguuggggagucggcacuggaugcaccuguugugggcuggaugugaaagaccucuuuacagauuacauguuugucaaguggaaaguugacuacauuaaaacagaagcuauaguguguguugagcuuacuagccaggaaagacaauguagcuuaauugaggcaggcacaagauucaacuuggguccugugaccaucacauugucagagccaagaaacauucagcagaagcucccuccagaaauagucacauugcauccuaggauugaagaaggcuucuuugacuuaaugcauauacaaaaagugcuaucagcaaguacaguauguaagcuacagaguugcacacauggcgugccaggagaccuacagaucuaccacauuggaaacuuguuaaaaggagacaaggugaacgggcaccugauucacaaaauugaaccacacuucaacaccuccuggaugucuugggacggcugugaccuagacuacuacuguaauaugggggauuggccaucuugcucauacacuggcguaacccaacacaaccaugcugcauuuguaaacaugcucaacaucgaaacugauuauacaaaaaacuuccacuuucacucuaagagaguuacagcacauggggacacaccacaauuagauuuaaaagcuagaccaacuuauggugcaggugaaaucacugugcugguagagguugcugacauggaguugcauacaaagaaaguugagauaucagguuugaaguuugcaagcuuaacuugcacaggcuguuaugcuuguaguucugguaucuccuguaaggucaggauccauguagaugaaccagaugagcuuacaguacaugugaagagcgaggauccagacauaguugcugcuaguucaagucucauggcuaggaagcuugaauuugggacagauagcacauuuaaagccuuuucagccaugcccaaaaccuccuugugcuuuuacauuguggagagggaacacugcaaaagcuguaguaaagaagacacacaaagaugugucaacacaaagcuugaacaaccacaaagcauuuuaaucgagcacaaagggacgauaauuggaaagcagaacgacacuuguacagccaaagcaaguugcugguuagagucaauuaagaguuuuuuuuauggacuaaagaauaugcuuaguggcauuuuuggcaauguuuucauagggguuuucuuauuccucgcuccuuuuaucauacuaauacuuuucuucauguuuggauggaggauccuguucugcuuuaaguguugcagaagaacuagaggcuuacuuaaguauagacaccucaaagacgaugaggaaaucgguuacaggaaaaucauugagaggcuaaacaacaaaaaagggaaaaacaaacugcuugacggugaaagacuagcugauaggaagaucgcugagcuguucucuacaaaaacacacauuggc

SEQ ID NO: 3744 - RNA, 3495 nt, Artificial Sequence
  derived and/or modified CDS sequence (wt) from CCHVF(CCHVF SPU 497/88)__KJ682808.1__Gn-NSm-Gc
ucugaagagucuaacgaugacuguuuaucaaggacucagcuauugaggacagagaaugcggaaauucacagugacaacuauggugguccaggugacaagauaacuaucugcaacgguucaacuauuguagaucagagacugggcagugaacuaggguguuacaccaucaauagagugaaaucauuuaagcucugcgaaaacagugcuacagguaaaucuugugaaauagauagcaccccagucagauguaggcaggguuuuugcuugaaaauuacucaggagggaaagggccacgugaagcuaucaagaggcucagagguuguccuggacgccugugauucaagcugugaaauaaugauaccaaagggcacaggggacauccuaguugacuguucaggugggcagcaacauuuccuaaaagauaaccugguugaucuaggaugccccaacaucccacuguuaggcaaaauggccaucuacauuuguagaaugucaaaucaucccaagacaacuaugguuuuccuuuuuugguuuagcuuuggcuaugugauaaccuguauacuuuguaaaguaaucuucuaucuauuaauaguuguagggacguuaggaaaaaaguucaaacaguacagagaguuaaaaccucagaccuguaccauaugugaaacaaacccuguuaaugcaauagaugcugagaugcacgaccucaacugcaguuacaauauauguccuuauugugcaucuagguuaaccucagauggucuugccagacauguaaugcaaugccccaaacggaaggaaaaaauagaagaaaccgaauuauauuuaaacuuagaaagaaucccuuggguuguuaggaaauuacugcaggugucagaauccaccgguguagcacuaaagaggaguaguuggcugguuauacuacuugugcuacucacaguuucauugucaccaguacaaucagcaccuaucagccauggagagacagucgaaguauaucaaaccagagaaggguacacaaguauuugccuuuuuguacuaggaggcauccuguuuuugguauccugccugaugaagggguugguugacagugucggcaauaguuuuuucccuggcuuguccauuuguaagacaugcucuauuggcaguauaaacggcuuugaaauugaaucucacaaauguuacuguagccuauuuugcugccccuacuguagacacugcucugccgauauagaaauacacaaguugcacuugagcaucugcaagaaaaggaaaacuuggaguaaugucauguuagccgucuguaagcgcaugugcuuuagggcaacuguggaaguaagcaauaaagcuuuacuuauccgaaacaucaucaacaccacuuucguugugugcauacugauauuagcaauuuguguugucagcaccucugcaguggagauggaaaaccugccagcaggcacuugggaaaaggaggaagaccugacaaauuucugucaucaggaaugccaggucacugagacugaaugccucuguccuuaugaagcucuuguacucaggaaacccuuguuuuuggacaguauuguuaaaggcaugaggaacuugcuaaauucaacaagccuagaaacaagcuuaucaauugaggcaccauggggggcaauaaauguccagucaacuuucaaaccaacugugucagcugcaaacauagcgcuuaguuggagcucaguagaacauagaggcaauaaaauuuugguuucaggcagaucagagucaaucaugaaauuagaggaaaggacaggaauuagcugggaucuggguguggaagacgccucugaguccaaacugcucacugucucuguuauggacuugucacaaauguauucuccugucuuugaauaccuaucaggugauagacaaguggaggaauggcccaaggcaaccugcacaggagauugcccagaaagaugcggcugcacgucaucaaccugccuacacaaggaauggccccauucaagaaacuggagaugcaacccuacuugguguuggggagucggcacuggaugcaccuguuguggguuggaugugaaagaccucuuuacagauuacauguuugucaaguggaaaguugacuacauuaaaacagaagcuauaguguguguugagcuuacuagccaggaaagacaauguagcuuaauugaggcaggcacaagauucaacuuggguccugugaccaucacauugucagaaccaaggaacauucagcaaaagcucccuccagaaauagucacauugcauccuaggauugaagaaggcuucuuugacuuaaugcauauacaaaaaguacuaucagcaaguacaguauguaagcuacagaguugcacacauggcgugccaggagaccuacagaucuaccacauuggaaacuuguuaaaaggagacaaggugaacgggcaccugauucacaaaauugaaccacacuucaacaccuccuggaugucuugggacggcugugaccuagacuacuacuguaacaugggggauuggccaucuugcucauauacuggcguaacccaacacaaucaugcugcauuuguaaacaugcucaacaucgaaacugauuauacaaaaaacuuccacuuucacucuaagagaguuacagcacauggagacacaccacaauuagauuuaaaagcuagaccaacuuauggugcaggugaaaucacugugcugguagagguugcugacauggaguugcauacaaagaaaauugagauaucagguuugaaguuugcaagcuuaacuugcacaggcuguuaugcuuguaguucugguaucuccuguaagguuaggauccauguagaugaaccagaugagcuuacaguacaugugaagagcgaggauccagacauaguugcugcuaguucaagucucauggcuaggaagcuugaauuugggacagauagcacauuuaaagccuuuucagccaugcccaaaaccuccuugugcuuuuacauuguggagagggaauacugcaaaagcuguaguaaagaagacacacaaaaaugugucaacacaaagcuugaacaaccacaaagcauuuuaaucgagcacaaagggacgauaauuggaaaacagaacgacacuuguacagccagagcaaguugcugguuagagucaaucaagaguuuuuuuuauggacugaagaauaugcuuaguggcauuuuuggcaauguuuucauagggauuuucuuauucuucgcuccuuuuaucaugcuaauacuuuucuuuauguuuggauggaggauccuguucugcuuuaaguguugcagaagaacuagaggcuuguuuaaguauagacaccucaaagacgaugaagaagucgguuacaggaaaaucauugagaggcuaaacaacaaaaaagggaaaaacaaacugcuugacggugaaagacuagcugauaggaagaucgcugagcuguucucuacaaaaacacacauuggc

SEQ ID NO: 3745 - RNA, 3495 nt, Artificial Sequence
  derived and/or modified CDS sequence (wt) from CCHVF(CCHVF SPU 18/88)__KJ682810.1__Gn-NSm-Gc
ucugaagagucuaaugaugacuguuuaucaaggacucagcuauugaggacagaaaaugcggaaauucacagugacaacuauggugguccaggugacaagauaacuaucugcaacgguucaacuauuguagaucagagacugggcagugaacuaggauguuacacuaucaauagagugaaaucauuuaagcucugugaaaacagugcuacagguaaaucuugugaaauagauagcaccccagucagauguaggcaggguuuuugcuugaaaauuacucaggagggaaggggccacgugaagcuaucaagaggcucagaaguugucuuggacgccugugauucaagcugugaaauaaugauaccaaagggcacuggggacauccuaguugacuguucaggugggcagcaacauuuccuaaaagauaaccugguugaucuaggaugccccaacaucccacuguuaggcaaaauggccaucuacauuuguagaaugucaaaucaucccaagacaacuauggguuuccuuuuuugguuuagcuuugguuaugugauaaccuguauacuuuguaaaguaaucuucuaucuauuaauaguuguagggacauuagggaaaaaguucaaacaguacagagaguuaaaaccucagaccuguaccauaugugaaacgaauccuguuaaugcaauagaugcugagaugcacgaccucaacuguaguuacaauauauguccuuauugugcaucuaggcugaccucagauggucuugccagacauguaaugcaaugccccaaacggaaggaaaaaauagaagaaaccgaauuauauuuaaacuuagaaagaauccccuggguuguuaggaaauuacugcaggugucagaauccaccgguguagcacuaaagaggaguaguuggcugguuauacuacuugugcuacucacaguuucauugucaccaguacaaucagcaccuaucagccauggagagacagucgaaguauaucaaaccagagaaggguacacaaguauuugccuuuuuguacuagggagcauccuguuuuugguauccugccugaugaagggguugguugacagugucggcaauaguuuuuccccuggcuuguccauuuguaagacauguucuauuggcaguauaaacggcuuugaaauugaaucucacaaauguuacuguagucuguuuugcugccccuacuguaggcacugcucugccgauauagaaauacauaaguugcacuuaagcaucugcaagaaaagaaaaacugggaguaaugucauguuagccgucuguaagcgcaugugcuuuagggcaacuguggaaguaagcaauaaagcuuuacuuauccgaaacaucaucaacaccacuuuuguugugugcauacugauauuagcaguuuguguugucagcaccucugcaguggagauggaaaaccugccagcaggcacuugggaaaaagaggaagaccugacaaauuucugucaucaggaaugccagguaacugagacugaaugccucuguccuuaugaagcucuugugcuaaggaaacccuuguuuuuggacaguauuguuaaaggcaagaagaacuugcuaaauucaacaagccuagaaacaagcuuaucaauugaggcaccauggggggcaauaaauguccagucaacuuucaaaccaacugugucagcugcaaacauagcgcuuaguuggagcucaguagaacauagaggcaauaaaauuuugguuucaggcagaucagagucaaucaugaaauuagaggaaaggacaggaauuagcugggaucuggguguggaagacgccucugaguccaaauugcucacugucucuguuauggacuugucacaaauguauucuccugucuuugaguaccuaucaggugauagacaaguggaggaauggcccaaggcaaccugcacaggagauugcccagagagaugcggcugcacgucaucaaccugccuacacaaggaauggccccauucaagaaacuggagaugcaacccuacuugguguuggggagucggcacuggaugcaccuguugugggcuggaugugaaagaccucuuuacagauuacauguuugucaaguggaaaguugacuacauuaaaacagaagcuauaguguguguugagcuuacuagccaggaaagacaauguagcuuaauugaggcaggcacaagauucaacuuggguccugugaccaucacauugucagagccaagaaacauucagcaaaagcucccuccagaaauagucacauugcauccuaggauugaagaaggcuucuuugacuuaaugcauauacaaaaagugcuaucagcaaguacaguaugcaagcuacagaguugcacacauggcgugccaggagaccuacagaucuaccacauuggaaacuuguuaaaaggagacaaggugaacgggcaccugauucacaaaauugaaccacacuucaacacuuccuggaugucuugggacggcugugaccuagacuacuacuguaauaugggggauuggccaucuugcucauauacuggcguaacccaacacaaucaugcugcauuuguaaacaugcucaacaucgaaacugauuauacaaaaaacuuccacuuucacucuaagagaguuacagcacauggagacacaccacaauuagauuuaaaagcuagaccaacuuauggugcaggugaaaucacugugcugguagagguugcagacauggaguugcauacaaagaaaauugagauaucagguuugaaguuugcaagcuuaacuugcacaggcuguuaugcuuguaguucugguaucuccuguaagguuaggauccauguagaugaaccagaugagcuuacaguacaugugaagagcgaggacccagacauaguugcugcuaguucaagucucauggcuaggaagcuugaauuugggacagauagcacauuuaaagccuuuucagccaugcccaaaaccuccuugugcuuuuacauuguggagagggaauacugcaaaagcuguaguaaagaagacacacaaaaaugugucaacacaaagcuugaacaaccacaaagcauuuuaaucgagcacaaagggacgauaauugggaagcagaacgacacuuguacaggcaaagcagguugcugguuagagucaaucaagaguuuuuuuuauggacuaaagaauaugcuuaguggcauuuuuggcaauguuuucauagggauuuucuuauuccuagcuccuuuuaucaugcuaauacuuuucuucauguuuggauggaggauccuguucugcuuuaaguguugcagaagaacuagaggccuauuuaaguauagacaccucaaagacgaugaagaaaucgguuacaggaaaaucauugagaggcuaaaaaacaaaaaagggaaaaacaaacugcuugauggugaaagacuagcugauaggaagaucgcugagcuguucucuacaaaaacacacauuggc

SEQ ID NO: 3746 - RNA, 3495 nt, Artificial Sequence
  derived and/or modified CDS sequence (wt) from CCHVF(CCHVF SPU 556/87)__KJ682811.1__Gn-NSm-Gc
uccgaggagucugauggugacuguauaucaagaacucaacuauugaggacagagacugcagaaauccacagugacaacuaugguggcccaggugacaaaauaacuaucugcaaugguucaacuauuguagaucaaagacuaggcagugaacugggguguuauacuaucaauaggguaaagucauuuaagcuuugcgaaaacagugccacaggaaaaucuugugaaauagauagcaccccaguuaagugcagacaagguuuuugcuugaaaaucacucaagaagggaggggccacgugaagcugucgagaggcucagaaauugucuuggacgccugcgauucaagcugugaaauaaugauaccaaagggcaccggagacaucuuaguugacuguucagguggacaacaacauuucuuaaaagauaauuugauugaucuuggaugucccaauaucccauuauuaggcagaauggccaucuacauuugcagaauguccaaucauccuaaaacaaccauggccuuucucuuuugguuuagcuuugguuaugugauaaccuguauccuuuguaaggugaucuuuuaccuauugauaguugcagggacaguagggaaaaaguucaaacaguauagagaguugagaccucagaccugcaccauaugugaaacaacuccugucaaugcaauagaugcugaaaugcaugaccucaacugcaguuacaauauauguccuuauugcgcaucuagauuaaccucagauggucuugccagacauguaaugcaaugccccaagcggaaggaaaaaauagaggaaacugaauuauacuuaaaccuagaaaggauucccuggguuguuaggaaauuauugcaaguuucagagucuaccgguguggcauugaagaggagcaguuggcugacagugcugcuuguguugcuuauaguuucauugucaccggugcagucagcaccuauuggucauggaaagacaauugaaacauaucaggccagagagggguauacaagcuucugccuuuuuauacuaggaagcaucuuguuuauagucucuugccuaguaaagggucugauugacagugucgguaacagcuucuucccuggacuguccauuugcaagacaugcucuauuggcaguguaaaugguuuugagauugaaucccacaaauguuacuguagucuauuuuguugcccuuauuguagacacugcucugccgauagagaaauccauaaguugcacuugagcaucugcaaaaaaagaaaaacugggagcaaugucaugucggccgucugcaagcgcaugugcuuuagagcaaccauagaaguuagcaauagggcuuuacuuauccggaguaucaucaauaccacuuuugcuguguguauacuaacacuagcaguuuguguugucagcaccucugcaguggagauggaaagucuaccagccggcaccugggagagagaggaagaccuaacaaacuucugucaucaggaaugccaagucacugagacugaaugccucuguccuuacgaagcccuuguacucagaaaacccuuauuuuuagacaguauuguuaaaggcaagaagaacuugcuaaacucaacaagcuuggaaacaagcuuaucaauugaagcaccauggggugcaauaaauguccaaucaaccuucaaaccuacugugucagcugcaaacauagcacuuagcuggagcucaguggaacacagaggcaacaagauuuugguuucaggcaggucagaaucaaucaugaagcuggaggaaaggacaggaaucagcugggaucugggaguagaagacgccucugaguccaaauugcucaccgucucugucauggacuugucacagauguauucccccgucuuugaguaccugucaggugauagacagguagaagaguggcccaaggcgaccuguacaggcgauugcccagaaagauguggcugcacaucaucaaccuguuugcacaaggaauggccccauucaaggaacuggagaugcaaccccacuugguguuggggggucggcacuggaugcaccuguuguggacuagauguaaaagaccucuuuacagauuacauguuugucaaguggaaaguugaauacauaaaaacagaggccauagugugcgucgaacuuacuagccaagaaagacaauguagcuugauugaagcaggcacaagauucaauuuagguccugugacuaucacauugucagagccaagaaacauucagcaaaagcucccuccagagauaaucacauugcauccuagaauugaagaaggcuuuuuugacuuaaugcaugugcaaaaagugcugucagcaagcacagugugcaagcuacagaguugcacacaugguguuccaggagaccuacaggucuaccacaucggaaacuuguuaaaaggagacaagguaaacgggcaucugauucacaagauugaaccacauuucaacacuuccuggaugucuugggauggcugugaccuagacuacuacugcaauaugggggacuggccuucuugcacauacacuggaguaacccaacauaaccaugcugcauuuguaaauuugcucaauaucgaaaccgauuauacaaaaaacuuucauuuucacuccaagagaguuacugcacauggagacacaccacaguuagacuugaaggccagaccaacuuauggugcaggggaggucacuguacuaguggagguugcugacauggaguugcacacaaagaaaauugagauaucaggcuugaaguuugcaagccuaucuugcacaggcugcuaugcuuguagcucugguaucuccuguaaggucaggauccauguagaugaaccagaugagcuuacaguacaugugaagagugaagacccagacauaguugcugcaggcucaagucucauggcaaggaagcuugaauuuggggcagauaguacauucaaagccuuuucagccaugcccaaaaccuccuugugcuuuuacauuguggagagagaauacuguaagagcugcaguagagaagacacacaaaaauguguuaacacuaaacuugagcgaccacagagcauuuugaucgaacauaaaggaacgauuauuggaaagcaaaacgacacuugcacagcuaaagcaagcugcuggcuagagucagucaaaaguuuuuucuacggauuaaagaguaugcuuaguggcauuuuuggcaacguuuucauagggauuuucuuauucauugcuccuuuuguccuguuaauacuuuucuuuauguuuggguggaggauucuguucugcuuuaagugcugcagaagaaccaggggccuauuuaaguacagacaccucaaggacgaugaagaaaccgguuacaggaaaaucauugagaggcuaaauaacaaaaagggaaaaaacaaacuacuugauggggaaaggcuagcugacaggaaaaucgccgaguuauucuccacaaaaucacauaucggc

SEQ ID NO: 3747 - RNA, 3495 nt, Artificial Sequence
  derived and/or modified CDS sequence (wt) from CCHVF(CCHVF SPU 431/85)__KJ682812.1__Gn-NSm-Gc
uccgaggagucugauggugacuguauaucaagaacucaacuauugaggacagagacuacagaaauccacagugacaacuaugguggcccaggugacaaaauaacuaucugcaaugguucaacuauuguagaucaaagacuaggcagugaacugggguguuauacuaucaauagggugaagucauuuaagcuuugcgaaaacagugccacaggaaaaucuugugaaauagauagcaccccaguuaagugcagacaagguuuuugcuugaaaaucacucaagaagggaggggccacgugaagcugucgagaggcucggaaauugucuuggacgcuugcgauucaaacugugaaauaaugauaccaaagggcaccggagacaucuuaguugacuguucagguggacaacaacauuucuuaaaagauaauuugauugaucuuggaugucccaauaucccauuauuaggcaaaauggccaucuacauuugcagaauguccaaucauccuaaaacaaccauggccuuucucuuuugguuuagcuuugguuaugugauaaccuguauacuuuguaaggugaucuuuuaccuauugauaguugcagggacaguaggaaaaaaguucaaacaguauagagaguugagaccucagaccugcaccauaugugaaacaauuccugucaaugcaauagaugcugaaaugcaugaccucaacugcaguuacaauauauguccguauugcgcaucuagauuaaccucagauggucuugccagacauguaaugcaaugcccuaagcggaaggaaaaaguagaggaaacugaauuauacuuaaaccuagaaaggauucccuggguuguuaggaaauuauugcaaguuucagagucuaccgguguggcauugaagaggagcaguuggcugacagugcugcuuguguugcuuauagucucauugucaccggugcagucagcaccuauuggucauggaaagacaauugaaacauaucaggccagagaaggguacacaagcuucugccuuuuuauacuaggaagcaucuuguuuguagucucuugccuaguaaagggucuaauugacagugucgguaacagcuuuuucccuggauuguccauuugcaagacaugcucgauuggcaguauaaaugguuuugagauugaaucccacaaauguuacuguagucuauuuuguugcccuuauuguagacacugcccugccgauagagaaauccauaaguugcacuugagcaucugcaaaaaaagaaaaacugggagcaaugucauguuggccgucugcaagcgcaugugcuuuagagcaaccauagaaguuagcaauagggcucuacuuauccggaauaucaucaauacuacuuuuguuguguguauacugacacuagcaguuuguguugucagcaccucugcaguggagauggaaagucuaccagccggcacuugggagaaagaggaagaccuaacaaacuucugucaucaggaaugccaagucacugagacugaaugccucuguccuuacgaagcccuuguacucagaaaacccuuauuuuuagacaguauuguuaaaggcaggaagaacuugcuaaacucaacaagcuuggaaacaagcuuaucaauugaggcaccauggggugcaauaaauguccaaucaaccuucaaacccacugugucagcugcaaacauagcacuuagcuggagcucaguggaacacagaggcaacaagauuuugguuucaggcaggucagaaucaaucaugaagcuggaggaaaggacaggaaucagcugggaucugggaguagaagacgccucugaguccaaauugcucaccgucucugucauggacuugucacaaauguauucccccgucuuugaguaccugucaggugauagacagguagaagaguggcccaaggcgaccuguacaggcgauugcccagaaagauguggcugcacaucaucaaccuguuugcacaaggaauggccccauucaaggaacuggagaugcaaccccacuugguguuggggggucggcacuggaugcaccuguugugggcuagauguaaaagaccucuuuacagauuacauguuugucaaguggaaaguugaauacauaaaaacagaggccauagugugugucgaacuuacuagccaagaaaggcaauguagcuugauugaagcaggcacaagauucaauuuagguccugugacuaucacauuaucggagccaagaaacauucagcaaaagcucccuccagaaauaauuacauugcauccuagaauugaagaaggcuuuuuugacuuaaugcaugugcaaagagugcugucagcaagcacagugugcaagcuacagaguugcacacauggugugccaggagaccuacaggucuaccacaucggaaacuuguuaaaaggagacaagguaaacgggcaucugauucacaagauugaaccacauuucaacacuuccuggaugucuugggauggcugugaccuagauuacuacugcaauaugggggauuggccuucuugcacauacacuggaguaacccaacauaaccaugcugcauuuguaaauuugcucaauaucgaaaccgauuauacaaaaaacuuucauuuucacuccaagagaguuacugcacauggagacacaccacaauuagacuugaaggccagaccaacuuauggugcaggggagguuacuguacuaguggagguugcugacauggagcugcacacaaagaaaauugagauaucaggcuugaaguuugcaagucuaacuugcacaggcugcuaugcuuguagcucugguaucuccuguaaggucaagauccauguagaugaaccagaugagcuuacaguacaugugaagagugaagacccagacauaguugcugcaggcucaagucucauggcaaggaagcuugaauuuggggcagauaguacauucaaagccuuuucagccaugcccaaaaccuccuugugcuuuuauauuguggagagagaauacuguaagagcugcaguagagaggacacacgaaaauguguuaacacuaagcuugaucgaccacagagcauuuugaucgaacauaaaggaacgauuauuggaaagcaaaacaacacaugcacagcuaaagcaagcugcuggcuagagucagucaaaaguuuuuucuacggauugaagaauaugcuuaguggcauuuucgguaauguuuucauagggauuuucuuauucauugcuccuuuuguccuguuaauacuuuucuuuauguuuggguggaggauccuguucugcuuuaagugcugcagaagaaccagaggccuauuuaaguacagacaccucaaggacgaugaagaaaccgguuacaggaaaaucauugagaggcuaaauaacaaaaagggaaaaaacaaacuacuugauggggaaaggcuagcugauaggaaaaucgccgaguuauucuccacaaaaucacauaucggc

SEQ ID NO: 3748 - RNA, 3495 nt, Artificial Sequence
  derived and/or modified CDS sequence (wt) from CCHVF(CCHVF SPU 48/90)__KJ682813.1__Gn-NSm-Gc
uccgaagaacccagugaugacugcauaucaagaacucagcuauugaggacagagacugcagagauccacggcgacaacuaugguggcccgggugacaaaauaacuaucugcaauggcucaacuauuguagaccaaagacugggcagugagcuaggguguuacacuaucaacagagugaagucauucaagcuaugcgaaaauagugccacagggaagagcuguguaauagacagugucccaguuaaaugcaggcaagguuauugucuaagaaucacucaggaaggaaggggccauguaaaauuaucuaggggcucagagguugucuuagaugcaugcgauacaagcugugaaauaaugauaccuaagggcaccggugacauccuaguugacuguucaggugggcagcaacauuuucuaaaggacaauuugauagaucuaggaugccccaaaauuccauuauugggcaaaauggcuaucuacauuugcagaaugucgaaucaccccacaacaaccauggcuuuccucuucugguucagcuuuggcuauguaauaacuuguauacuuugcaaggccaucuuuuacuuguuaauaauuauuggaacacuagggaaaagguucaggcaguauagagaguuaaaaccucagaccugcaccauaugugagacaacuccuguaaaugcaauagaugcugagaugcaugaccucaauugcaguuacaacauuugucccuacugugcaucuagacuaaccucagaugggcuugcuaggcaugugacacagugcccuaagcggaaggagaaaguggaagaaacugaacuguacuugaacuuagaaagaauuccuuggguuguaagaaagcuauugcagguaucagaguccaccgguguggcauugaaaagaagcagcuggcugauugugcugcuugugcuguucacgguuucauugucgccaguucaaucagcacccauuggucacgggaagacaauugaggcauaccgugccagggagggauacacaaguauaugucucuuuguacuaggaaguauccuauuuguagucucuugccuaaugaaaagguugguugacaguguuggcaacuccuucuucccuggacuguccauuugcaaaacgugcuccauaagcagcauuaauggcuuugaaauugagucccauaagugcuauugcagcuuauucugcugccccuauuguaggcacugcucugcugauaaagaaauucacaagcugcacuugagcaucugcaaaaaaagaaaaacaggaaguaaugucauguuggcugucugcaagcgcauguguuucagggccaccauggaaguaagugacagagcccuguuuauucguagcaucaucaauaccacuuuuguuuugugcauacugauacuagcaguuuguguuguuagcaccucagcaguggagauggaaaaccuaccagccgggacuugggaaagagaagaagaccuaacaaauuucugucaucaggaaugccagguuacagagacugaaugccucugcccuuaugaagcucuaguacucagaaagccucuauuccgagacaguauaguuaaaggcaugaaaaaucugcuaaacucaacaaguuuagaaacaagucuaucaauugaggcaccauggggggcaauaaauguucagucaaccuacaagccaacugugucgacugcaaacauagcacucagcuggagcucaguggaacacagaggcaauaagaucuugguuucaggcagaucagaaucaauuaugaagcuggaagaaaggacagggaucagcugggaucucggcguagaagacgccucugaguccaaacugcuuacagucucugucauggacuugucucagauguacucuccugucuucgaguacuuaucaggagacagacagguggaagaguggcccaaagcaacuuguacaggugacugcccagaaagauguggcugcacaucaucaacauguuugcacaaagaauggccccacucaagaaauuggagaugcaauccuacuuggugcugggguguagggacuggcugcaccuguuguggauuagaugugaaagaccuuuuuacagauuauauguuugucaaguggaaaguugaauacaucaagacagaggccauaguguguguagaacuuaccagucaggaaaggcaguguagcuugauugaagcgggcacaagguucaauuuagguccugugaccaucacacugucagaaccaagaaacauccaacagaagcucccuccugaaauaaucacacuacauccuaggauugaagaagguuuuuuugaccugaugcacguucagaaaguguuaucagcaagcacaguguguaaguugcagaguugcacacaugguguaccaggagaccuacaggucuaccacaucggaaauuuauuaaaaggggacaagguaaauggacaucuaauucauaaaauugagccacacuucaacacuuccuggauguccugggaugguugugaccuagacuacuacugcaacaugggagauuggccuucuugcacauacacaggagucacccaacacaaucgugcuucauuuguaaaccugcucaacauugaaacugauuacacaaaaaacuuccauuuucacucuaaaagggucacugcacacggagacacaccacaacuggaucuuaaggcaagaccaaccuauggugcaggugagauuacuguacugguagaaguugcugacauggaguuacacacaaagaagauugaaauaucaggcuuaaaauuugcaagcuugacuugcacagguuguuaugcuuguagcucuggcaucucaugcaaaguuagaauucauguggacgaaccagaugaacuuacagugcauguuaaaagugaugauccagauguaguugcagcuagcucaagccucauggcaagaaagcuugaauuuggaacagacagcacauuuaaagcuuucucagccaugccuaaaacuucgcuauguuucuacauuguugaaaaagaauacugcaagagcugcagugaagaagacacaaaaaaauguguuaacacaaaacuugagcaaccacaaagcauuuugaucgaacacaagggaacuauaaucggaaagcaaaacagcacuugcacagccaaagugaguugcugguuagagucagccaagaguuuuuuuuauggucuaaaggacaugcuuaguggcauuuuuggcaaugucuuuauagguauuuucuuguuccuugcccccuucauccuguuaauacuauucuuuauguuuggguggaggauccuacuuugcuuuaaauguuguagaagaacuagaggccuguucaaguauagacaccucaaggacgaugaagaaacugguuauagaaggauuauugaaagacuaaacaauaaaaaaggaaaaaacaaauugcuugauggugaaagacuugcugauagaagaauugcugaacuguucuccacaaaaacacacauuggc

SEQ ID NO: 3749 - RNA, 3495 nt, Artificial Sequence
  derived and/or modified CDS sequence (wt) from CCHVF(CCHVF SPU 187/90)__KJ682814.1__Gn-NSm-Gc
uccgaagaaccuagugaugacugcauaucgagaacucaacuauugaggacagagacugcagagauccacggcgacaacuaugguggcccgggugacaaaauaaccaucugcaacggcucaacuauuguagaccaaagacugggcagugagcuaggguguuacacuaucaauagagugaagucauucaagcuaugcgaaaauagugccacagggaagagcugugaaauagacagugucccaguuaaaugcaggcaggguuauugccuaagaaucacucaggaagggaggggccauguaaaauuaucuaggggcucagagguugucuuagaugcaugcgauacaagcugugaaauaaugauaccuaagggcacuggugacauccuaguugacuguucaggugggcagcaacauuuucuaaaggacaauuugauagaucuaggaugccccaaaauuccauuauugggcaaaauggcuauuuacauuugcagaaugucgaaucaccccaaaacaaccauggcuuuccuuuucugguucagcuuuggcuacguaauaacuuguauacuuugcaaggccaucuuuuacuuguuaauaauuauuggaacgcuagggaagagguucaagcaguauagagaguuaaaaccucagaccugcaccauaugugagacaacuccuguaaaugcaauagaugcugagaugcaugaccucaacugcaguuacaacauuugucccuacugugcaucuagacuaaccucagaugggcuugcuaggcaugugacacaaugcccuaagcggaaggagaaaguggaagaaacugaacuauacuugaacuuagaaagaauuccuuggguuguaagaaagcuguugcagguaucagaguccacugguguggcauugaaaagaagcagcuggcugauugugcugcuugugcuguucacgguuucauugucaccaguucaaucagcacccauuggucacgggaagacaauugaggcauaccgggccagggagggauacacaaguauaugucucuuuguacuaggaaguauccuauuuguagucucuugccuaaugaaagggcugguugacaguguuggcaacuccuucuucccuggacuguccauuugcaaaacgugcuccauaggcagcauuaauggcuuugaaauugagucccauaagugcuauugcagcuuauucuguugcccuuauuguaggcacugcucugcugauaaagaaauucauaagcugcacuugagcaucugcaaaaaaagaaaaacaggaaguaaugucauguuggcugucugcaagcgcauguguuucagggccaccauggaaguaaguaacagagcccuguuuauccguagcaucaucaacaccacuuuuguuuuauguauacugauacuagcaguuuguguuguuaguaccucagcaguggagauggaaaaccuaccagccgggaccugggaaagagaagaggaccuaacaaauuucugucaucaggaaugccagguuacagagacugaaugccucugcccuuaugaagcucuaguacucagaaggccucuauuccuagauaguauaguuaaagguaugaaaaaucugcuaaauucaacaaguuuagaaacaaguuuaucaauugaggcaccauggggggcaauaaauguucagucaaccuacaaaccaacugugucaacugcaaacauagcacucaguuggagcucuguggaacacagaggcaauaagaucuugguuucaggcagaucagaaucaauuaugaagcuggaagaaaggacaggaaucagcugggaccucggcguggaagacgccucugagucuaaacugcuuacagucucugucauggacuugucucagauguacucuccugucuucgaguacuuaucaggagacagacagguggaagaguggcccaaggcaacuuguacaggugacugcccagaaagauguggcugcacaucaucaacauguuuacacaaagaauggccccacucaagaaauuggaggugcaaucccacuuggugcugggguguagggacuggcugcaccuguuguggauuagaugugaaggaccuuuuuacagauuauauguuugucaaguggaaaguugaauauauuaagacagaagccauaguguguguagaacuuaccagucaggaaaggcaguguagcuugauugaagcaggcacaagguucaauuuagguccuguaaccaucacacugucagaaccacgaaacauccaacagaagcucccuccugaaauaaucacacugcaucccaggaucgaagaagguuuuuuugaccugaugcauguacagaaaguguuaucggcaagcacaguguguaaguugcagaguugcacacauggugugccaggagaccuacaggucuaccacaucgggaauuuauuaaaaggggauaaggugaauggacaucuaauucauaaaauugagccacacuucaacacuuccuggauguccugggaugguugugaccuagacuacuacugcaacaugggagauuggccuucuugcacauacacaggagucacccaacacaaucaugcuucauuuguaaaccugcucaacauugaaacugauuacacaaaaaacuuccacuuucacucuaaaagggucacugcacacggagacacaccacaacuagaucuuaaggcaagaccaaccuauggugcaggugagaucacuguacugguagaaguugcugacauggaguuacacacaaagaagauugaaauaucaggcuuaaaauuugcaagcuugacuugcacaggcuguuaugcuuguagcucuggcaucucaugcaaaguuagaauucauguggaugaaccagaugaacuuacaguacauguuaaaagugaugauccagauguaguugcagcuagcucaagucucauggcaagaaagcuugaauuuggaacagacaguauauuuaaagcuuucucagccaugccuaaaacuucucuauguuucuacauuguugaaagagaacacuguaagagcugcagcgaagaagacacuaaaaaauguguuaacacaaaacuugagcaaccacaaagcauuuugaucgaacacaagggaacuauaaucggaaagcaaaacagcacuugcacagccaagacgaguugcugguuagagucagucaaaaguuuuuuuuauggucuaaagaacaugcuuaguggcauuuuuggaaauguuuuuauagguauuuucuuguuccuugcccccuucauccuguuaauacuguucuuuauguuuggguggaggauccuauuuugcuuuaaauguugcagaagaacuagaggccuguucaaguauagacacuuaaaggacgaugaagaaacugguuauagaaggauuauugaaagauuaaacaauaaaaaaggaaaaaacaaacugcuugauggugaaagacuugcugauagaagaauugccgaacuguucucuacaaaaacacacauuggc

SEQ ID NO: 3750 - RNA, 3495 nt, Artificial Sequence
  derived and/or modified CDS sequence (wt) from CCHVF(CCHVF Haskovo-V46/13)__KR092379.1__Gn-NSm-Gc
uccgaagagcuaggugaugacuguauaucaagaacucagcuauugaggacagaaacagcagagauacaugaugacaacuauggugguccaggugauaaaauaacuaucugcaaugguucaaccauuguagaucagagacugggcagugaacuaggauguuauaccaucaacagggggaagucauucaagcuaugcgaaaacagcgcuacagggaaaaccugugagauagacagcacuccgguuaagugcaggcaagguuuuuguuuaaaaaucacccaagagggaaggggccacguaaaauuaucuagaggcucagagguuguccuggaugcuugcgacucaagcugugaaguaaugauaccuaaaggcacuggagauauccuaguggacuguucaggugggcagcaacauuucuuaaaagacaacuuaauugaccuagggugcccccauaucccgcuauuggguaagauggcuauuuacauuugcagaaugucuaaucauccuagaacaaccauggcuuuucucuucugguuuagcuuuggcuaugugaucacuuguauauuuugcaaggcucuuuuuuauucauugauaauuauugggacacuagggaaaaaaaucaagcaauauagggaacugaaaccucaaaccugcaccauaugugagacaacuccugucaaugcaauagaugcugaaaugcaugaccucaacuguaguuacaauauaugcccuuauugugcaucaagauugaccuccgaugggcuagccaggcauguaacacaaugccccaagcggaaagagaaaguugaggagacugaacuguaccugaaccuggaaagaauuccuuggauugucagaaagcuauugcaggugucagaguccaccgguguggcauugaaacgaagcagcuggcugauuguacugcuuguguuacucccaguuucauugucgccgguucaaucagcaccuguuggucauggaaagacaaucgaaacauaucagaccagagaaggauucacaagcaucugucucuuuauguuaggaagcauucuauuuauaguuucuugcuuggugaaagggcugguugacaguguuggugacagcuucuuccccggccugucugucuguaagacaugcucuauuggcaguauaaauggcuuugaaauugaaucgcauaaaugcuacuguagccuauuuugcugccccuacuguaggcacugcucugcugacagagaaauucaccagcuacacuugaguaucugcaaaaaaaggaaaacggggagcaaugucaugcuggcugucugcaaacgcaugugcuuuagggcaaccauagaagcaagcagaagagccuugcucauccgaagcauuaucaauaccacuuuugcaaugugcauucuaacauugacaaucuguguuguuagcaccucugcaguagagauggaaaaccuuccagcagguacuugggagagagaggaagaccugacaaauuucugucaucaggaaugccagguaacugagacggagugccucuguccauacgaagcucuugugcucagaaagccccuuuucuuagacaguauaguuaaagguaugaaaaauuugcuaaacucaacaagcuuggaaacaagcuuaucaauugaggcaccauggggagcaauaaauguccagucaaccuuuaaaccaacaguaucgacugcaaacauagcacucaguuggagcucaguggagcacagaggcaacaagaucuuagucacaggcaggucugaaucaaucaugaaacuagaggaaaggacaggagucagcugggaucuaggcguagaagaugccucagaauccaaauuacuuaccguuucuaucauggauuuaucacaaauguauuccccuguuuuugaguacuugucaggggacagacagguugaagaauggccaaaagcaacuuguacaggugauugcccagaaagguguggcugcacaucaucaaccugcuuacauaaagaauggccucacucaagaaacuggagaugcaaucccacuuggugcuggggaguaggaaccggcugcaccuguugcgggguggauguaaaagaccuuuuuacggaucacauguucgucaaauggaaaguugaauacauaaaaacugaagccauaguauguguugagcucaccagccaagaaagacagugcagucugauugaggcagguacuagauucaacuugggcccugugacuauuacccugucugagccaagaaacauucagcagaagcuucccccugaaauuaucacguugcaucccaaaauugaagaaggcuucuuugacuugaugcauguacaaaaaguguugucugcaaguacaguguguaaacugcagaguugcacacaugguauaccaggagaucuacaaguuuaccacauuggcaacuuguugaaaggggauagaguaaacgggcaucuaauucacaaaauugaaccacauuucaacaccucuuggauguccugggaugguugugauuuagauuacuacugcaacaugggggauuggccuucuugcacauacacaggagugacccagcauaaccaugcugcauuuguaaacuugcuuaacauugaaacugauuacacgaaaaccuuccacuuccacucuaaaagaguuacagcacauggugacacaccacaauuggacuuaaaagcaaggccgaccuacggugcaggugagaucacugugcugguugagguugcugacauggaguugcauaccaagaaaguugaaauaucaggcuugaaauuugcaaguuugacuugcacggguugcuaugcuuguagcucuggcaucuccugcaaaguuaggauucauguagaugaaccagaugagcuuacaguacauguaaagagcagugauccugaugugguugcagcuggcacaagucuuauggcgaggaagcuugaauuuggaacagacagcacauucaaggccuuuucagcuaugcccaaaaccucuuuauguuuuuacauuguggagagagaauacugcaagagcugcagugaagaugauacacaaaaauguguugacacaaaacuugagcagccacagagcauacuaauugagcacaaaggaacaauaauuggaaagcagaaugauacuugcacagccagggcaagcuguuggcuagagucagucaagaguuuuuuuuauggauugaagaauaugcuuggcaguguuuuugguaauuuuuuaauaggcauuuuguuauuccuugccccuuuuguccuguuggugcuuuucuuuauguuuggguggaaaaucuuguuuugcuuuaaauguugcaggaggaccagaggcuuauucaaauauagacaccucaaagacgaugaggaaacaggcuacagaaggauuauugaaagacugaacagcaaaaaagggaaaaacagacugcuugauggugaaaggcuggcugauaggaaaauugcugagcuguucuccacaaaaacacacauuggc

SEQ ID NO: 3751 - RNA, 3495 nt, Artificial Sequence
  derived and/or modified CDS sequence (wt) from CCHVF(CCHVF 24-R-2012)__KR814856.1__Gn-NSm-Gc
uccgaggagccaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauaccaucaacagggugaagucauucaagcuaugcgaaaacagcgccacagggaaaaccugugagauagacagcacuccgguuaagugcaggcaagguuuuuguuuaaaaaucacccaagagggaaggggccacguaaaauuaucuagaggcucagagguuguuuuggaugcuugcgacacaagcugcgaaguaaugauaccuaaaggcacuggagauauccugguggacuguucagguggacagcaacauuucuuaaaagacaauuuaauugaccuagggugcccccauaucccgcuauuggguaaaauggccauuuacaucugcagaaugucaaaucauccuagaacaacuauggcuuuucucuucugguucagcuuuggcuaugugaucaccuguauauuuugcaaggcucuuuuuuauucauugauaauuauugggacacuagggaaaaagaucaagcaauauagggaauugaaaccucaaacuuguaccauaugugagacagcuccugucaaugcaauagacgcugaaaugcaugaccuuaacugcaguuacaauauaugcccuuauugugcaucaagauugaccuccgaugggcuagcuaggcaugugccacaaugccccaagcggaaggaaaaaguugaggagacugagcuguacuugaaccuggaaagaauuccuuggauugucagaaagcuauugcaagugucagaguccacugguguggcauugaaacgaagcagcuggcugauuguacugcuuguguuacucacaguuucauugucaccgguucaaucagcaccuguuggucaugguaagacaaucgaaacauaucagaccagagaaggauucacaagugucugucucuuuauguuaggaagcauccuguuuuuagucucuugcuuggugaaggggcugguugacagugucagugacagcuucuucccuggccugucugucuguaagacaugcucuauuggcaguauaaauggcuuugaaauugaaucgcauaaaugcuacuguagccuauuuugcugccccuacuguaggcacugcucugcugacagagaaauucaucaguuacacuugaguaucugcaaaaaaagaaaaauggguagcaaugucaugcuggcugucugcaaacgcaugugcuuuagggcaaccauagaagcaagcagaagagcccugcucauccgaagcauuauaaauaccacuuuuguaauaugcauuuuaacauugacaaucuguguuguuagcaccucugcaguagagauggaaaaccuuccaucaggcacuugggagagagaggaagaccugacaaauuucugucaucaggaaugccagguaaccgagacggagugccucuguccauacgaagcucuugugcucagaaaaccucuguucuuagacaguauaguuaaaggcaugaagaauuugcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguagaagaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaacuugcuugcauaaagaauggccucacucaagaaacuggagauguaaucccacuuggugcuggggaguaggaacuggcugcaccugcugcgggguggauguaaaagaccuuuuuacagaucacauguuugucaaauggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcaugugcaaaaaguguugucugcaaguacaguguguaaacugcagaguugcacacaugguauaccaggagaucuacaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaauaucgaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcauaccaagaaaguugagauaucaggcuuaaaauuugcaagucuggcuugcacggguugcuaugcuuguagcucuggcaucuccuguaaagucaggauucauguagaugagccagaugagcucacaguacauguaaagagcaaugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaaugauacuugcacagccaaggcaagcuguuggcuagagucagucaagaguuuuuuuuauggauugaaaaauaugcuugguaguguauuugguaacuuuuucauaggcauuuuguuauuccuugccccuuuuguccuguuggugcuuuucuuuauguuuggauggaaaaucuuguuuugcuucaaauguugcaggaggaccagaggcuuacuuaaguauagacuccucaaagacgaugaggaaacaggcuacagaaggauuauugaaagacugaacaacaaaaaaggaaaaaacagacugcuugauggugaaagguuggcugauaggaaaauugcugagcuguucuccacaaaaacacacauuggu

SEQ ID NO: 3752 - RNA, 3495 nt, Artificial Sequence
  derived and/or modified CDS sequence (wt) from CCHVF(CCHVF 36-ST-2014)__KR814857.1__Gn-NSm-Gc
uccgaagagccaggugacgacugcauaucaagaacucagcuauugaagacagaaacagcagagauccaugacgacaacuauggugguccaggugacaaaauaacuaucugcaaugguucaaccauuguagaucagagacugggcagugaacuaggguguuauaccaucaacaggguaaagucauucaagcuaugcgaaaacagugccacagggaaaaccugugagauagacagcacuccggucaagugcaggcaagguuuuuguuugaaaaucacccaagaggggaggggccacguaaaauuauccaggggcucagagguuguuuuggaugcuugcgacucgagcugugaaauaaugauaccuaaaggcacuggagauauccuaguagacuguucagguggacagcaacauuucuuaaaagacaacuugauugaccuagggugcccucauaucccgcuauuggguaagauggccauuuacauuugcagaaugucaaaucaucccaggacaaccauggcuuuccucuucugguucaguuuuggcuauguaaucaccuguauauuuugcaaagcucuuuuuuauucauugauaauuauugggacacuaggaaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuagcuaggcaugugacacaaugcccuaagcgaaaggagaaaguugaggagacugaacuguauuugaaccuggaaagaauuccauggauagucagaaagcuguugcaagugucagaguccacugguguggcauugaaacgaagcagcuggcugauugugcugcuuguguuacucacagucucauugucaccgguucaaucagcaccuguuggucaugguaagacaauugaaacauaucagaccagagaaggauucacaaauaucugucucuuuauguuaggaagcauccuauucauaguuucuugccugguaaaggggcugguugacagugucagugacagcuuuuuccccggccugucugucuguaagacaugcucuauuggcaguauaaauggcuuugaaauugaaucgcauaaaugcuacuguaguuuauuuugcugccccuacuguaggcacugcucugcugacagagaaauucaccaguugcacuuggguaucugcaaaaaaagaaaaacggggagcaaugucaugcuggcugucugcaagcgcaugugcuuuaaggcaaccauagaagcaagcagaagagccuugcucauccgaagcauuaucaauaccacuuuuguaauaugcauccuaacauuagcaaucuguguuguuagcacuucugcaguagagauggaaaaucuuccagcaggcacuugggagagagaggaagaccugacaaauuucugccaucaggaaugccagguaagcgagacggaaugccucuguccauacgaagcucuugugcucaggaaaccucuuuucuuagacaguauaguuaaagguaugaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggauuugucacaaauguauuccccuguuuuugaguacuuaucaggagauagacagguugaagaauggcccaaggcaaccugcacaggugauugcccagaaagguguggcugcacaucaucaaccugcuugcauaaagaauggccucacucaagaaacuggagauguaaucccacuuggugcuggggaguaggaaccggcugcacaugcugcggaguggauguaaaagaccuuuuuacagaucacauguuuaucaaauggaagguugaauauauaaaaaccgaagccauaguauguguugagcucaccagccaagaaagacagugcagucugauugaggcagguacuagauucaacuuggguccugugacuaucacccugucugagccaagaaacauucagcagaagcuucccccugagaucauuacgcugcauccuaaaauugaagaaggcuucuuugacuugaugcaugugcaaaaaguguuaucugcaaguacaguguguaaacugcagaguugcacacaugguauaccaggagaucuacaaauuuaccacauuggcaacuuguugaaaggggauagauuaaacgggcaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccauucuaaaagagucacagcacauggagacacaccacaauuagacuuaaaagcaaggccgacuuacggugcaggugagaucacugugcugguugagguugcugacauggaguugcauaccaagaaaguugagauaucaggcuugaaauuugcaagucuggcuugcacggguugcuaugcuuguagcucuggcaucuccuguaaagucagaauucauguagaugaaccggaugagcucacagugcauguaaagagcagugauccagaugugguugcagcuagcacaagccuuauggcaaggaagcuugaauuugggacagauagcacauucaaggcauuuucagcuaugcccaaaaccucuuuaugcuuuuacauuguggagagggaauacugcaagagcugcagugaagaugauacaaaaaaauguguugacacaaaacuugaucagccacagagcauacuaauugagcacaaagggaccauaauuggaaagcagaaugacacuugcacagccaaggcaaguuguuggcuagagucagucaagaguuuuuuuuauggauugaagaauaugcuuggcaguguuuuugguaauuuuuucguaggcauuuuguuauuccuugcccccuuugucuuguuggugcuuuucuuuauguguggauggaaauucuuguuuugcuuuaaguguugcaggaggaccagaggcuuguuuaaguauagacaccucaaagaugaugaggaaacaggcuacagaaggauuauugaaagacugaacagcaaaaaaggaaagaacagacugcuugauggugagagguuggcugauaggaaaauugcugagcuguucucuacaaaaucacacauuggc

SEQ ID NO: 3753 - RNA, 3495 nt, Artificial Sequence
  derived and/or modified CDS sequence (wt) from CCHVF(CCHVF 37-R-2013)__KR814858.1__Gn-NSm-Gc
uccgaggagccaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauaccaucaacagggugaagucauucaagcuaugcgaaaacagcgccacagggaaaaccugugagauagacagcacuccgguuaagugcaggcaagguuuuuguuuaaaaaucacccaagagggaaggggccacguaaaauuaucuagaggcucagagguuguuuuggaugcuugcgacacaagcugcgaaguaaugauaccuaaaggcacuggagauauccugguggacuguucagguggacagcaacauuucuuaaaagacaauuuaauugaccuagggugcccccauaucccgcuauuggguaaaauggccauuuacaucugcagaaugucaaaucauccuagaacaacuauggcuuuucucuucugguucagcuuuggcuaugugaucaccuguauauuuugcaaggcucuuuuuuauucauugauaauuauugggacacuagggaaaaagaucaagcaauauagggaauugaaaccucaaacuuguaccauaugugagacagcuccugucaaugcaauagacgcugaaaugcaugaccuuaacugcaguuacaauauaugcccuuauugugcaucaagauugaccuccgaugggcuagcuaggcaugugccacaaugccccaagcggaaggaaaaaguugaggagacugagcuguacuugaaccuggaaagaauuccuuggauugucagaaagcuauugcaagugucagaguccacugguguggcauugaaacgaagcagcuggcugauuguacugcuuguguuacucacaguuucauugucaccgguucaaucagcaccuguuggucaugguaagacaaucgaaacauaucagaccagagaaggauucacaagugucugucucuuuauguuaggaagcauccuguuuuuagucucuugcuuggugaaggggcugguugacagugucagugacagcuucuuccccggccugucugucuguaagacaugcucuauuggcaguauaaauggcuuugaaauugaaucgcauaaaugcuacuguagccuauuuugcugccccuacuguaggcacugcucugcugacagagaaauucaucaguuacacuugaguaucugcaaaaaaagaaaaauggguagcaaugucaugcuggcugucugcaaacgcaugugcuuuagggcaaccauagaagcaagcagaagagcccugcucauccgaagcauuauaaauaccacuuuuguaauaugcauuuuaacauugacaaucuguguuguuagcaccucugcaguagagauggaaaaccuuccaucaggcacuugggagagagaggaagaccugacaaauuucugucaucaggaaugccagguaaccgagacggagugccucuguccauacgaagcucuugugcucagaaaaccucuguucuuagacaguauaguuaaaggcaugaagaauuugcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguagaugaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaacuugcuugcauaaagaauggccucacucaagaaacuggagauguaaucccacuuggugcuggggaguaggaacuggcugcaccugcugcgggguggauguaaaagaccuuuuuacagaucacauguuugucaaauggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcaugugcaaaaaguguugucugcaaguacaguguguaaacugcagaguugcacacaugguauaccaggagaucuacaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaauaucgaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcauaccaagaaaguugagauaucaggcuuaaaauuugcaagucuggcuugcacggguugcuaugcuuguagcucuggcaucuccuguaaagucaggauucauguagaugagccagaugagcucacaguacauguaaagagcaaugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaauguuacuugcacagccaaggcaagcuguuggcuagagucagucaagaguuuuuuuuauggauugaaaaauaugcuugguaguguauuugguaacuuuuucauaggcauuuuguuauuccuugccccuuuuguccuguuggugcuuuucuuuauguuuggauggaaaaucuuguuuugcuucaaauguugcaggaggaccagaggcuuacuuaaguauagacuccucaaagacgaugaggaaacaggcuacagaaggauuauugaaagacugaacaacaaaaaaggaaaaaacagacugcuugauggugaaagguuggcugauaggaaaauugcugagcuguucuccacaaaaacacacauuggu

SEQ ID NO: 3754 - RNA, 3495 nt, Artificial Sequence
  derived and/or modified CDS sequence (wt) from CCHVF(CCHVF 44-ST-2010)__KR814859.1__Gn-NSm-Gc
uccgaagagccaggugacgacugcauaucaagaacucagcuauugaagacagaaacagcagagauccaugacgacaacuauggugguccaggugacaaaauaacuaucugcaaugguucaaccauuguagaucagagacugggcagugaacuaggguguuauaccaucaacaggguaaagucauucaagcuaugcgaaaacagugccacagggaaaaccugugagauagacagcacuccggucaagugcaggcaagguuuuuguuugaaaaucacccaagaggggaggggccacguaaaauuauccaggggcucagagguuguuuuggaugcuugcgacucgagcugugaaauaaugauaccuaaaggcacuggagauauccuaguagacuguucagguggacagcaacauuucuuaaaagacaacuugauugaccuagggugcccucauaucccgcuauuggguaagauggccauuuacauuugcagaaugucaaaucaucccaggacaaccauggcuuuccuccucugguucaguuuuggcuauguaaucaccuguauauuuugcaaagcucuuuuuuauucauugauaauuauugggacacuaggaaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuagcuaggcaugugacacaaugcccuaagcgaaaggagaaaguugaggagacugaacuguauuugaaccuggaaagaauuccauggauagucagaaagcuguugcaagugucagaguccacugguguggcauugaaacgaagcagcuggcugauugugcugcuuguguuacucacagucucauugucaccgguucaaucagcaccuguuggucaugguaagacaauugaaacauaucagaccagagaaggauucacaaauaucugucucuuuauguuaggaagcauccuauucauaguuucuugccugguaaaggggcugguugacagugucagugacagcuuuuuccccggccugucugucuguaagacaugcucuuuuggcaguauaaauggcuuugaaauugaaucgcauaaaugcuacuguaguuuauuuugcugccccuacuguaggcacugcucugcugacagagaaauucaccaguugcacuuggguaucugcaaaaaaagaaaaacggggagcaaugucaugcuggcugucugcaagcgcaugugcuuuaaggcaaccauagaagcaagcagaagagccuugcucauccgaagcauuaucaauaccacuuuuguaauaugcauccuaacauuagcaaucuguguuguuagcacuucugcaguagagauggaaaaucuuccagcaggcacuugggagagagaggaagaccugacaaauuucugccaucaggaaugccagguaagcgagacggaaugccucuguccauacgaagcucuugugcucaggaaaccucuuuucuuagacaguauaguuaaagguaugaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggauuugucacaaauguauuccccuguuuuugaguacuuaucaggagauagacagguugaagaauggcccaaggcaaccugcacaggugauugcccagaaagguguggcugcacaucaucaaccugcuugcauaaagaauggccucacucaagaaacuggagauguaaucccacuuggugcuggggaguaggaaccggcugcacaugcugcggaguggauguaaaagaccuuuuuacagaucacauguuuaucaaauggaagguugaauauauaaaaaccgaagccauaguauguguugagcucaccagccaagaaagacagugcagucugauugaggcagguacuagauucaacuuggguccugugacuaucacccugucugagccaagaaacauucagcagaagcuucccccugagaucauuacgcugcauccuaaaauugaagaaggcuucuuugacuugaugcaugugcaaaaaguguuaucugcaaguacaguguguaaacugcagaguugcacacaugguauaccaggagaucuacaaauuuaccacauuggcaacuuguugaaaggggauagauuaaacgggcaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccauucuaaaagagucacagcacauggagacacaccacaauuagacuuaaaagcaaggccgacuuacggugcaggugagaucacugugcugguugagguugcugacauggaguugcauaccaagaaaguugagauaucaggcuugaaauuugcaagucuggcuugcacggguugcuaugcuuguagcucuggcaucuccuguaaagucagaauucauguagaugaaccggaugagcucacagugcauguaaagagcagugauccagaugugguugcagcuagcacaagccuuauggcaaggaagcuugaauuugggacagauagcacauucaaggcauuuucagcuaugcccaaaaccucuuuaugcuuuuacauuguggagagggaauacugcaagagcugcagugaagaugauacaaaaaaauguguugacacaaaacuugaucagccacagagcauacuaauugagcacaaagggaccauaauuggaaagcagaaugacacuugcacagccaaggcaaguuguuggcuagagucagucaagaguuuuuuuuauggauugaagaauaugcuuggcaguguuuuugguaauuuuuucguaggcauuuuguuauuccuugcccccuuugucuuguuggugcuuuucuuuauguguggauggaaaaucuuguuuugcuuuaaguguugcaggaggaccagaggcuuguuuaaguauagacaccucaaagaugaugaggaaacaggcuacagaaggauuauugaaagacugaacagcaaaaaaggaaagaacagacugcuugauggugagagguuggcugauaggaaaauugcugagcuguucucuacaaaaucacacauuggc

SEQ ID NO: 3755 - RNA, 3495 nt, Artificial Sequence
  derived and/or modified CDS sequence (wt) from CCHVF(CCHVF 46-ST-2012)__KR814860.1__Gn-NSm-Gc
uccgaagagccaggugaugacugcauaucaagaacucagcuauugaggacagaaacagcggagauccaugaugacaacuauggugguccaggugauaaaauaacuaucugcaacgguucaaccauuguagaucagagacugggcagugaacuaggguguuauaccaucaacagagugaagucauucaagcuaugcgaaaacagcgccacagggaaaaccugugagauagacagcacuccgguuaagugcaggcaaggcuuuuguuuaaaaaucacccaagagggaaggggccacguaaaauuaucuagaggcucagagguugucuuggaugccugcgacucaagcugcgaaguaaugauaccuaaaggcacuggagauauccugguggacuguucagguggacagcaacauuucuuaaaagacaacuuaauugaccuagggugcccccauaucccgcuauuggguaaaauggccauuuacaucugcagaaugucaaaucauccuagaacaacuauggcuuuucucuucugguucagcuuuggcuaugugaucaccuguauauuuugcaaggcucuuuuuuauucauugauaauuauugggacacuagggaaaaagaucaagcaauauagggaacugaaaccucaaacuuguaccauaugugagacagcuccugucaaugcaauagaugcugaaaugcaugaccuuaacugcaguuacaauauaugcccuuauugugcaucaagauugaccuccgaugggcuagcuaggcaugugccacagugccccaagcgaaaggaaaaaguugaggagacugagcuguacuugaaccuggaaagaauuccuuggaucgucagaaagcuauugcaagugucagaauccacugguguggcauugaaacgaagcagcuggcugauuguacugcuuguguuacucacaguuucauugucaccgguucaaucagcaccuguuggucaugguaagacaaucgaaacauaucagaccagagaaggauucacaaguaucugucucuuuauguuaggaagcauccuauuuuuagucucuugcuuggugaaggggcugguugacagugucagugacagcuucuuccccggccugucugucuguaagacaugcucuauuggcaguauaaauggcuuugaaauugaaucgcauaaaugcuacuguagccuauuuugcugccccuacuguaggcacugcucugcugacagagaaauucaccaguuacacuugagcaucugcaaaaaaagaaaaacggguagcaaugucaugcuggcugucugcaaacgcaugugcuuuagagcaaccauagaggcaagcagaagagcccugcucauccgaagcauuaucaaugccacuuuuguaauaugcauucuaacauugacaaucuguguuguuagcaccucugcaguagagauggaaagccuuccagcaggcacuugggagagagaggaagaccugacaaauuucugucaucaggaaugccagguaaccgagacggagugccucuguccauacgaagcucuugugcucagaaaaccucuguucuuagacaguauaguuaaaggcaugaaaaauuugcuaaacucaacaagcuuagaaacaagcuuaucaaucgaggcaccauggggagcaauaaauguccagucaaccuuuaaaccaacaguaucgacugcaaacauagcacucaguuggagcucaguggagcacagaggcaacaagaucuuagucacaggcaggucugaaucaauuaugaaacuggaggaaaggacaggagucagcugggaucuaggcguagaggaugccucugaauccaaauuacuuaccgucucuaucauggaucugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcuggggaguaggaacuggcugcaccugcugcgggguggauguaaaagaccuuuuuacagaucacauguuugucaaguggaagguugaauauauaaaaacugaagccauaguauguguugagcucaccagccaagaaagacagugcagucugauugaggcagguaccagauucaacuugggcccugugacuauuacccugucugagccaagaaacauacagcagaagcuucccccugagauuaucacauugcaucccaaaguugaagagggcuucuuugacuugaugcaugugcaaaaaguguugucugcaaguacaguguguaaacugcagaguugcacacacgguauaccaggagaucuacaaguuuaccacauuggcaacuuacugaaaggagauaggauaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacauugaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcacaccaaaaaaguugagauaucaggcuugaaauuugcaagucuggcuugcacggguugcuaugcuuguagcucuggcaucuccuguaaagucaggauucauguagaugagccagaugagcucacaguacauguaaagagcagugauccagaugugguugcagccagcacaagucucauggcgaggaagcuugaguuugggacagacaguaccuucaaggccuuuucagcuaugcccaaaaccucuuuauguuuuuacauuguggagagagaauacuguaagagcugcagugaagaggacacacaaaaauguguugacacaagacuugagcagccgcagagcauacuaauugagcacaaaggaacgauaauuggaaagcagaaugauacuugcacagccaaggcaagcuguugguuagagucagucaagaguuuuuuuuauggauugaagaauaugcuugguagugucuuugguaauuuuuucauaggcauucuguuauuccuugccccuuuuguccuguuggugcuuuucuuuauguuuggguggaaaaucuuguuuugcuuuaaauguugcaggaggaccagaggcuuacuuaaguauagacaccucaaagacgaugaggaaacaggcuacagaaggauuauugaaagacugaacaacaaaaaagggaaaaacagacugcuugauggugaaagguuggcugauaggaagauugcugagcuguucuccacaaaaacacacauuggu

SEQ ID NO: 3756 - RNA, 3495 nt, Artificial Sequence
  derived and/or modified CDS sequence (wt) from CCHVF(CCHVF 47-ST-2013)__KR814861.1__Gn-NSm-Gc
uccgaagagccaggugacgacugcauaucaagaacucagcuguugaagacagaaacagcagagauccaugacgacaacuauggugguccaggugacaaaauaacuaucugcaaugguucaaccauuguagaucagagacuggguagugaacuaggguguuauaccaucaacagggugaagucauucaagcuaugcaaaaacagugccacagggaaaaccugugagauagacagcacuccggucaagugcaggcaagguuuuuguuugaaaaucacccaagagggaaggggccacguuaaauuauccaggggcucagagguuguuuuggaugcuugcgacucgagcugugaaauaaugauaccuaaaggcacuggagauauccuaguagacugcucagguggacagcaacauuucuuaaaagacaacuugauugaccuagggugcccucauaucccgcuauuggguaagauggccauuuacauuugcagaaugucaaaucaucccaggacaaccauggcuuuccucuucugguucaguuuuggcuauguaaucaccuguauauuuugcaaggcucuuuuuuauucauugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagauugaccucugaugggcuagcuagacaugugacacaaugcccuaagcgaaaggagaaaguugaggagacugaacuguauuugaaccuggaaagaauuccuuggauagucagaaaguuauugcaagugucagaguccacugguguggcauugaaacgaagcaguuggcugauugugcugcuuguguuacucacagucucauugucaccgguucaaucagcaccuguuggucaugguaagacaauugaaacauaucagaccagagaaggauucacaaguaucugucucuuuauguuaggaagcauccuauucauaguuuccugccugguaaaggggcugguugacagugucagugacagcuucuuccccggccugucugucuguagaacaugcucuauuggcaguauaaauggcuuugaaauugaaucgcacaaaugcuacuguaguuuauuuugcugccccuacuguaggcacugcucugcugacagagaaauucaccaguugcacuugaguaucugcaaaaaaagaaaaacggggagcaaugucaugcuggcugucugcaagcgcaugugcuuuaaggcaaccauagaagcaagcagaagagcccuguucauccggagcauuaucaauaccacuuuuguaacaugcauucuaacauuagcaaucuguguuguuagcaccucugcaguagagauggaagaccuuccagcaggcacuugggagagagaggaagaccugacaaauuucugccaucaggaaugccaggugaccgagacggaaugccucuguccauacgaagcucuugugcucaggaaaccucuuuucuuagacaguauaguuaaagguaugaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagauccuggucacaggcaggucugaaucaauuaugaaacuagaggaaaggacaggagucagcugggaucuagguguagaagaugccucugaauccaaauuacuuaccgucucuaucauggauuugucacaaauguauuccccuguuuuugaguacuuaucaggagauagacagguugaagaauggcccaaggcaaccugcacaggugaaugcccagaaagguguggcugcacaucaucaaccugcuugcauaaagaauggccucacucaagaaacuggagauguaaucccacuuggugcuggggaguaggaaccggcugcacaugcugcggaguggauguaaaagaccuuuuuacagaucacauguuuaucaaauggaagguugaauauauaaaaaccgaagccauaguauguguugagcucaccagccaagaaagacagugcagucugauugaggcagguacuagauucaacuuagguccugugacuaucacccugucugagccaagaaacauucagcagaagcuucccccugagaucauuacgcugcaucccaaaauugaagaaggcuucuuugacuugaugcauguacaaaaaguguuaucugcaaguacaguguguaaacugcagaguugcacacaugguauaccaggagaucuacaaauuuaccacauuggcaacuuguugaaaggggauagaguaaacgggcaucuaauucacaaaauugaaccacauuuuaacaccucuuggauguccugggaugguugugaccuagacuacuacugcaacaugggggauuggccuucuugcacauacacaggagugacccaacauaaucaugcugcauuuguaaacuugcuuaacauugaaacugauuacacaaaaaccuuccacuuccacucuaaaagagucacagcacauggagacacaccacaauuagacuuaaaagcaaggccgaccuacggugcaggugagaucaccgugcugguugagguugcugacauggaguugcauaccaagaaaguugagguaucaggcuugaaauuugcaagucuggcuugcacggguugcuaugcuuguagcucuggcaucuccuguaaagucagaauucauguagaugaaccagaugagcucacagugcauguaaagagcagugauccagaugugguugcagcuagcacaagccuuauggcaaggaagcuugaauuugggacagauaguacauucaaggcauuuucagcuaugccuaaaaccucuuuaugcuuuuacauuguggagagggaauacugcaaaagcugcagugaagaugauacaaaaaaauguguugacacaaaacuugaacagccacagagcauacuaauugagcacaaagggacaauaauuggaaagcagaaugauacuugcacagccaaggcaaguuguuggcuagagucagucaagaguuuuuuuuauggauugaagaauaugcuuggcaguguuuuugguaauuuuuuuguaggcauuuuguuauuccuugccccuuuugucuuguuggugcuuuucuuuauguuuggauggaaaaucuuguuuugcuuuaaguguugcaggaggaccagaggcuuguuuaaguauagacaccucaaagaugaugaggaaacaggcuacagaaggauuauugaaagacugaacagcaaaaaagggaaaaacagacugcuugauggugagagguuggcugauaggaaaauugcugagcuguucucuacgaaaacacacauuggc

SEQ ID NO: 3757 - RNA, 3495 nt, Artificial Sequence
  derived and/or modified CDS sequence (wt) from CCHVF(CCHVF 52-R-2014)__KR814862.1__Gn-NSm-Gc
uccgaggagccaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauacuaucaacagggugaagucauucaagcuaugcgaaaacagcgccacagggaaaaccugugagauagacagcacuccgguuaagugcaggcaagguuuuuguuuaaaaaucacccaagagggaagaggccacguaaaauuaucuagaggcucagagguuguuuuggaugcuugcgacacaagcugcgaaguaaugauaccuaaaggcacuggagauauccugguggacuguucagguggacagcaacauuucuuaaaagacaauuuaauugaccuagggugcccccaugucccgcuauuggguaaaauggccauuuacaucugcagaaugucaaaucauccuagaacaacuauggcuuuucucuucugguucagcuuuggcuaugugaucaccuguauauuuugcaaggcucuuuuuuauucauugauaauuauugggacacuagggaaaaagaucaagcaauauagggaauugaaaccucaaacuuguaccauaugugagacagcuccugucaaugcaauagacgcugaaaugcaugaccuuaacugcaguuacaauauaugcccuuauugugcaucaagauugaccuccgaugggcuagcuaggcaugugccacaaugccccaagcggaaggaaaaaguugaggagacugagcuguacuugaaccuggaaagaauuccuuggauugucagaaagcuauugcaagugucagaguccacugguguggcauugaaacgaagcagcuggcugauuguacugcuuguguuacucacaguuucauugucaccgguucaaucagcaccuguuggucaugguaagacaaucgaaacauaucagaccagagaaggauucacaagugucugucucuuuauguuaggaagcauccuguuuuuagucucuugcuuggugaaggggcugguugacagugucagugacagcuucuuccccggccugucugucuguaagacaugcucuauuggcaguauaaauggcuuugaaauugaaucgcauaaaugcuacuguagccuauuuugcugccccuacuguaggcacugcucugcugacagagaaauucaucaguuacacuugaguaucugcaaaaaaagaaaaauggguagcaaugucaugcuggcugucugcaaacgcaugugcuuuagggcaaccauagaagcaagcagaagagcccugcucauccgaagcauuauaaauaccacuuuuguaauaugcauuuuaacauugacaaucuguguuguuagcaccucugcaguagagauggaaaaccuuccaucaggcacuugggagagagaggaagaccugacaaauuucugucaucaggaaugccagguaaccgagacggagugccucuguccauacgaagcucuugugcucagaaaaccucuguucuuagacaguauaguuaaaggcaugaagaauuugcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguagaugaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaacuugcuugcauaaagaauggccucacucaagaaacuggagauguaaucccacuuggugcuggggaguaggaacuggcugcaccugcugcgggguggauguaaaagaccuuuuuacagaucacauguuugucaaauggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcaugugcaaaaaguguugucugcaaguacaguguguaaacugcagaguugcacacaugguauaccaggagaucuacaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaauaucgaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcauaccaagaaaguugagauaucaggcuuaaaauuugcaagucuggcuugcacggguugcuaugcuuguagcucuggcaucuccuguaaagucaggauucauguagaugagccagaugagcucacaguacauguaaagagcaaugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaaugauacuugcacagccaaggcaggcuguuggcuagagucagucaagaguuuuuuuuauggauugaaaaauaugcuugguaguguauuugguaacuuuuucauaggcauuuugcuauuccuugccccuuuuguccuguuggugcuuuucuuuauguuuggauggaaaaucuuguuuugcuucaaauguugcaggaggaccagaggcuuacuuaaguauagacuccucaaagacgaugaggaaacaggcuacagaaggauuauugaaagacugaacaacaaaaaaggaaaaaacagacugcuugauggugaaagguuggcugauaggaaaauugcugaacuguucuccacaaaaacacacauuggu

SEQ ID NO: 3758 - RNA, 3495 nt, Artificial Sequence
  derived and/or modified CDS sequence (wt) from CCHVF(CCHVF 75-R-2012)__KR814863.1__Gn-NSm-Gc
uccgaggagccaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauaccaucaacagggugaagucauucaagcuaugcgaaaacagcgccacagggaaaaccugugagauagacagcgcuccgguuaagugcaggcaagguuuuuguuuaaaaaucacccaagagggaaggggccacguaaaauuaucuagaggcucagagguuguuuuggaugcuugcgacucaagcugcgaaguaaugauaccuaaaggcacuggagauauccugguggacuguucagguggacagcaacauuucuuaaaagacaacuuaauugaccuagggugcccacauaucccgcuauuggguaaaauggccauuuacaucugcagaaugucaaaucauccuagaacaacuauggcuuuucucuucugguucagcuuuggcuaugugaucaccuguauauuuugcaaggcucuuuuuuauucauugauaauuauugggacacuagggaaaaagaucaagcaauauagggaauugaaaccucaaacuuguaccauaugugagacagccccugucaaugcaauagacgcugaaaugcaugaccuuaacugcaguuacaauauaugcccuuauugugcaucaagauugaccuccgaugggcuagcuaggcaugugccacaaugccccaagcggaaggaaaaaguugaggagacugagcuguacuugaaccuagaaagaauuccuuggauugucagaaagcuauugcaagugucagaguccacugguguggcauugaagcgaagcagcuggcugauuguacugcuuguguuacucacaguuucauugucaccgguucaaucagcaccuguuggucaugguaagacaaucgaaacauaucagaccagagaaggauucacaaguaucugucucuuuauguuaggaagcauccuguuuuuagucucuugcuuggugaaggggcugguuaacagugucagugacagcuucuuccccggccugucuguuuguaagacaugcucuauuggcaguauaaauggcuuugaaauugaaucgcauaaaugcuacuguagccuauuuugcugccccuacuguaggcacugcucugcugacagagaaauucaucaguuacacuugaguauuugcaaaaaaagaaaaacggguagcaaugucaugcuggcugucugcaaacgcaugugcuuuagggcaaccauagaagcaagcagaagagcccugcucauccgaagcauuauaaauaccacuuuuguaauaugcauuuuaacauugacaaucuguguuguuagcaccucugcaguagagauggaaaaccuuccaucaggcacuugggagagagaggaagaccugacaaauuucugucaucaggaaugccagguaaccgagacggagugccucuguccauacgaagcucuugugcucagaaaaccucuguucuuagacaguauaguuaaaggcaugaagaauuugcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcagguccgaaucaauuaugaaacuggaggaaaggacaggagucagcugggaucuaggcguagaagaugccucugaguccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcuggggaguagguacuggcugcaccugcugcgggguggauguaaaagaccuuuuuacagaucacauguuugucaaauggaagguugaauauauaaaaacugaagccauaguauguguugagcucaccagucaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcaugugcaaaaaguguugucugcaaguacaguguguaaacugcagaguugcacacaugguauaccaggagaucuacaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacauugaaacugauuacacgaaaaccuuccacuuccacucuaaaagaguuacagcacauggugacacaccacaauuagacuuaaaagcaaggccgaccuacggugcaggugagaucaccgugcugguugagguugcugacauggaguugcauaccaagaaaguugagauaucaggcuuaaaauuugcaagucuggcuugcacggguugcuaugcuuguagcucuggcaucuccuguaaagucaggauucauguagaugagccagaugagcucacaguacauguaaagagcagugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaaugauacuugcacagccaaggcaagcuguuggcuagagucagucaagaguuuucuuuauggauugaaaaauaugcuugguaguguauuugguaacuuuuucauaggcauuuuguuauuccuugccccuuuuguccuguuggugcuuuucuuuauguuuggauggaaaaucuuguucugcuucaaauguugcaggaggaccagaggcuuacuuaaguauagacuccucaaagacgaugaggaaacaggcuacagaaggauuauugaaagacugaacaacaaaaaaggaaaaaacagacugcuugauggugaaagguuggcugauaggaaaauugcugagcuguucuccacaaaaacacacauuggu

SEQ ID NO: 3759 - RNA, 3495 nt, Artificial Sequence
  derived and/or modified CDS sequence (wt) from CCHVF(CCHVF 75-ST-2010)__KR814864.1__Gn-NSm-Gc
uccgaagagucaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauaccaucaacagggugaagucauucaagcuaugcgaaaacagcgccacagggaaaaccugugagauagacagcacuccgguuaagugcaggcaagguuuuuguuuaaaaaucacccaagaaggaaggggccacguaaaauuaucuagaggcucagagguuguuuuggaugcuugcgacucaagcugcgaaguaaugauaccuaaaggcacuggagauaucuugguggacuguucagguggacagcaacauuucuuaaaagacaacuuaauugaccuagggugcccccauaucccgcuauuggguaaaauggccauuuacaucugcagaaugucaaaucacccuagaacaacuauggcuuuucucuucugguucagcuuuggcuaugugaucaccuguuuauuuugcaaggcucuuuuuuauucauugauaaucauugggacacuagggaaaaagaucaagcaauauagggaauugagaccucaaaccuguaccauaugugagacagcuccugucaaugcaauagaugcugaaaugcaugaccuuaacugcaguuacaauauauguccuuauugugcaucaagauugaccuccgaugggcuagcuaggcaugugccacaaugccccaagcggaaggaaaaaguugaggagacugagcuguacuugaaccuggaaagaauaccuuggauugucagaaagcuauugcaagugucagaguccacugguguggcauugaaacgaagcagcuggcugauuguacugcuuguguuacucacaguuucauugucaccgguucaaucagcaccuguuggucaugguaagacaaucgaaacauaucagaccagagaaggauucacaaguaucugucucuuuauguuaggaagcauccuguuuuuagucucuugcuuggugaaggggcugguugacagugucagugacagcuucuuccccggccugucugucuguaagacaugcuccauuggcaguauaaauggcuuugaaauugaaucgcauaaaugcuacuguagccuacuuugcugccccuacuguaggcacugcucugcugacagagaaauccaccaguuacacuugaguaucugcaaaaaaagaaaaacggguagcaaugucaugcuggcugucugcaaacgcaugugcuuuagggcaaccauagaagcaagcagaagagcccugcucauccgaagcauuauaaauaccacuuuuguaauaugcauuuuaacauuaacaaucuguguuguuagcaccucugcaguagagauggaaaaccuuccaucaggcacuugggagaaagaggaagaccugacaaauuucugucaucaggaaugccaggugaccgagacggagugccucuguccauacgaagcucuugugcucagaaaaccucuguucuuagacaguauaguuaaaggcaugaagaauuugcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguagaagaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcuggggaguaggaacuggcugcaccugcugcgggguggauguaaaagaccuuuuuacagaucacauguuugucaaguggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcauguacaaaaaguguugucugcaaguacaguguguaaacugcagaguugcacacaugguauaccaggagaucuacaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacauugaaacugauuacacgaaaaccuuccacuuccacucuaaaagaguuacagcacauggugacacaccacaauuagacuuaaaagcaaggccaaccuacggugcaggugagaucacugugcugguugagguugcugacauggaguugcauaccaagaaaguugagauaucaggccugaaauuugcaagucuggcuugcacggguugcuaugcuuguagcucuggcaucuccuguaaagucaggauucauguagaugagccagaugagcucacaguacauguaaagagcagugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaaugauacuugcacagccaaggcaagcuguuggcuagagucagucaagaguuuuuuuuauggauugaaaaauaugcuugguaguguauuuggcaacuuuuucauaggcauuuuguuauuccuugccccuuuuguccuguuggugcuuuucuuuauguuuggauggaaaaucuuguuuugcuucaaauguugcaggagggccagaggcuugcuuaaguauagacaccuaaaagacgaugaggaaacaggcuacagaaagauuauugaaaggcugaacaacaaaaaaggaaaaaacagacugcuugauggugaaagguuggcugauaggaaaauugcugagcuguucuccacaaaaacacacauuggu

SEQ ID NO: 3760 - RNA, 3495 nt, Artificial Sequence
  derived and/or modified CDS sequence (wt) from CCHVF(CCHVF 81-R-2014)__KR814865.1__Gn-NSm-Gc
uccgaagagccaggugaugacugcauaucaagaacucagcuauugaggacagaaacagcagagauccaugaugacaacuauggugguccaggugauaaaauaacuaucugcaacgguucaaccauuguagaucagagacugggcagugaacuaggguguuauaccaucaacagagugaagucauucaagcuaugcgaaaacagcgccacagggaaaaccugugagauagacagcacuccgguuaagugcaggcaaggcuuuuguuuaaaaaucacccaagagggaaggggccacguaaaauuaucuagaggcucagagguugucuuggaugccugcgacucaagcugcgaaguaaugauaccuaaaggcacuggagauauccugguggacuguucagguggacagcaacauuucuuaaaagacaacuuaauugaccuagggugcccccauaucccgcuauuggguaaaauggccauuuacaucugcagaaugucaaaucauccuagaacaacuauggcuuuucucuucugguucagcuuuggcuaugugaucaccuguauauuuugcaaggcucuuuuuuauucauugauaauuauugggacacuagggaaaaagaucaagcaauauagggaacugaaaccucaaacuuguaccauaugugagacagcuccugucaaugcaauagaugcugaaaugcaugaccuuaacugcaguuacaauauaugcccuuauugugcaucaagauugaccuccgaugggcuagcuaggcaugugccacagugccccaagcgaaaggaaaaaguugaggagacugagcuguacuugaaccuggaaagaauuccuuggaucgucagaaagcuauugcaagugucagaauccacugguguggcauugaaacgaagcagcuggcugauuguacugcuuguguuacucacaguuucauugucaccgguucaaucagcaccuguuggucaugguaagacaaucgaaacauaucagaccagagaaggauucacaaguaucugucucuuuauguuaggaagcauccuauuuuuagucucuugcuuggugaaggggcugguugacagugucagugacagcuucuuccccggccugucugucuguaagacaugcucuauuggcaguauaaauggcuuugaaauugaaucgcauaaaugcuacuguagccuauuuugcugccccuacuguaggcacugcucugcugacagagaaauucaccaguuacacuugagcaucugcaaaaaaagaaaaacggguagcaaugucaugcuggcugucugcaaacgcaugugcuuuagagcaaccauagaggcaagcagaagagcccugcucauccgaagcauuaucaauaccacuuuuguaauaugcauucuaacauugacaaucuguguuguuagcaccucugcaguagagauggaaaaccuuccagcaggcacuugggagagagaggaagaccugacaaauuucugucaucaggaaugccagguaaccgagacggagugccucuguccauacgaagcucuugugcucagaaaaccucuguucuuagacaguauaguuaaaggcaugaaaaauuugcuaaacucaacaagcuuagaaacaagcuuaucaaucgaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguagaggaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcuggggaguaggaacuggcugcaccugcugcgggguggauguaaaagaccuuuuuacagaucacauguuugucaaguggaagguugaauauauaaaaacugaagccauaguauguguugagcucaccagccaagaaagacagugcagucugauugaggcagguaccagauucaacuugggcccugugacuauuacccugucugagccaagaaacauacagcagaagcuucccccugagauuaucacguugcaucccaaaguugaagagggcuucuuugacuugaugcaugugcaaaaaguguugucugcaaguacaguguguaaacugcagaguugcacacacggcauaccaggagaucuacaaguuuaccacauuggcaacuugcugaaaggagauaggauaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacauugaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcacaccaaaaaaguugagauaucaggcuugaaauuugcaagucuggcuugcacggguugcuaugcuuguagcucuggcaucuccuguaaagucaggauucauguagaugagccagaugagcucacaguacauguaaagagcagugauccagaugugguugcagccagcacaagucucauggcgaggaagcuugaguuugggacagacaguaccuucaaggccuuuucagcuaugcccaaaaccucuuuauguuuuuacauuguggagagagaauacuguaagagcugcagugaagaggacacacaaaaauguguugacacaagacuugagcagccgcagagcauacuaauugagcacaaaggaacgauaauugggaagcagaaugauacuugcacagccaaggcaagcuguugguuagagucagucaagaguuuuuuuuauggauugaagaauaugcuugguagugucuuugguaauuuuuucauaggcauucuguuauuccuugccccuuuuguccuguuggugcuuuucuuuauguuuggguggaaaaucuuguuuugcuuuaaauguugcaggaggaccagaggcuuacuuaaguauagacaccucaaagacgaugaggaaacaggcuacagaaggauuauugaaagacugaacaacaaaaaagggaaaaacagacugcuugauggugaaagguuggcugauaggaaaauugcugagcuguucuccacaaaaacacacauuggu

SEQ ID NO: 3761 - RNA, 3495 nt, Artificial Sequence
  derived and/or modified CDS sequence (wt) from CCHVF(CCHVF 3756-ST-2007)__KR814866.1__Gn-NSm-Gc
uccgaagagccaggugacgacugcauaucaagaacucagcuauugaagacagaaacagcagagauccaugacgacaacuauggugguccaggugacaaaauaacuaucugcaaugguucaaccauuguagaucagagacugggcagugaacuaggguguuauaccauuaacagggugaagucauucaagcuaugcgaaaacagugccacagggaaaaccugugagauagacagcacuccggucaagugcaggcaagguuuuuguuugaaaaucacccaagagggaaggggccacguaaaauuauccaggggcucagagguuguuuuggaugcuugcgacucgagcugugaaauaaugauaccuaaaggcacuggagauauccuaguagacuguucagguggacagcaacauuucuuaaaagacaacuugauugaccuagggugcccucauaucccgcuauuggguaaaauggccauuuacauuugcagaaugucaaaucaucccaggacaaccauggcuuuccucuucugguucaguuuuggcuauguaaucaccuguauauuuugcaaggcucuuuuuuauucauugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuagcuaggcaugugacacaaugcccuaagcgaaaggagaaaguugaggagacugaacuguauuugaaccuggaaagaauucccuggauagucagaaagcuauugcaagugucagaguccacugguguggcauugaaacgaagcaguuggcugauugugcugcuuguguuacucacagucucauugucaccgguccaaucagcaccuguuggucaugguaagacaaucgaaacauaucagaccagagaaggauucacaaguaucugucucuuuauguuaggaagcauccuauucauaguuucuugccugguaaaggggcugguugacagugucagugacagcuucuuccccggccugucugucuguaagacaugcucuauuggcagcauaaauggcuuugaaauugaaucgcauaaaugcuacuguaguuuauuuugcugccccuacuguaggcacugcucugcugacagagaaauucaccaguugcacuugaguaucugcaaaaaaagaaaaacggggagcaaugucaugcuggcugucugcaagcgcaugugcuuuaaggcaaccauagaagcaagcagaagagcccugcucauccgaagcauuaucaauaccacuuuuguaauaugcauucuaacauuagcaaucuguguuguuagcaccucugcaguagagauggaagaccuuccagcaggcacuugggagagagaggaagaccuaacaaauuucugccaucaggaaugccagguaaccgagacggaaugccucuguccauacgaagcucuugugcucaggaaaccucuuuucuuagacaguauaguuaaagguaugaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggauuugucacaaauguauuccccuguuuucgaguacuuaucaggagauagacagguugaagaauggcccaaggcaaccugcacaggugauugcccagaaagguguggcugcacaucaucaaccugcuugcauaaagaauggccucauucaagaaacuggagauguaaucccacuuggugcuggggaguaggaaccggcugcacaugcugcggaguggauguaaaagaccuuuuuacagaccacauguuuaucaaauggaagguugaauauauaaaaaccgaagccauaguauguguugagcucaccagccaagaaagacaaugcagucugauugaggcagguacuagauucaacuuggguccugugacuaucacccugucugagccaagaaacauucagcagaagcuucccccugagaucauuacgcugcaucccaaaauugaagaaggcuucuuugacuugaugcaugugcaaaaaguguuaucugcaaguacaguguguaaacugcagaguugcacacauggcauaccaggagaucuacaaauuuaccacauuggcaacuuguugaaaggggauagaguaaacgggcaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaagaaaguugagauaucaggcuugaaauuugcaagucugacuuguacggguugcuaugcuuguagcucuggcaucuccuguaaagucagaauucauguagaugaaccagaugagcucacagugcauguaaagagcagugauccagaugugguugcagcuagcacaagccuuauggcaaggaagcuugaauuugggacagauagcacauucaaggcauuuucagcuaugcccaaaaccucuuuaugcuuuuacauuguggagagggaauacugcaagagcugcagugaagaugauacaaaaaaauguguugacacaaaacuugagcagccacagagcauacuaauugagcacaaagggacgauaauuggaaagcagaaugauacuugcacagccaaggcaaguuguuggcuagagucggucaagaguuuuuuuuauggauugaagaauaugcuuggcaguguuuuugguaguuuuuucguaggcauuuuguuauuccuuaccccuuuugucuuguuggugcuuuucuuuauguuuggauggaaaaucuuguuuugcuuuaaguguugcaggaggaccagaggcuuguuuaaguauagacaccucaaagaugacgaggaaacaggcuacagaaggauuauugaaagacugaacagcaaaaaaggaaaaaacagacugcuugauggugagagguuggcugauaggaaaauugcugagcuguucucuacaaaaacacacauuggc

SEQ ID NO: 3762 - RNA, 3495 nt, Artificial Sequence
  derived and/or modified CDS sequence (wt) from CCHVF(CCHVF 3809-ST-2007)__KR814867.1__Gn-NSm-Gc
uccgaagagccaggugaugacugcauaucaagaacucaguuauugaggacagaaacagcagagauccaugaugacaacuauggugguccaggugauaaaauaacuaucugcaacgguucaaccauuguagaucagagacugggcagugaacuaggguguuauaccaucaacagggugaagucauucaagcuaugcgaaaacagcgccacagggaaaaccugugagauagacagcacuccgguuaagugcaggcaagguuuuuguuuaaaaaucacccaagagggaaggggccacguaaaauuaucuagaggcucagagguugucuuggaugccugcgacucaagcugcgaaguaaugauaccuaaaggcacuggagauauccugguggacuguucagguggacagcaacauuucuuaaaagacaacuuaauugaccuagggugcccccauaucccgcuauuggguaaaauggccauuuacaucugcagaaugucaaaucauccuagaacaacuauggcuuuucucuucugguucagcuuuggcuaugugaucaccuguauauuuuguaaggcucuuuuuuauucauugauaauuauugggacacuagggaaaaagaucaagcaauauagggaauugaaaccucaaacuuguaccauaugugagacagcuccugucaaugcaauagaugcugaaaugcaugaccuuaacugcaguuacaauauaugcccuuauugugcaucaagauugaccuccgaugggcuggcuaggcaugugccacaaugccccaagcggaaggaaaaaguugaggagacugagcuguacuugaaccuggaaagaaucccuuggauugucagaaagcuauugcaagugucagaguccacugguguggcauugaaacgaagcagcuggcugauuguacugcuuguguuacucacaguuucauugucaccgguucaaucagcaccuguuggucaugguaaaacaaucgaaacauaucagaccagagaaggauucacaaguaucugccucuuuauguuaggaagcauccuguuuuuagucucuugcuuggugaaggggcugguugacagugucagugacagcuucuuccccggccugucugucuguaagacaugcucuauuggcaguguaaauggcuuugagauugaaucgcauaaaugcuacuguagccuauuuugcugccccuacuguaggcacugcucugcugacagagaaauucaccaguuacacuugagugucugcaaaaaaagaaaaacggguagcaaugucaugcuggcugucugcaaacgcaugugcuuuagggcaaccauagaagcaagcagaagagcccugcucauccgaagcauuaucaauaccacuuuuguaauaugcauuuuaacauugacaaucuguguuguuagcaccucugcaguagagauggaaaaccuuccagcaggcacuugggagagagaggaagaccugacaaauuucugucaucaggaaugccagguaaccgagacggagugccucuguccauacgaagcucuugugcucagaaaaccucuguucuuagacaguauagucaaaggcaugaagaauuugcuaaacucaacaagcuuagaaacaagcuuaucaauugaagcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguggaagaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcuggggaguaggaacuggcuguaccugcugcgggguggauguaaaagaccuuuuuacagaucacauguuugucaaauggaagguugaauauauaaaaacugaagccauaguauguguugagcucaccagccaggaaagacagugcagucugauugaggcagguacuagauucaacuugggcccugugacuaucacccugucugagccaagaaacauucagcagaagcuucccccugagauuaucacguugcaucccaaaguugaagagggcuucuuugacuugaugcaugugcaaaaaguguugucugcaaguacaguguguaaacugcagaguugcacacaugguauaccaggagaucuucaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacauugaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcauaccaagaaaguugagauaucaggcuugaaauuugcaagucuggcuugcacggguugcuaugcuuguagcucuggcaucuccuguaaagucaggauucauguagaugagccagaugagcucacaguacauguaaagagcagugauccagaugugguugcagcuagcacaagucucauggcgaggaagcuugaauuugggacagacaguacauucaaggccuuuucagcuaugcccaaaaccucuuuauguuuuuacauuguggagaaagaauacugcaggagcugcagugaagaggacacacaaaaauguguugacacaaaacuugagcagccacagagcauacuaauugagcacaaaggaacgauaauuggaaagcagaaugauacuugcacagccaaagcaagcuguuggcuagagucagucaagaguuuuuuuuauggauugaagaauaugcuugguagugucuuugguaacuuuuucauaggcauuuuguuauuccuuaccccuuuuguccuguuggugcuuuucuuuauguuuggauggaaaaucuuguuuugcuucaaauguugcaggaggaccagaggcuuacuuaaguauagacaccucaaagacgaugaggaaacaggcuacagaaggauuauugaaagacugaacaacaaaaaagggaaaaacagacugcuugauggugaaagguuggcugauaggaaaauugcugagcuguuuuccacaaaaacacacauuggu

SEQ ID NO: 3763 - RNA, 3495 nt, Artificial Sequence
  derived and/or modified CDS sequence (wt) from CCHVF(CCHVF 3820-ST-2007)__KR814868.1__Gn-NSm-Gc
uccgaagagccaggugacgacugcauaucaagaacucagcuauugaagacagaaacagcagagauccaugacgacaacuaugguaguccaggugacaaaaucacuaucugcaaugguucaaccauuguagaucagagacugggcagugaacuaggguguuauaccaucaacagggugaagucauucaagcuaugcgaaaacagugccacagggaaaaccugugagauagacagcacuccggucaagugcaggcaagguuuuuguuugaaaaucacccaagagggaaggggccacguaaaauuauccaggggcucagagguuguuuuggaugcuugcgacucgagcugugaaauaaugauaccuaaaggcacuggagauauccuaguagacuguucagguggacagcaacauuucuuaaaagacaacuugauugaccuagggugcccucauaucccgcuauuggguaaaauggccauuuacauuugcagaaugucaaaucaucccaggacaaccauggcuuuccucuucugguucaguuuuggcuauguaaucaccuguauauuuugcaaggcucuuuuuuauucacugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuggcuaggcaugugacacaaugcccuaagcgaaaggagaaaguugaggagacugaacuguauuugaaccuggaaagaauuccuuggauagucagaaagcuauugcaagugucagaguccacugguguggcauugaaacgaagcaguuggcugauugugcugcuuguguuacucgcagucucauugucaccgguccaaucagcaccuguuggucaugguaagacaaucgaaacauaucagaccagagagggauucacaagcaucugucucuuuauguuaggaagcauccuauucauaguuucuugccugguaaaggggcugguugacagugucagugacagcuucuuccccggccugucugucuguaagacaugcucuauuggcaguauaaauggcuuugaaauugaaucgcauaaaugcuacuguaguuuauuuugcugccccuacuguaggcacugcucugcugacagagaaauucaccaguugcacuugaguaucugcaaaaaaagaaaaacggggagcaaugucaugcuggcugucugcaagcgcaugugcuuuaaggcaaccauagaagcaagcagaagagcccugcucauccgaagcauuaucaauaccacuuuuguaaugugcauucuaacauuagcaaucuguguuguuagcaccucugcaguagagauggaagaccuuccagcaggcacuugggagagagaggaagaccuaacaaauuucugccaucaggaaugccaggugaccgagacggaaugccucuguccauacgaagcucuugugcucaggaaaccccuuuucuuagacaguauaguuaaagguaugaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaccuaggcguagaagaugccucugaauccaaauuacuuaccgucucuaucauggauuugucacaaauguauuccccuguuuuugaguacuuaucaggagauagacagguugaagaauggcccaaggcaaccugcacaggugauugcccagaaagguguggcugcacaucaucaaccugcuugcauaaagaauggccucauucaagaaacuggagauguaaucccacuuggugcuggggaguaggaaccggcugcacaugcugcggaguggauguaaaagaccuuuuuacagaccacauguuuaucaaauggaagguugaauauauaaaaaccgaagccauaguauguguugagcucaccagccaagaaagacagugcagucugauugaggcagguacuagauucaacuuggguccugugacuaucacccugucugagccaagaaacauucagcagaagcuucccccugagaucauuacgcugcaucccaaaauugaagaaggcuucuuugacuugaugcaugugcaaaaaguguuaucugcaaguacaguguguaaacugcagaguugcacacaugguauaccaggagaucuacaaauuuaccacauuggcaacuuguugaaaggggauagaguaaacggccaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaaaaaaguugagauaucaggcuugaaauuugcaagucugacuuguacggguugcuaugcuuguagcucuggcaucuccuguaaagucagaauucauguagaugaaccagaugagcucacagugcauguaaagagcagugauccagaugugguugcagcuagcacaagccuuauggcaaggaagcuugaauuugggacagauagcacauucaaggcauuuucagcuaugcccaaaaccucuuuaugcuuuuacauuguggagagggaauacugcaagagcugcagugaagaugauacaaaaaaauguguugacacaaaacuugagcagccacagagcauacuaauugagcacaaagggacgauaauuggaaagcagaaugauacuugcacagccaaggcaaguuguuggcuagagucagucaagaguuuuuuuuauggauugaagaauaugcuuggcaguguuuuugguaguuuuuucguaggcauuuuguuauuccuugccccuuucgucuuguuggugcuuuucuuuauguuuggauggaaaaucuuguuuugcuuuaaguguugcaggaggaccagaggcuuguuuaaguauagacaccucaaagaugacgaggaaacaggcuacagaaggauuauugaaagacugaacagcaaaaaaggaaaaaacagacugcuugauggugagagguuggcugauaggaaaauugcugagcuguucucuacaaaaacacacauuggc

SEQ ID NO: 3764 - RNA, 3495 nt, Artificial Sequence
  derived and/or modified CDS sequence (wt) from CCHVF(CCHVF 4495-ST-2008)__KR814869.1__Gn-NSm-Gc
uccgaagagucaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauaccaucaacagggugaagucauucaagcuaugcgaaaacagcgccacagggaaaaccugugagauagacagcacuccgguuaagugcaggcaagguuuuuguuuaaaaaucacccaagaaggaaggggccacguaaaauuaucuagaggcucagagguuguuuuggaugcuugcgacucaagcugcgaaguaaugauaccuaaaggcacuggagauaucuugguggacuguucagguggacagcaacauuucuuaaaagacaacuuaauugaccuagggugcccccauaucccgcuauuggguaaaauggccauuuacaucugcagaaugucaaaucauccuagaacaacuauggcuuuucucuucugguucagcuuuggcuauguaaucaccuguuuauuuugcaaggcucuuuuuuauucauugauaaucauugggacacuagggaaaaagaucaagcaauauagggaauugagaccucaaacuuguaccauaugugagacagcuccugucaaugcaauagaugcugaaaugcaugaccuuaacugcaguuacaauauaugcccuuauugugcaucaagauugaccuccgaugggcuagcuaggcaugugccacaaugccccaagcggaaggaaaaaguugaggagacugagcuguacuugaaccuggaaagaauuccuuggauugucagaaagcuauugcaagugucagaguccacugguguggcauugaaacgaagcagcuggcugauuguacugcuuguguuacucacaguuucauugucaccgguucaaucagcaccuguuggucaugguaagacaaucgaaacauaucagaccagagaaggauucacaaguaucugucucuuuauguuaggaagcauccuguuuuuagucucuugcuuggugaaggggcugguugacagugucagugacagcuucuuccccggccugucugucuguaagacaugcucuauuggcaguauaaauggcuuugaaauugaaucgcauaaaugcuacuguagccuacuuugcugccccuacuguaggcacugcucugcugacagagaaauccaccaguuacacuugaguaucugcaaaaaaagaaaaacggguagcaaugucaugcuggcugucugcaaacgcaugugcuuuagggcaaccauagaagcaagcagaagagcccugcucauccgaagcauuauaaauaccacuuuuguaauaugcauuuuaacauuaacaaucuguguuguuagcaccucugcaguagagauggaaaaccuuccaucaggcacuugggagaaagaggaagaccugacaaauuucugucaucaggaaugccaggugaccgagacggagugccucuguccauacgaagcucuugugcucagaaaaccucuguucuuagacaguauaguuaaaggcaugaagaauuugcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggaaucagcugggaucuaggcguagaagaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcuggggaguaggaacuggcugcaccugcugcgggguggauguaaaagaccuuuuuacagaucacauguuugucaaguggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcauguacaaaaaguguugucugcaaguacaguguguaaacugcagaguugcacacaugguauaccaggagaucuacaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacauugaaacugauuacacgaaaaccuuccacuuccacucuaaaagaguuacagcacauggugacacaccacaauuagacuuaaaagcaaggccaaccuacggugcaggugagaucacugugcugguugagguugcugacauggaguugcauaccaagaaaguugagauaucaggccugaaauuugcaagucuggcuugcacggguugcuaugcuuguagcucuggcaucuccuguaaagucaggauucauguagaugagccagaugagcucacaguacauguaaagagcagugauccagaugugguugcagcuagcacaagucucauggcgaggaagcuugaauuugggacagacaguacauucaaggccuuuucagcuaugcccaaaaccucuuuauguuuuuacauuguggagagggaauacugcaagagcugcagugaagaggacacacaaagauguguugacacaaaacuugagcagccacagagcauacuaauugagcacaaaggaacgauaauuggaaagcagaaugauacuugcacagccaaggcaagcuguuggcuagagucagucaagaguuuuuuuuauggauugaaaaauaugcuugguaguguauuuggcaacuuuuucauaggcauuuuguuauuccuugccccuuuuguccuguuggugcuuuucuuuauguuuggauggaaaaucuuguuuugcuucaaauguugcaggagggccagaggcuugcuuaaguauagacaccuaaaagacgaugaggaaacaggcuacagaaagauuauugaaaggcugaacaacaaaaaaggaaaaaacagacugcuugauggugaaagguuggcugauaggaaaauugcugagcuguucuccacaaaaacacacauuggu

SEQ ID NO: 3765 - RNA, 3495 nt, Artificial Sequence
  derived and/or modified CDS sequence (wt) from CCHVF(CCHVF 4691-ST-2009)__KR814871.1__Gn-NSm-Gc
uccgaagagccaggugacgacugcauaucaagaacucagcuauugaagacagaaacagcagagauccaugacgacaacuauggugguccaggugacaaaauaacuaucugcaaugguucaaccauuguagaucagagacugggcagugaacuaggguguuauaccaucaacagggugaagucauucaagcuaugcgaaaacagugccacagggaaaaccugugagauagacagcacuccggucaagugcaggcaggguuuuuguuugaaaaucacccaagagggaaggggccacguaaaauuauccaggggcucagagguuguuuuagaugcuugcgacucgagcugugaaauaaugauaccuaaaggcacuggagauauccuaguagacuguucagguggacagcaacauuucuuaaaagacaacuugauugaccuagggugcccucauaucccgcuuuuggguaagauggccauuuacauuugcagaaugucaaaucaucccaggacaaccauggcuuuccucuucugguucaguuuuggcuauguaaucaccuguauauuuugcaaggcucuuuuuuauucauugauaauuauuggaacacuaggaaaaaaaaucaagcaauauagggagcuaaagccucaaacuugcaccauaugugagacagcuccugucaaugcaauagaugcugaaaugcaugaccucaacuguaguuauaauauaugcccuuauugugcaucaagacugaccucugaugggcuagcuaggcaugugacacaaugcccuaagcgaaaggagaaaguugaggagacugaacuguauuugaaccuggaaagaauuccuuggauagucagaaagcuauugcaagugucagaguccacugguguggcauugaaacgaagcaguuggcugauugugcugcuuguguuacucacagucucauugucaccgguucaaucagcaccuguuggucaugguaagacaaucgaaacauaucaggcuagagaaggauucacaaguaucugucucuuuauguuaggaagcauccuauucauaguuucuugccugguaaaggggcugguugacagugucagugacagcuucuuccccggccugucugucuguaagacaugcucuauuggcaguauaaauggcuuugaaauugagucgcauaaaugcuacuguaguuuauuuugcugccccuacuguaggcacugcucugcugacagagaaauucaccaguugcacuugaguaucugcaaaaaaagaagaacggggagcaaugucaugcuggcugucugcaagcgcaugugcuuuaaggcaaccauagaagcaagcagaagagcccugcucauccgaagcauuaucaauaccacuuuuguaauaugcauucuaacauuagcaaucuguguuguuagcacuucugcaguagagauggaaaaccuuccagcaggcacuugggagagagaggaagacuugacaaauuucugccaucaggaaugccaggugaccgagacggaaugccucuguccauacgaagcucuugugcucaggaaaccucuuuucuuagacaguaucguuaaagguaugaaaaauuugcuaaacucaacaagcuuagaaacaagcuuaucaauugaggcaccauggggagcaauaaauguccagucaaccuuuaaaccagcaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggauuugucacaaauguauuccccuguuuuugaguacuuaucaggagauagacagguugaagaauggcccaaggcaaccugcacaggugauugcccagaaagguguggcugcacaucaucaaccugcuugcauaaagaauggccucacucaagaaacuggagauguaaucccacuuggugcuggggaguaggaaccggcugcacaugcugcggaguggauguaaaagaccuuuuuacagaucacauguuuaucaaauggaagguugaauauauaaaaaccgaagccauaguauguguugagcucaccagccaagaaagacagugcagucugauugaggcagguacuagauucaacuuggguccugugacuaucacccugucugagccaagaaacauucagcagaagcuucccccugagaucauuacgcugcaucccaaaauugaagaaggcuucuuugacuugaugcaugugcaaaaaguguuaucugcaaguacaguguguaaacugcagaguugcacacaugguauaccaggagaucuacaaauuuaccacauuggcaaccuguugaaaggggauagaguaaacgggcaucuaauucacaaaauugaaccacauuuuaacaccucuuggauguccugggaugguugugaccuagacuacuauugcaacaugggggauuggccuucuugcacauacacaggagugacccaacacaaucaugcugcauuuguaaacuugcuuaacauugaaacugauuacacgaaaaccuuccacuuccacucuaaaagagucacagcgcauggagacacaccacaauuggacuuaaaagcaaggccgaccuacggugcaggugagaucacugugcugguugagguugcugacauggaguugcauaccaagaaaguugagauaucaggcuugaaauuugcaagucuggcuugcacggguugcuaugcuuguagcucuggcaucuccuguaaagucagaauucauguagaugaaccagaugagcucacagugcauguaaagagcagugauccagaugugguugcagcuagcacaagccuuauggcaaggaagcuugaauuugggacagauagcacauucaaggcauuuucagcuaugcccaaaaccucuuuaugcuuuuacauuguggagagggaauacugcaagagcugcagugaagaugauacaaaaaaauguguugacacaaaacuugagcagccacagagcauacuaauugagcauaaagggacgauaauuggaaagcagaaugauacuugcacagccaaggcaaguuguuggcuagagucagucaagaguuuuuuuuauggauuaaagaauaugcuuggcaguguuuuugguaauuuuuucguaggcauuuuguuauuccuugccccuuuugucuuguuggugcucuucuuuauguuuggauggaaaaucuuguuuugcuuuaaguguugcaggaggaccagaggcuuguuuaaguauagacaccucaaagaugaugaggaaacaggcuacagaaggauuauugaaagacugaacagcaaaaaaggaaaaaacagacugcuugacggugagagguuggcugauaggaaaauugcugagcuguucucuacaaaaacacacauuggc

SEQ ID NO: 3766 - RNA, 3495 nt, Artificial Sequence
  derived and/or modified CDS sequence (wt) from CCHVF(CCHVF 4701-ST-2009)__KR814872.1__Gn-NSm-Gc
uccgaagagccaggugacgacugcauaucaagaacucagcuauugaagacagaaacagcagagauccaugacgacaacuauggugguccaggugacaaaauaacuaucugcaaugguucaaccguuguagaucagagacugggcagugaacuaggguguuauaccaucaacagggugaagucauucaagcuaugcgaaaacagugccacagggaaaaccugugagauagacagcacuccgguuaagugcaggcaaggguuuuguuugaaaaucacccaagagggaaggggccacguaaaauuauccaggggcucagagguuguuuuggaugcuugcgacucaagcugugaaauaaugauaccuaaaggcacuggagauauccuaguagacuguucagguggacagcaacauuucuuaaaagacaacuugauugaccuagggugcccucauaucccgcuauuggguaaaauggccauuuacauuugcagaaugucaaaucaucccaggacaaccauggcuuuccucuucugguucaguuuuggcuauguaaucaccuguauauuuugcaaggcucuuuuuuauucauugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuggcuaggcaugugacacaaugcccuaagcgaaaagagaaaguugaggagacugaacuguauuugaaccuggaaagaauuccuuggauagucagaaagcuauugcaagugucagaguccacugguguggcauugaaacgaagcaguuggcugauugugcugcuuguguuacucacagucucauugucaccgguccaaucagcaccuguuggucaugguaagacaaucgaaacauaucagaccagagagggauucacaaguaucugucucuuuauguuaggaagcauccuauucauaguuucuugccugguaaaggggcugguugacagugucagugacagcuucuuccccggccugucugucuguaagacaugcucuauuggcaguauaaauggcuuugaaauugaaucgcauaaaugcuacuguaguuuauuuugcugccccuacuguaggcacugcucugcugacagagaaauucaccaguugcacuugaguaucugcaaaaaaagaaaaacggggagcaaugucaugcuggcugucugcaagcgcaugugcuuuaaggcaaccauagaagcaagcagaagagcccugcucauccgaagcauuaucaauaccacuuuuguaaugugcauucuaacauuagcaaucuguguuguuagcaccucugcaguagagauggaagaccuuccggcaggcacuugggagagagaggaagaccuaacaaauuucugccaucaggaaugccaggugaccgagacggaaugccucuguccauacgaagcucuugugcucaggaaaccccuuuucuuagacaguauaguuaaagguaugaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggauuugucacaaauguauuccccuguuuuugaguacuuaucaggagauagacagguugaagaauggcccaaggcaaccuguacaggugauugcccagaaagguguggcugcacaucaucaaccugcuugcauaaagaauggccucauucaagaaacuggagauguaaucccacuuggugcuggggaguaggaaccggcugcacaugcugcggaguggauguaaaagaccuuuuuacagaccacauguuuaucaaauggaagguugaauauauaaaaaccgaagccauaguauguguugagcucaccagccaagaaagacagugcagucugauugaggcagguacuagauucaacuuggguccugugacuaucacccugucugagccaagaaacauucagcagaagcuucccccugagaucauuacgcugcauccuaaaauugaagaaggcuucuuugacuugaugcaugugcaaaaaguguuaucugcaaguacaguguguaaacugcagaguugcacacaugguauaccaggagaucuacaaauuuaccacauuggcaacuuguugaaaggggauagaguaaacggccaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaauauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaaaaaaguugagauaucaggcuugaaauuugcaagucugacuuguacggguugcuaugcuuguagcucuggcaucuccuguaaagucagaauucauguagaugaaccagaugagcucacagugcauguaaagagcagugauccagaugugguugcagcuagcacaagccuuauggcaaggaagcuugaauuugggacagauagcacauucaaggcauuuucagcuaugcccaaaaccucuuuaugcuuuuacauuguggagagggaauacugcaagagcugcagugaagaugauacaaaaaaauguguugacacaaaacuugagcagccacagagcauacuaauugagcacaaagggacgauaauuggaaagcagaaugauacuugcacagccaaggcaaguuguuggcuagagucagucaagaguuuuuuuuauggauugaagaauaugcuuggcaguguuuuuggugguuuuuucguaggcauuuuguuauuccuugccccuuucgucuuguugguacuuuucuuuauguuuggauggaaaaucuuguuuugcuuuaaguguugcaggaggaccagaggcuuguuuaaguauagacaccucaaagaugacgaggaaacaggcuacagaaggauuauugaaagacugaacagcaaaaaaggaaaaaacagacugcuugauggugagagguuggcugauaggaaaauugcugagcuguucucuacaaaaacacacauuggc

SEQ ID NO: 3767 - RNA, 3495 nt, Artificial Sequence
  derived and/or modified CDS sequence (wt) from CCHVF(CCHVF 5170-R-2011)__KR814873.1__Gn-NSm-Gc
uccgaagagccaggugacgacugcauaucaagaacucagcuauugaagacagaaacagcagaaauccaugacgacaacuauggugguccaggugacaaaauaacuaucugcaaugguucaaccauuguagaucagagacugggcagugaacuaggguguuauaccaucaacagggugaagucauucaagcuaugcgaaaacagugccacagggaaaaccugugagauagacagcacuccggucaagugcaggcaagguuuuuguuugaaaaucacccaagagggaaggggccacguaaaauuauccaggggcucagagguuguuuuggauguuugcgacucgagcugugaaauaaugauaccuaaaggcacuggagauauccuaguagacuguucagguggacagcaacauuucuuaaaagacaacuugauugaccuagggugcccucauaucccgcuauuggguaaaauggccauuuacauuugcagaaugucaaaucaucccaggacaaccauggcuuuccucuucugguucaguuuuggcuauguaaucaccuguauauuuugcaaggcucuuuuuuauucauugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaagggcuagcuaggcaugugacacaaugcccuaagcgaaaggagaaaguugaggagacugaacuguauuugaaccuggaaagaauuccuuggauagucagaaagcuauugcaagugucagaguccacugguguggcauugaaacgaagcaguuggcugauugugcugcuuguguuacucacagucucauugucaccgguccaaucagcaccuguuggucaugguaagacaaucgaaacauaucagaccagagaaggauucacaaguaucugucucuuuauguuaggaagcauccuauucauaguuucuugccugguaaaggggcugguugacagugucagugacagcuucuuccccggccugucugucuguaagacaugcucuauuggcaguauaaauggcuuugaaauugaaucgcauaaaugcuacuguaguuuauuuugcugccccuacuguaggcacugcucugcugacagagaaauucaccaguugcacuugaguaucugcaaaaaaagaaaaacagggagcaaugucaugcuggcugucugcaagcgcaugugcuuuaaggcaaccauagaagcaagcagaagagcccugcucauccgaagcauuaucaauaccacuuuuguaauaugcauucuaacauuagcaaucuguguuguuagcaccucugcaguagagauggaagaccuuccagcaggcacuugggagagagaggaagaccuaacaaauuucugccaucaggaaugccaggugaccgagacggaaugccucuguccauacgaagcucuugugcucaggaaaccucuuuucuuagacaguauaguuaaagguaugaaaaauuugcuaaacucaacaagcuuagaaacaagcuuaucaauugaggcaccauggggagcaauaaauguccagucaaccuuuaaaccaacaguaucuacugcaaacauagcacucaguuggagcucaguagagcacagaggcaacaagaucuuggucacaggcaggucugaaucaauuaugaaacuagaggaaaggacaggagucagcugggaucuaggcguggaagaugccucugaauccaaauuacuuaccgucucuaucauggacuugucacaaauguauuccccuguuuuugaguacuuaucaggagauagacagguugaagaauggcccaaggcaaccugcacaggugauugcccagaaagguguggcugcacaucaucaaccugcuugcauaaagaauggccucauucaagaaacuggagauguaaucccacuuggugcuggggaguaggaaccggcugcacaugcugcggaguggauguaaaagaccuuuuuacagaccacauguuuaucaaauggaagguugaauauauaaaaaccgaagccauaguauguguugagcucaccagccaagaaagacagugcagucugauugaggcagguacuagauucaacuuggguccugugacuaucacccugucugagccaagaaacauucagcagaagcuucccccugagaucauuacgcugcaucccaaaauugaagaaggcuucuuugacuugaugcaugugcaaaaaguguuaucugcaaguacaguguguaaacugcagaguugcacacaugguauaccaggagaucuacaaauuuaccacaucgguaacuuguugaaaggggauagaguaaacgggcaucugauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaagaaaguugagauaucaggcuugaaauuugcaagucugacuuguacggguugcuaugccuguagcucuggcaucucuuguaaagucagaauucauguagaugaaccagaugagcucacagugcauguaaagagcagugauccagaugugguugcagcuagcacaagccuuauggcaaggaagcuugaauuugggacagauagcacauucaaggcauuuucagccaugcccaaaaccucuuuaugcuuuuacauuguagagagggaauacugcaagagcugcagugaagaugauacaaaaaaauguguugacacaaaacuugagcagccacagagcauacuaauugagcacaaggggacgauaauuggaaagcagaaugauacuugcacagccaaggcaaguuguuggcuagagucagucaagaguuuuuuuuauggacugaagaauaugcuuggcaguguuuuugguaguuuuuucguaggcauuuuguuauuccuugccccuuuugucuuguuggugcuuuucuuuauguuuggauggaaaaucuuguuuugcuuuaaguguugcaggaggaccagaggcuuguuuaaguauagacaccucaaagaugacgaggaaacaggcuacagaaggauuauugaaagacugaacagcaaaaaagggaaaaacagacugcuugauggugagagguuggcugauaggaaaauugcugagcuguucucuacaaaaacacacauuggc

SEQ ID NO: 3768 - RNA, 3495 nt, Artificial Sequence
  derived and/or modified CDS sequence (wt) from CCHVF(CCHVF Oman-199809166)__KR864901.1__Gn-NSm-Gc
uccgaagagucuggugaagacuguauaucaaggacucagcuguugaggacagaaacugcagaaauccauggugauaacuauggugguccaggugacaaaauaaccaucugcaaugguucaaccauuguagaucaaaggcuggguagugaacugggguguuacacuaucaauagggugaagucauuuaagcuaugcgaaaacagugccacagguaaguccugugaaauagauaacacuccaguaaaaugcaagcaagguuuuugcuugaaaauaacccaagaaggaaggggccacgugaagcuuucaagagacucagaaguuguccuggacgccugcgauucaagcugugaaauaaugauaccaaagggcacuggagacauccugguugacugcucaggugggcagcagcacuucuuaaaagacaaccugauugaucugggaugccccaacaucccauuauuaggcaaaauggcaaucuacauuuguagaaugucaaaucauccuaaaacaacuauggcuuuucuuuuuugguuuagcuuugguuaugugauaaccugcauacuuuguaaagucauuuuuuaucuauugauaguuguuggaacuuuagggaaaaaguuuaaacaguauagagaguuaaaaccucagaccugcacaauaugugaaacaacuccugucaaugcaauagaugcugagaugcacgaucucaauuguaguuacaauauauguccuuauugugcaucuagguuaacuucagauggucuugccagacauguaaugcaguguccuaagcggaaggaaaaaauagaagaaaccgaauuauaccugaacuuagaaagaaucccuuggguugucagaaaacuacugcagguaucagaauccacugguguagcacuaaagaggagcaguuggcugauugugcuacuugugcuucucacaguuucauugucaccaguacaaucagcaccuaucggucaugggaagaccauagaaacguaucaaacuagagaaggguacacaaguauuugucuuuuugugcuaggaagcauuuuguuuauaguuucucaccuaaugaaggggcugguugacaguguugguaacaguuuuuucccuggguuaucuaucugcaagacaugcucuauuggcaguauaaauggcuuugaaauugaaucucacaaauguuacuguagccuauuuuguugccccuacuguagacacugcucugccgauaaagaaauccauaaguugcauuugagcaucugcaaaaaaagaaaagcugggaguaaugucauguuggccgucuguaagcgcauguguuuuagggcaacuauggaagugagcaacaaggcucuacucauccgaagugucaucaacacuacuuuuguuguaugcauacuaauauuagcaguuuguguuguuagcaccuccgcaguagagauggaaagccugccagcuggcacuugggagagagaggaagaccuaacaaacuucugccaucaagaaugccaggucacugaaacugaaugucucugucccuaugaagcucuuguacucagaaagcccuuauuuuuagacaguauugcuaaggguaugaagaaccugcugaauucaacaagcuuagaaacaagcuuaucaauugaggcaccauggggagcaauaaacguccaaucuacuuucaaaccuacugugucaacugcaaacauagcacuuaguuggagcucaguggaacacagagguaauaagaucuugguuucaggcagaucagagucaaucaugaagcuagaagaaagaacaggaaucagcugggauuugggaguagaagaugccucugaguccaaauuacuuacuguuuccgucauggacuuaucacagauguacucuccugucuuugaguaccuaucaggugacagacaaguagaggaauggccaaaggcaaccuguacaggcgauugcccggaaagauguggcugcacaucaucaaccugccuacacaaggaauggccucacucaagaaacuggagaugcaaccccacuugguguuggggagucggcaccggaugcaccuguuguggacuagauguaaaggaccuuuuuacagauuacauguuuguuaaauggaaggucgaauauauaaaaacagaggcuauaguguguguugagcuuacuagccaagaaagacaauguagcuugauugaggcaggcacaagauucaacuuagguccugugacuaucacauuaucagagccaagaaacauucagcaaaagcucccuccagaaauugucacauuacauccuagaauugaagaagguuuuuuugacuuaaugcauguacagaagguacuaucagcaagcacagugugcaagcuacagaguugcacacauggcguaccaggagacuuacaggucuaccacaucggaaacuuacuaaaaggagacaaagugaaugggcaucugauacauaaaguugaaccacauuucaacaccuccuggaugucuugggacggcugugaccuagauuacuacugcaauaugggggauuggcccucuugcacguauacuggaguuacccaacauaaucaugcugcauuuguaaaccuacuuaacauugaaacugauuacacaaagaacuuccacuuucacucuaagagagucacugcacauggggacacuccacaauuagauuuaaaagccagaccaaauuauggugcaggugaaaucacugugcugguggaaguugcugacauggaguuacacacaaagaaaauugagauaucagguuugaaguuugcaagccuaaccugcacagguuguuaugcuuguagcucuggcaucucauguaagguuaggauccauguagaugaaccagaugagcuuacaguacaugugaagagugaagacccagacauaguugcugcuagcucaagucucauggcaagaaagcuugaauucgggacggauaguacauucaaagccuucucagccaugccuaaaaccuccuugugcuuuuacauuguugagagagaauacuguaaaagcugcaguaaagaagacacacaaaaguguguuaacgcaaagcuugagcgaccacagagcauuuuaauugagcacaaaggaacgauaauuggaaagcagaacgacacuugcacagcuaaagcaagcugcuggcuagagucagucaagaguuucuuuuauggacuaaagaacaugcuuaguggcauuuuuggcaauguuuucauagggauuuucuuauuccuugcuccuuuuauccuguuaauacuuuucuuuauguuuggguggagaauccuauucugcuuuaagugcugcaggagaacuagaggccuauuuaaguacagacaccucaaagaugaugaagaaaccgguuauaggaaaaucauugagagacuaaacaacaaaaaagguaaaaacaagcugcuugacggugaaagauuagcugauagaaagaucgcugagcuguucucuacaaaaacacacauuggc

SEQ ID NO: 3769 - RNA, 3495 nt, Artificial Sequence
  derived and/or modified CDS sequence (wt) from CCHVF(CCHVF 200406546-Turkey)__KR864902.1__Gn-NSm-Gc
uccgaagagccaggugaugacugcauaucaagaacucagcuauugaggacagaaacagcagagauucaugaugauaacuaugguggcccaggugauaaaauaacuaucugcaacgguucaacuauuguagaucagagacugggcagugaacuaggguguuauacuaucaacagggugaagucauucaagcuaugcgaaaacagcgccacagggaaaaccugugagauagacagcacuccaguuaagugcaggcaagguuuuuguuuaaaaaucacccaagagggaaggggccacguaaaauuaucuagaggcucagagguugucuuggacguuugcgacucaagcugugaaguaaugauaccuaaaggcacuggagauauccugguggacuguucagguggacagcaacauuucuuaaaagacaaccuaauugaccuagggugcccccaugucccgcuauuggguaggauggccauuuacauuugcagaaugucaaaucauccuagaacaacuauggcuuuucucuucugguucagcuuuggcuaugugaucaccuguauauuuugcaaggcucuuuuuuauucauugauaauuauugggacacuagggaaaaaguucaagcaguauagggaacugaaaccucaaacuuguaccauaugugagacggcuccugucaaugcaauagaugcugaaaugcaugaccuuaacugcaguuacaauauaugcccuuauugugcaucaagauugaccuccgacgggcuagcuaggcaugugccacaaugccccaagcggaaagaaaaaguugaggagacugaacuguacuugaaccuggagagaauuccuuggauugucagaaagcuauugcaggugucagaguccacugguguggcauugaaacgaagcagcuggcugauuguacugcuuguguuacucacaguuucguugucaccgguucaaucggcaccuguuggucaugguaagacaaucgaaacauaucagaccagagagggauucacaaguaucugucucuuuauguuaggaagcauccuauucauagucucuugcuuggugaaggggcuaguugacagugucagugacagcuucuuccccggccugucugucuguaagacaugcucuauuggcaguauaaauggcuuugaaaucgaaucgcauaaaugcuacuguagccuauuuugcugccccuacuguaggcacugcucugcugacagagaaauucaccaguuacacuugaguaucugcaaaaaaagaaaaacggggagcaaugucaugcuggcugucugcaaacgcaugugcuuuagggcaaccauagaagcaagcagaagagcccuacucauccgaagcauuaucaauacuacuuuuguaauaugcauucuaacauugacaaucuguguuguuagcaccucugcaguagagauggaaaaccuuccagcaggcaccugggagagagaggaagaccugacaaauuucugucaucaggaaugccaggugaccgagacggagugccucuguccauacgaagcucuugugcucagaaaaccucuguucuuagacaguauaguuaaaggcaugaaaaauuugcuaaacucaacaagcuuagaaacaaguuuaucaauugaggcaccauggggagcaauaaauguccagucaaccuuuaaaccaacaguaucgacugcaaauauagcacucaguuggagcucaauagagcacaggggcaacaagaucuuagucacaggcaggucugaaucaauuaugaagcuggaggaaaggacaggggucagcugggaucuaggcguagaagaugccucugaaucuaaauuacucacugucucuauuauggauuugucacaaauguacuccccuguuuuugaguacuugucaggagacagacagguugaggaauggcccaaagcaacgugcacaggugacugcccagaaaggugugguugcacaucaucaaccugcuugcauaaagaauggccucacucaagaaacuggagauguaaucccacuuggugcuggggaguaggaacuggcugcaccugcugcgggguggaugugaaagaccuuuuuacagaucacauguuugucaaauggaagguugaauauauaaaaacugaagccauaguauguguugagcucaccagccaagaaagacagugcagucugauugaggcagguacuagauucaacuugggcccugugacuauuacccugucugagccaagaaacauucagcagaagcuucccccugagauuaucacguugcaucccaaaguugaagaaggcuucuuugacuugaugcauguacaaaaaguguugucugcaaguacaguguguaaacugcaaagcugcacacaugguauaccaggagaucuacaaguuuaccacauuggcaacuugcugaaaggugauagaguaaacgggcaucuaauucacaaaauugaaccacauuucaacaccucuuggauguccugggaugguugugacuuagacuacuacugcaacaugggggauuggccuucuugcacauacacaggagugacccagcauaaccaugcugcauuuguaaacuugcuuaacauugaaacugauuacacgaaaaccuuccacuuccacucuaaaagagucacagcacauggugacacaccacaauuagacuuaaaagcaaggccgaccuacggugcaggugagaucacugugcugguugaaguugcugauauggagcugcauaccaagaaaguugagauaucaggcuugaaauuugcaagucuagcuugcacggguugcuaugcuuguagcucuggcaucuccuguaaagucaggauucauguagaugagccagaugagcucacaguacauguaaagagcagugauccugaugugguugcagcuagcacaagucucacggcgaggaagcuugaauuugggacagacagcacauucaaggccuuuucagcuaugcccaagaccucuuuauguuuuuacauuguggagaaagaauacugcaagagcugcaaugaagaugacacacaaaaauguguugacacaaagcuugagcagccacagagcauacuaauugagcacaaaggaacgauaauuggaaagcagaaugauacuugcacagccaaggcaagcuguuggcuggagucagucaagaguuuuuuuuauggauuaaagaauaugcuugguagugucuuugguaauuuuuucauaggcauuuuguuauuccuugccccuuuuguccuguuggugcuuuucuuuauguuuggauggaaaaucuuguuuugcuuuaaauguugcaggaggaccagaggcuuauuuaaguauagacaccucaaagacgaugaggaaacaggcuacaaaaggauuauugaaagauugaacaacaaaaaagggaaaaacagacugcuugauggugaaagguuggcugauaggaaaauugcugagcuguucuccacaaaaacacacauuggu

SEQ ID NO: 3770 - RNA, 3495 nt, Artificial Sequence
  derived and/or modified CDS sequence (wt) from CCHVF(CCHVF 1-CR/HU-2015)__KU161584.1__Gn-NSm-Gc
uccgaagagccaggugaugacugcauaucaagaacucagcuauugaggacagaaacagcagagauccaugacgacaacuacggcgguccaggugacaaaauaacuaucugcaaugguucaaccaucguagaucagagacugggcagugaacuaggguguuauaccaucaacagggugaagucauucaagcuaugcgaaaacagcgcuacagggaaaaccugugagauagacagcacuccggucaagugcaggcaagguuucuguuuaaaaaucacccaagagggaaggggccacguaaaauuaucuagaggcucagagguugucuuggaugcuugcgacucaagcugugaagugaugauaccuaaaggcaccggagauauccuaguagacuguucagguggacagcagcauuuuuuaaaagacaacuugauugaccuagggugcccccacaucccgcuauuggguaagauggccauuuacauuugcagaaugucaaaucauccuaggacaaccauggcuuuucucuucugguucagcuuuggcuaugugaucaccuguauauuuugcaaggcucuuuuuuauucauuaauaauuauugggacacuagggaaaaagaucaagcaguauagagaacuaaaaccucaaacuuguacuauaugugagacagcuccugucaaugcaauagaugcugaaaugcaugaccucaacuguaguuacaauauaugcccuuauugugcaucaagacugaccucugaugggcuagcuaggcauguaacgcaaugcccuaagcgaaaggagaaaguugaggagacugaacuguacuugaaccuagaaagaauuccuuggaucgucagaaagcuauugcaagugucagaguccacugguguggccuugaaacgaagcaguugguugauugugcugcuuguguuacucacaguuucauugucaccgguucaaucagcaccuguuggucaugguaagacaaucgaaacauaucagaccagagaaggauucacaaguaucugucucuuuauguuaggaagcauccuauucauagucucuugcuuggugaaggggcugguugacagcgucagugacagcuucuuccccggccugucugucuguaggacaugcucuauuggcagcauaaauggcuuugaaauugagucgcauaagugcuacuguagcuuauuuugcugccccuacuguaggcacuguucugcugacagagaaauucaccaguuacacuugaguaucugcaaaaaaagaaaaacggggagcaaugucaugcuggcugucugcaaacgcauguguuuuagggcaaccauggaggcaagcagaagagcccugcucauccgaagcauuaucaauaccacuuuuguaauaugcauucuaacauuaacaaucuguguugucagcaccucugcaguagagauggaaaaccuuccagcaggcacuugggagagagaggaagaccugacaaauuucugucaucaggaaugccagguaaccgagacggagugccucuguccauacgaagcucuugugcucaggaaaccccuuuuccuagacaguauaguuaaagguaugaaaaauuugcuaaacucgacaagcuuagaaacaagcuuaucaauugaggcaccauggggagcaauaaauguccagucaaccuuuaaaccaacaguaucaacugcaaacauagcacucaguuggagcucaguggagcacagaggcaacaagaucuuagucacaggcaggucugaaucaauuaugaaacuagaggaaaggacaggagucagcugggaucuaggcguagaagaugccucugaauccaaauuacuuaccgucucuauaauggauuuaucacaaauguauuccccuguuuuugaguacuugucaggagacagacagguugaagaguggcccaaagcaacuuguacaggugauugcccagaaagguguggcugcacaucaucaaccugcuugcauaaagaauggccucacucaagaaacuggagauguaaucccacuuggugcuggggaguaggaaccggcugcaccuguugcgggguggauguaaaagaccuuuuuacagaucacauguuugucaaauggaagguugaauauauaaaaacugaagccauaguauguguugagcucaccagccaggaaagacagugcagucuuauugaggcagguacaagauucaacuuaggcccugugacuaucacccugucugagccaagaaacauucagcagaagcuucccccugagaucauuacguugcaucccaaaauugaagaaggcuucuuugacuugaugcauguacaaaaaguguugucugcaaguacaguguguaaacugcagaguugcacacaugguauaccaggagaccuacaaguuuaccacauuggcaacuuguugaaaggggauagaguaaacgggcaucuaauucacaaaauugaaccacauuuuaacaccucuuggauguccugggaugguugugaucuagacuacuacugcaacaugggggacuggccuucuugcacauacacaggagugacccagcauaaucaugcugcauuuguaaacuugcuuaacauugaaacugauuacacgaaaaccuuccacuuccacucuaaaagagucacagcacauggugacacaccacaauuagacuuaaaagcaaggccgaccuacggugcaggugagaucacugugcugguugagguugcugacauggaguugcauaccaaaaaaguugagauaucaggcuugaaauuugcaagccuggcaugcacggguugcuaugcuuguagcucuggcaucuccuguaaagucagaauucauguagaugaaccagaugagcucacagugcauguaaagagcagugauccagacgugguugcagcuagcacaagucuuauggcaaggaagcuugaauuugggacagacagcacauucaaggccuuuucagcuaugccuaaaaccucuuuauguuuuuacauuguggagagagaauacugcaagagcugcagugaagaugauaccaaaaaauguguugacacaaaacuugagcagccacagagcauacuaauugagcacaaagggacgauaauuggaaagcagaaugauacuugcacagccaaggcaagcuguuggcuagagucagucaagaguuuuuuuuauggauugaagaauaugcucggcaguguuuuuggcaauuuuuuuauaggcauuuuguuauuccuugccccuuuuguccuguuggugcuuuucuuuauguuuggauggaaaaucuuguuuugcuuuaaauguugcaggaggaccagaggcuuguuuaaguauagacaccucaaagacgaugaggaaacaggcuacagaaggauuauugaaagacugaacaacaaaaaggggaaaaacagacugcuugauggugaaagguuggcugauaggaaaauugcugagcuguucuccacaaaaacacacauuggc

SEQ ID NO: 3771 - RNA, 3495 nt, Artificial Sequence
  derived and/or modified CDS sequence (wt) from CCHVF(CCHVF 1231-CR/TI-2015)__KU161585.1__Gn-NSm-Gc
uccgaagagccaggugaugacugcauaucaagaacucagcuauugaggacagaaacagcagagauccaugacgacaacuacggcgguccaggugacaaaauaacuaucugcaaugguucaaccaucguagaucagagacugggcagugaacuaggguguuauaccaucaacagggugaagucauucaagcuaugcgaaaacagcgcuacagggaaaaccugugagauagacagcacuccggucaagugcaggcaagguuucuguuuaaaaaucacccaagagggaaggggccacguaaaauuaucuagaggcucagagguugucuuggaugcuugcgacucaagcugugaaguaaugauaccuaaaggcaccggagauauccuaguagacuguucagguggacagcagcauuuuuuaaaagacaacuugauugaucuagggugcccccacaucccgcuauuggguaagauggccauuuacauuugcagaaugucaaaucauccuagaacaaccauggcuuuucucuucugguucagcuuuggcuaugugaucaccuguauauuuugcaaggcucuuuuuuauucauuaauaauuauugggacacuagggaaaaagaucaagcaauauagagaacugaaaccucaaacuuguacuauaugugagacagcuccugucaaugcaauagaugcugaaaugcaugaccucaacuguaguuacaauauaugccccuauugugcaucaagacugaccucugaugggcuagcuaggcauguaacgcaaugcccuaagagaaaggagaaaguugaggagacugaacuguacuugaaccuagaaagaauuccuuggaucgucagaaagcuauugcaagugucagaguccacugguguggccuugaaacgaagcaguugguugauugugcugcuuguguuacucacaguuucauugucaccgguucaaucagcaccuguuggucaugguaagacaaucgaaacauaucagaccagagaaggauucacaaguaucugucucuuuauguuaggaagcauccuauucauagucucuugcuuggugaaggggcugguugaaagugucagugauagcuucuuccccggccugucugucuguaggacaugcucuauuggcagcauaaauggcuuugaaauugagucgcauaagugcuacuguagcuuauuuugcugccccuacuguaggcacuguucugcugacagagaaauucaccaguuacacuugaguaucugcaaaaaaagaaaaacggggagcaaugucaugcuggcugucugcaaacgcauguguuuuagggcaaccauggaagcaagcagaagagcccugcuuauccgaagcauuaucaauaccacuuuuguaauaugcauucuaacauuaacaaucuguguugucagcaccucugcaguagagauggaaaaccuuccagcaggcacuugggagagagaggaagaccugacaaauuucugucaucaagaaugccagguaaccgagacggagugccucuguccauaugaagcucuugugcucaggaaaccccuuuuccuagacaguauaguuaaagguaugaaaaauuugcuaaacucgacaagcuuagaaacgagcuuaucaauugaggcaccauggggagcaauaaauguccagucaaccuuuaaaccaacaguaucaacugcaaacauagcacucaguuggagcucaguggagcacagaggcaacaagaucuuagucacaggcaggucugaaucaauuaugaaacuagaggaaaggacaggagucagcugggaucuagguguagaagaugccucugaauccaaauuacuuaccgucucuauaauggauuuaucacaaauguauuccccuguuuuugaguacuugucaggagacagacagguugaagaguggcccaaagcaacuuguacaggugauugcccagaaagguguggcugcacaucaucaaccugcuugcauaaagaauggccucacucaagaaacuggagauguaaucccacuuggugcuggggaguaggaaccggcugcaccuguugcgggguggauguaaaagaccuuuuuacagaucacauguuugucaaauggaagguugaauauauaaaaacugaagccauaguauguguugagcucaccagccaggaaagacagugcagucuuauugaggcagguacaagauucaacuuaggcccugugacuaucacccugucugagccaagaaacauucagcagaagcuucccccugagaucauuacguugcaucccaaaauugaagaaggcuucuuugacuugaugcauguacaaaaaguguugucugcaaguacaguguguaaacugcagaguugcacacaugguauaccaggagaccuacaaguuuaccacauuggcaacuuguugaaaggggauagaguaaacgggcaucuaauucacaaaauugaaccacauuuuaacaccucuuggauguccugggaugguugugaucuagacuacuacugcaacaugggggacuggccuucuugcacauacacaggagugacccagcauaaucaugcugcauuuguaaacuugcuuaacauugaaacugauuacacgaaaaccuuccacuuccacucuaaaagagucacagcacauggugacacaccacaauuagacuuaaaagcaaggccgaccuacggugcaggugagaucacugugcugguugagguugcugacauggaguugcauacaaaaaaaguugagauaucaggcuugaaauuugcaagccuggcaugcacggguugcuaugcuuguagcucuggcaucuccugcaaagucagaauucauguagaugaaccagaugagcucacagugcauguaaagagcagugauccagaugugguugcggcuagcacaagccuuauggcaaggaagcuugaauuugggacagacagcacauucaaggccuuuucagcuaugccuaaaaccucuuuauguuuuuacauuguggagagagaauacugcaagagcugcagugaagaugauacaaaaaaauguguugacacaaaacuugagcagccacagagcauacuaauugagcacaaagggacgauaauuggaaagcagaaugauacuugcacagccaaggcaagcuguugguuagagucagucaagaguuuuuuuuauggauugaagaauaugcucggcaguguuuuuggcaauuuuuuuauaggcauuuuguuauuccuugccccuuuuguccuguuggugcuuuucuuuauguuuggauggaaaaucuuguuuugcuuuaaauguugcaggaggaccagaggcuuguuuaaguauagacaccucaaagacgaugaggaaacaggcuacagaaggauuauugaaagacugaacaacaaaaaggggaaaaacagacugcuugauggugaaagguuggcugauaggaaaauugcugagcuguucuccacaaaaacacacauuggc

SEQ ID NO: 3772 - RNA, 3495 nt, Artificial Sequence
  derived and/or modified CDS sequence (wt) from CCHVF(CCHVF Gaib)__KX013445.1__Gn-NSm-Gc
uccgaagaauccagugaugacugcauaucaagaacucagcuauuaaggacagagacugcagaaauccauaaugauaauuauggagggccaggugacaaaauaacuauuuguaaugguucaacuauuguagaucaaaggcuaggcagugaacugggauguuacacuaucaauagaguaaagucauuuaagcuaugcgaaaacagugcuacagggaaauccugugaaauagauagcaucccuguaaagugcaggcaaggguuuuguuuaaaaauuacucaggagggaagaggccaugugaaguugucaagagguucagaaguugucuuagaugccugugauucaagcugugaaauaaugauaccaaaaggcaccggagacauccuaguggacuguucaggugggcaacaacauuuuuuaaaggauaacuugauugacuuagggugucccaauaucccacuguuaggcaaaauggcuaucuacauuuguagaaugucuaaucaucccaaaacaaccauggccuuucucuuuugguuuaguuuugguuaugugauaaccuguauauuuugcaaagccaucuuuuauuuguugauaaucguggggacacuuggaaaaaaguucaaacaguauagagaguuaaaaccucagaccuguaccauaugugaaacaacuccugucaacgcaauagacgcugaaaugcaugaucuuaacugcaguuacaauauaugcccuuauugugcaucuagauuaaccucagauggacuugccagacacguugugcacugcccuaagcggaaggagaaaauagaagagacugaacuguacuuaaacuuagaaagaguuccuuggguuguuagaaaacuacuucaggugucugaaucaacugguguggcacugaagaggagcaguuggcuaauugugcuacuugugcuacuuacagucucauugucaccaguucaaucagcacccaucggucauggaaagacgauugagacuuaucaaacuagagaaggguacacaagcauuugucuauuuguacuagguggcaucuuguuuaucgucucuugccuaaugaaggggcugguugacagugucggcaauaauuuuuucccuggguuaacuaucugcaaaacauguuccaucagcaguauaaacggcuuugaaauugaaucccacaaaugcuacuguaguuuacuuugcugcccuuauuguagacacugcucugcugacagagagauacaucaguugcaccuaaguaucugcaaaaaaagaaaaacagggaguaaugucauguuagccgucugcaagcgcaugugcuuaaggguaacuacagaaguaagcaacagggcucuauucauccgaagcaucaucaacaccacauuuguuauaugcauacuuauacuagcagucugcguuaucagcaccuccgcaguagagauggaaaaccugccagcaggcaccugggagagagaagaagaccuaacaaacuucugucaccaagaaugucaaguaacggagacugaaugucuauguccuuacgaagcucuugugcucaggaaaccccuguucucagacagcauaguuaagggcaugaaaaaccugcugaacucaacaaguuuagagacaaguuuaucaauugaggcaccauggggagcgauaaauguccaaucaaccuuuaaaccuacuguaucaacugcaaauauagcacucaguuggagcucaauagagcacagaggcaacaagauucuggucucaggcagaucagagucaaucaugaagcuagaagagaggacaggaaucagcugggaccuaggcguggaagaugcuuccgagucuagguuacuuacuguuucuguuauggauuugucacaaauguacucucccguuuuugaauaccugucaggugacagacagguggaggaauggccuaaagcaaccugcacaggcgacuguccugaaagauguggaugcacaucgucaaccugcuuacacaaagaauggccucauucaagaaauuggagaugcaaucccacuuggugcuggggaguugguaccgggugcaccugcuguggacuagauguaaaagaccuuuuuacagacuauauguuugucaaauggaaagucgaguacauaaagacagaggcuauaguguguguugaacuuacaagccaagaaaggcaaugcaguuugauugaggcaggcacaagauucaacuuagguccagugaccaucacauugucagaaccgagaaacauucagcaaaagcuuccuccugaaauaaucacauugcacccuagaauugaagaaggcuucuuugaccuaaugcacgugcagaaagugcugucugcuaguacgguguguaaacuacagaguugcacacacggugugccgggggaucuacaggucuaccacauuggcaauuuguuaaaaggggauaaggugaacggacaucugauucacaagauugaaccacacuucaacacuucuuggauguccugggaugguugugaccuggacuacuacugcaauaugggggauuggccuuccugcacguauacuggaguaacccaacauaaccacgccgcauuugugaaccugcucaacauugaaacugauuauaccaaaaacuuccacuuccacucuaagagaguuacugcacauggagacacaccgcaauuggauuugaaggcuagaccaaccuauggugcaggcgagaucacugugcugguagaaguugcugacauggagcuacacacaaaaaagauugagauaucaggccugaaauuugcgagucuaacuugcacagguugcuaugcuugcagcucuggcaucuccuguaaaguuaggauccauguagaugaaccagaugagcuuacagugcaugugaaaagugaagauccagacauaguugcagcuagcucaagucucauggcaaggaagcuugaauuugguacagacaguaccuuuaaagccuuuucagcuaugcccaaaaccucuuuaugcuuuuacauuguagagagagaauauugcaagagcugcaguagagaagacacacaaaaaugugucagcacaaaacuugagcaaccacagagcauuuuaauugaacacaaaggaacgauaaucggaaaacagaauaacaccugcacaacuaaaacaaccuguugguuggaaucaguaaagaguuucuuuuauggacuaaagaacaugcuuagcaguauuuuuggcaauguuuucgugggcauuuucucauuccuugccccuuucaucuuacugauacuuuucuucauguuuggguggagaauccuauuuugcuuuaaguguugcagaaggacuagaggcuuauuuaaguacagacaucucaaagacgaugaagagaccgguuauaggaggaucauugaaagauuaaacaacaaaaaaggaaagagcaaguugcuugauggugaaagguuggcugauaggaagauugcugagcuguucuccacaaaaacacacauugga

SEQ ID NO: 3773 - RNA, 3495 nt, Artificial Sequence
  derived and/or modified CDS sequence (wt) from CCHVF(CCHVF Hodzha)__KX013448.1__Gn-NSm-Gc
ucugaagaaucuggugacgacugcauaucaagaacucagcuacugaggacagagacugcagagauccauggugaugauuauggugguccgggcgacaagauuaccauuugcaaugguucaacuauuguagaucaaagacuagguagugaacugggguguuacacuaucaauagagugaagucauucaagcugugcgaaaacagugcaacagggaagagcugugaaauagacagcaccccaguuaaaugcaggcaggguuauugccuaaaaaucacucaggaaggaaggggccaugugaaauuauccaggggcucggagguugucuuggaugcaugcgauucaagcugugaaguaaugauaccuaagggcacaggugacauccuaguagacuguucaggugggcagcaacauuuuuugaaagacaacuuaauugaucuaggaugucccagaauuccauuauuagguaaaauggcuauuuauauuugcagaaugucgaaucacccugagacaaccauggcuuuccucuuuugguucaguuucggcuaugugauaaccuguauacucugcaaggccauuuucuacuuauuaauaauuguuggaacacuagggaagagguucaagcaguauagagaguuaaaaccccagaccuguaccauaugugagacaacuccugcaaaugcaauagaugcugaaaugcaugaccuuaacugcaguuacaacauaugucccuauugugcaucuagacuaaccucagaugggcuugcuaggcaugugacacaaugcccuaagcggaaggagaagguagaagaaacugaauuguacuugaacuuagagagaauucccuggauuguaagaaagcuguugcaggugucggaguccacugguguugcauuaaaaagaagcagcuggcugauugugcugcuugugcuguucgcaguuucauuaucaccuguucaaucagcacccauuggucaugggaagacaauugaaacauaccaggccagggaagaauacacaaguauuugccucuuuguacugggaagcaucuuguuuauagucucuugucugaugaaagggcugguugacaguauuggcaacaucuucuucccugggcugaccaucugcaagacaugcucuauagguaguaucaauggcuuugaaauugagucucacaagugcuauuguagcuuacuuuguugccccuacuguaggcacugcccugcugauagagaaauucaucagcugcacuugagcaucugcaaaaaaaggaaaacaggaaguaaugucaugcucgcagucugcaagcgcaugugcuucagagcaacuauggaagugagcaauaaggcccuacuuauccguagcaucaucaacaccacuuuuguugugugcauauugauauuagcagucuguguuguuagcaccucagcgguagagauggaaagccuaccagcugggaccugggaaagagaagaagaccuaacaaauuucugucaucaggaaugccagguuacagagacugagugccucugcccuuaugaagcccuugugcucagaaggccccuguuccuggauaguauaguuaaaggcaagaaaaaucuguuaaacuccacaaguuuagaaacaagcuugucgauugaggcaccauggggggcaauaaauguucagucaaccuacaaaccaacuguaucaacugcaaacauagcacuuaguuggaguucaguugaacacagagguaauaagauuuugguuucaggcagaucagaaucaauuaugaagcuggaagaaagaacaggaaucagcugggaucuuggcguugaagaugccucugaaucuaagcuacuuacugucucugucauggacuugucucagauguacuccccugucuucgaguacuuaucgggugacagacaaguagaagaguggcccaaggcaaccugcacaggugacugcucagaaagauguggcugcacaucaucaaccugcuuacauaaagaauggccccauucacgaaacuggagaugcaaucccacuuggugcugggggguggggacuggcugcaccuguuguggauuagaugugaaagaccuauuuacagauuauauguucgucaaguggaaaguugauuacauuaaaacagaggccauaguguguguagaacucaccagucaggaaaggcaguguagcuugguugaggcgggcacaagguucaauuuagguccuguaaccaucacauugucagaaccgaggaacauacaacaaaagcucccuccugaaauaaucacauugcauccuaggauugaagaagguuuuuuugaccugaugcauguacaaaaagugcugucagcaagcacaguguguaaauugcagaguugcacacauggugugccaggagaucuacaggucuaccacaucggaaauuuauuaaaaggagauaaagugaacggacaccuaauucauaaaauugagccgcacuucaauacuuccuggauguccugggauggcugugaccuagacuacuacugcaacaugggagacuggccuucuugcacauauaccggaguuacucaacacaaucaugcuucauuuguaaaccugcucaacauugaaacugacuauacaaaaagcuuccacuuucacucuaaaaggguuacugcacauggagacacaccacaauuggaucugaaggcaagaccaaccuacggcgcaggagaaaucacuguacugguagaaguugcugauauggaguuacacacaaagaagaucgaaauaacaggccucaaauuugcaagccugacuugcacagguuguuaugcuuguaguucaggcaucuccugcaaaguuaggauucacguggaugaaccagaugagcuaacaguacauguuaaaagugaugauccagauguaguugcagccagcucaagucucauggcaaggaaacuugaguuuggaacagacaguacauucaaagcuuucucagccaugccuaaaacuuccuuaugcuucuacauugucgaaagggaguacuguaagagcugcaguaaagaagacacacagaaauguguuaacacaaaacuugagcaaccacagagcauuuugaucgaacaaaagggaacuauaaucggaaagcaaaacaauacuugcacagccaaggcaaguugcugguuagagucaguuaaaaguuucuuuuauggucuaaagaacaugcuuaguggcauuuuuggcaauguuuuuguaggcauuuucuuauuucuugcccccuuuaucuuguuaauacuuuucuucauguuuggauggaggauccuguuuugcuucaaguguugcagaagaaccaggggccuguuuaaguauaaacaucucaaagacgaugaagaaacugguuacagaaggaucauugaaagacugaacaacaagaaggggaaaaacaagcugcuugacggugaaagacuugccgauagaaggauugccgaacuauucuccacaaaaacacacauuggc

SEQ ID NO: 3774 - RNA, 3495 nt, Artificial Sequence
  derived and/or modified CDS sequence (wt) from CCHVF(CCHVF IbAn7620)__KX013451.1__Gn-NSm-Gc
uccgaagaacccagugaugacuguauaucaagaacucaacuauugaggacagagacugcagagauccacggcgacaacuaugguggcccgggugauaaaauaaccaucugcaauggcucaacuauuguagaccaaagacugggcagugaacuaggguguuacaccaucaauagagugaagucauucaagcuaugcgaaaacagugccacagggaagaauugugaaauagacagugucccaguuaaaugcaggcaggguuauugccuaagaaucacucaagaagggaggggccacguaaaauuaucuaggggcucagagauugucuuagaugcaugcgauacaagcugugaaauaaugauaccuaagggcacuggugacauccuaguugacuguucaggugggcagcaacauuuucuaaaggacaauuugauagaucuaggaugcccuaaaauuccauuauugggcaaaauggcuauuuacauuugcagaaugucgaaccaccccaaaacaaccauggcuuuccucuucugguucagcuuugguuauguaauaaccuguauacuuugcaaggccauuuuuuacuuguuaauaauuauuggaacacuagggaaaaggcucaagcaguauagagaguugaaaccucagaccugcaccauaugugagacaacuccuguaaaugcaauagaugcugagaugcaugaccucaauugcaguuacaacauuugucccuacugugcaucuagacuaaccucagaugggcuugcuaggcaugugauacaaugcccuaagcggaaggagaaaguggaagaaacugaacuguacuugaacuuagaaagaauuccuuggguuguaagaaagcuguugcaggugucagagucaacugguguggcauugaaaagaagcaguuggcugauugugcugcuugugcuauucacuguuucauuaucaccaguucaaucagcacccauuggucaagggaagacaacugaggcauaccgggccagggaaggguacacaaguauaugucucuuuguacuaggaaguauccuauuuauaguuucuugccuaaugaaagggcugguugacaguguuggcaacuccuucuucccuggacuguccauuugcaaaacgugcuccauaagcagcauuaauggcuuugaaauugagucccauaagugcuauugcagcuuauucuguugccccuauuguaggcacugcucuaccgauaaagaaauucauaagcugcacuugagcaucugcaaaaagaggaaaacaggaaguaaugucauguuggcugucugcaagcgcauguguuucagggccaccauggaagugaguaacagagcccuguuuauccguagcaucaucaacaccacuuuugucuugugcauacugauacuagcaguuuguguuguuagcaccucagcaguggagauggaaaaccuaccagcagggaccugggaaagagaagaagaucugacaaauuucugucaucaggaaugccagguuacagagacugaaugccucugcccuuaugaagcucuaguacucagaaagccuuuguuccuagauaguauagcuaaaggcaugaaaaauccgcuaaauucaacaaguuuagaaacgaguuuaucaauugaggcaccauggggagcaauagauguucagucaaccuacaaaccaacugugucaacugcaaacauagcacucaguuggagcucaguggaacacagagguaauaagaucuugguuucaggcagaucagaaucaauuaugaagcuagaagaaaggacgggaaucagcugggaucucggcguagaagaugccucugagucuaaacugcuuacagucucugucauggaccugucucagauguacucuccugucuucgaguacuuaucaggggacagacagguggaagaguggcccaaagcaacuuguacaggugauugcccagaaagaugugguugcacaucaucaaccuguuugcacaaagaauggccucacucaagaaauuggagaugcaaucccacuuggugcuggggaguagggacuggcugcaccuguuguggauuagaugugaaagaccuuuuuacagauuauauguuugucaaguggaaaguugaauacaucaagacagaggccauaguguguguagaacuuaccagucaggaaaggcaguguagcuugauugaagcgggcacgagguucaauuuagguccugugaccaucacacugucagaaccaagaaacauccaacaaaaacucccuccugaaauaaucacacugcauccuaggaucgaagaagguuuuuuugaucugaugcaugugcaaaagguguuaucggcaagcacaguguguaaguugcagaguugcacacauggugugccaggagaccuacaggucuaccacaucggaaauuuauuaaaaggggauaagguaaauggacaucuaauucauaaaauugagccacacuucaacacuuccuggauguccugggaugguugugaccuagacuacuacugcaacaugggagauuggccuucuugcacauacacaggggucacccaacacaaucaugcuucauuuguaaacuuacucaacauugaaacugauuacacaaagaacuuccacuuucacucuaaaagggucacugcacacggagacacaccacaacuagaucuuaaggcaagaccaaccuauggugcaggcgagaucacuguucugguagaaguugcuaacauggaguuacauacaaagaagauugaaauaucaggcuuaaaauuugcaagcuugacuuguacagguuguuaugcuuguagcucuggcaucucaugcaaaguuagaauucauguggaugaaccagaugaacuuacaguacauguuaaaagugaugauccagaugugguugcagcuagcucaagucucauggcaagaaagcuugaauuuggaacagacaguacauuuaaagcuuucucggccaugcccaaaacuucucuauguuucuacauuguugaaagagaacacuguaagagcugcagugaagaagauacaaaaaaauguguuaacacaaagcuugagcaaccacaaagcauuuugaucgaacacaagggaacuauaauaggaaagcaaaacagcacuugcacggcuaaggcgaguugcugguuggagucagucaagaguuuuuuuuauggccuaaagaacaugcuuaguggcauuuuuggcaaugucuuuaugggcauuuucuuguuccuugcccccuucauccuguuaauacuauucuuuauguuuggguggaggauccuauucugcuuuaaauguuguagaagaaccagaggccuguucaaguacagacaccucaaagacgaugaagaaacugguuauagaaggauuauugaaagacuaaacaauaaaaaaggaaaaaacaagcugcuugauggugaaagacuugcugauagaagaauugccgaacuguucucuacaaaaacacacauuggc

SEQ ID NO: 3775 - RNA, 3495 nt, Artificial Sequence
  derived and/or modified CDS sequence (wt) from CCHVF(CCHVF K128_76)__KX013454.1__Gn-NSm-Gc
ucugaugaaucuggugaugacugcauaucaaggacucagcuguugagaacagagacugcagagauccauggugacaauuauggugguccgggugacaagauuaccauuugcaaugguucaacuauuguagaccaaagacuggguagugaacugggguguuacacuaucaauagagugaagucauucaagcugugcgaaaacagugccacagggaagagcugugaaauagacaguaucccaguuaagugcaggcaggguuauugccuaaaaaucacucaagaaggaaggggccaugugaaauuauccaggggcucagagguugucuuggaugcaugcgacucaagcugugaaguaaugauaccuaagggcacaggugacauucuaguagacuguucaggugggcagcaacauuuuuugaaggacaacuugauugaccuaggaugucccaaaauuccauuguugggcaaaauggcuauuuauauuuguagaaugucgaaucaccccaaaacgaccauggcuuuccucuuuugguucaguuuuggcuaugugauaacuuguauagucugcaaagccauuuuuuacuuauuaauaauuguuggaacacuagggaagagguuuaagcaguauagagaguuaaaaccccagaccuguaccaucugugagacaacuccuacaaaugcaauagaugcugaaaugcaugaccuuaacugcaguuacaacauaugucccuauugugcaucuagacuaaccucagaugggcuugcuaggcauguaacucauugcccuaagcggaaggagaaaguagaagaaacugaauuguacuugaacuuagaaagaauuccauggguuguaagaaagcuauugcagguaucagaguccaccgguguagcauuaaaaagaagcagcuggcugauugugcugcuugugcuguuugcaguuucauuaucaccaguucaaucagcacccauuagucaugggaagacaauugaaacauaccaggucagggaggaauacacaaguauuugccucuuuguacugggaagcauuuuguuuauugucucuugucuaaugaaagggcugguuaacaguguuggcaacaucuucuucccugggcuguccauuugcaagacgugcucuauagguaguauuaauggcuuugaaauugagucucauaagugcuauuguagcuuacuuuguugcccuuacuguaggcacugcucugcugauagagaaauucaucaacugcacuugagcaucugcaaaaaaagaaaaacaggaaguaaugucaugcuugcuguuugcaagcgcauguguuucagagcaacaauggaagugagcaacaaggcccuauuuauccguagcaucaucaacaccacuuuuguugugugcauuuugauacuagcagucuguguuguuagcacuucagcaguagagauggaaagccugccagcugggaccugggaaagagaagaagaccuaacaaauuucugucaucaggaaugccagguuacugagacugagugccucugcccuuaugaagcucuaguacucagaaggccccuguuucaggacaguauagucaaaggcaugaaaaaccugcuaaacucaacaaguuuagaaacaagcuugucgauugaggcaccauggggggcaauaaauguucagucaaccuacaaaccagcugugucagcugcaaacauagcacuuaguuggaguucaguugaacacagagguaguaagauuuugguuucaggcagaucagaaucaauuaugaagcuggaagaaaggacaggaaucagcugggaucuuggcguagaagaugccucugaaucuaagcuacuuacagucucugucauggacuugucucagauguacuccccugucuucgaguacuugucaggugacagacaaguagaagaguggcccaaggcaaccuguacaggugacugcccagagagaugugguuguacaucaucaaccuguuugcauaaagaauggccccauucaagaaacuggagguguaaucccacuuggugcugggggguagggacuggcugcaccuguugugguuuagaugugaaagaccuuuuuacagacuauauguucgucaaguggaaaguugaauauauuaagacagaggccauaguguguguagaacuuaccagucaggaaaggcaguguaguuuaauugaggcagguacaagguucaauuuagguccugugaccaucacauugucagaaccgaggaacauccaacaaaagcucccuccugaaauaaucacacugcauccuaggauugaagaagguuuuuuugaccugaugcaugugcaaaaggugcugucagcaagcacaguguguaaguugcagaguugcacacauggugugccaggagaucuacaagucuaccacaucgggaauuuacuaaaaggagauagaguuaacggacaccuaauucauaaaauugagccacacuuuaacacuucuuggauguccugggauggcugugaccuagacuauuacugcaacaugggagacuggccuucuugcacauauaccggaguuacccagcacaaucaugcuucauuugugaaccugcucaacauugaaacugacuauacaaaaagcuuccauuuucacucuaaaaggguuacugcacauggagacacaccacaauuagaucugaaggcaaggccaaacuauggcgcaggagagaucaccguacugguagagguugccgauauggaguuacacacaaagaagauugaaauaucaggccuaaaguuugcaagcuugacuuguacagguuguuaugcuuguaguuccgguaucuccuguaaaguuaggauucauguggaugaaccagaugaacuuacaguacauguuaaaagugaugauccagauguaguugcagcuagcucaagucucauggcaaggaagcuugaauuuggaacagacaguacauuuaaggcuuucucagccaugcccaaaaccuccuuauguuucuacauugucgaaagggaguacugcaagagcugcaguaaagaagacacacaaaaauguguuaacacaaaacuugagcagccacagagcauuuuaaucgaacauaagggaacuauaaucggaaagcaaaacaauaccugcacagcaaagacaaguugcugguuagagucaguuaaaaguuucuuuuaugguuuaaagaacaugcuuaguggcauuuuuggcaauguuuuuguggguauuuucuuauuucuugcccccuucaucuugcuaauacuuuucuuuauguuuggguggaggauccuguuuugcuucaagugcuguagaagaaccagaggccuguucagauauaagcaucucgaaaacgaugaagaaacugguuacagaagaaucauugaaagacugaacaacaaaaaaggaaaaaacaagcugcuugauggugaaagacuugcugauagaagaaucgccgaacuauucuccacaaaaacacacauuggc

SEQ ID NO: 3776 - RNA, 3495 nt, Artificial Sequence
  derived and/or modified CDS sequence (wt) from CCHVF(CCHVF K168_40)__KX013457.1__Gn-NSm-Gc
ucugaugagucuggugaugacugcauaucaaggacucagcuacugagaacagagacugcagagauccauggugacaauuauggugguccgggugacaagauuaccauuugcaaugguucaacuauuguagaccaaagacugggcagugaacugggguguuacacuaucaauagagugaagucauucaagcugugcgaaaacagugccacagggaagagcugugaaguagacaguaucccaguaaaaugcaggcaggguuauugccuaaaaaucacucaggaaggaaggggccacgugaaauuauccagagguucagagguugucuuggaugcaugcgauucaagcugugaaguaaugauaccuaagggcacaggugacauccuaguggacuguucaggugggcagcaacauuucuugaaggacaacuuaauugaccuaggaugucccaaaauuccauuguugggcaaaauggcuauuuauauuugcagaaugucgaaucaccccaagacaaccauggcuuuccucuuuugguucaguuuuggcuaugugauaacuuguauagucugcaaggccauuuuuuacuuauuaauaauuguuggaacacuagggaagagguuuaagcaguauagagaguuaaaaccccagaccugcaccaucugugagacaacuccuacaaaugcaauagaugcugaaaugcaugaccuuaacugcaguuacaacauaugucccuauugugcaucuagacuaaccucagaugggcuugcuaggcauguaacucauugcccuaagcggaaagagaaaguagaagaaacugaauuguacuugaacuuagagagaauucccuggguuguaagaaagcuguugcagguaucagaguccaccgguguagcauuaaaaagaagcagcuggcugauugugcugcuugugcuguuugcaguuucauuaucaccaguucaaucagcaccuauuggucaugggaagacaauugaaacauaccaggucagggaggaauacacaaguauuugccucuuuguacugggaaguaucuuguucauagucucuugucuaaugaaagggcugguuaacaguguuggcaacaucuucuucccugggcuguccauuugcaagacgugcucuauagguaguauuaauggcuuugaaauugagucucauaagugcuauuguagcuuacuuuguugcccuuacuguaggcacugcucugcugacagggaaauucaucaauugcacuugagcaucugcaagaaaagaaaaacaggaaguaaugucaugcuugcuguuugcaagcgcauguguuucagagcaacuguggaagugagcaacaaggcccuaucuauccguagcaucaucaacaccacuuuuguugugugcauuuuaauacuagcagucuguguuguuagcacuucagcaguagagauggaaagccuaccagcugggaccugggaaagagaagaagaucuaacaaauuucugucaucaggaaugccaggucacggagacugagugccucugcccuuaugaggcucuaguacucagaaggccccuguuucuggacgguauagucaaaggcaugaaaaaccugcuaaacucaacaaguuuggaaacaagcuugucgauugaggcaccauggggggcaauaaauguucagucaaccuacaaaccaacuguaucagcugcaaacauagcacuuaguuggaguucaguugaacacagagguaauaagauuuugguuucaggcagaucagaaucaauuaugaagcuggaagaaaggacaggaaucagcugggaucuuggcguagaagaugccucugaaucuaagcuacucacagucucugucauggacuugucucagauguacucuccugucuucgaguacuugucaggugacagacaaguagaagaguggcccaaggcaaccuguacaggugacugcccagagagauguggcuguacaucaucaaccuguuugcauaaagaauggccccauucaagaaacuggagguguaaucccacuuggugcugggggguagggacuggcugcaccuguugugguuuagaugugaaagaccuuuuuacagacuauauguuugucaaguggaaagucgaauacauuaagacagaggccauaguguguguagaacuuaccagucaggaaaggcaguguagcuuaauugaggcggguacaagguucaauuuaggucccgugaccaucacauugucagaaccgaggaacauccaacaaaaacucccuccugaaauaaucacacugcauccuaggauugaagaagguuuuuuugaccugaugcauguacaaaaggugcugucagcaagcacaguguguaaguugcagaguugcacacauggugugccaggagaucuacaggucuaccacaucggaaauuuacuaaaaggagauaaaguuaacggacaccuaauucauaaaauugaaccacacuucaacacuucuuggaugucuugggauggcugugaccuagacuacuacugcaacaugggagauuggccuucuugcacauauaccgggguuacccagcacaaucaugcuucauuuauaaaccugcucaacauugaaacugacuauacaaaaagcuuccauuuucacucuaaaaggguuacugcacauggagacacaccacaauuagaucugaaggcaaggccaaacuauggcgcaggagagaucaccguacugguagagguugccgauauggaguuacacacaaagaagauugaaauaucaggacuaaaguuugcaagcuugacuuguacagguuguuaugcuuguaguuccgguaucuccuguaaaguuaggauucauguggaugaaccagaugaacuuacaguacauguuaaaagugaugauccagauguaguugcugcuagcucaagucucauggcaaggaagcuugaauuuggaacagacaguacauuuaaggcuuucucagccaugccaaaaaccuccuuauguuucuauauugucgaaagggaauacugcaagagcugcaguaaagaagacacacaaaaauguguuaacacgaagcuugagcauccacagagcauuuugaucgaacauaagggaacuauaaucggaaagcagaacaauaccugcacagcaaagacaaguugcugguuagagucaguuaagaguuucuuuuaugguuuaaagaacaugcuuaguggcauuuucggcaacguuuuuguaggcauuuucuuauuucuugcccccuucaucuugcuaauacuuuucuuuauguuuggguggaggauccuauuuugcuucaagugcuguagaagaaccagaggccuguuuagauauaaacaucucgaagacgaugaagaaacugguuacagaagaaucauugaaagacugaacaacaaaaaaggaaaaaacaagcugcuugauggugaaagacuugcugauagaagaauugccgaacuauucuccacaaaaacacacauuggc

SEQ ID NO: 3777 - RNA, 3495 nt, Artificial Sequence
  derived and/or modified CDS sequence (wt) from CCHVF(CCHVF K168_125)__KX013460.1__Gn-NSm-Gc
ucugaugagucuggugaugacugcauaucaaggacucagcuacugagaacagagacugcagagauccauggugacaauuauggugguccgggugacaagauuaccauuugcaaugguucaacuauuguagaccaaagacugggcagugaacugggguguuacacuaucaauagagugaagucauucaagcugugcgaaaacagugccacagggaagagcugugaaguagacaguaucccaguaaaaugcaggcaggguuauugccuaaaaaucacucaggaaggaaggggccacgugaaauuauccagagguucagagguugucuuggaugcaugcgauucaagcugugaaguaaugauaccuaagggcacaggugacauccuaguggacuguucaggugggcagcaacauuucuugaaggacaacuuaauugaccuaggaugucccaaaguuccauuguugggcaaaauggcuauuuauauuugcagaaugucgaaucaccccaagacaaccauggcuuuccucuuuugguucaguuuuggcuaugugauaacuuguauagucugcaaggccauuuuuuacuuauuaauaauuguuggaacacuagggaagagguuuaagcaguauagagaguuaaaaccccagaccugcaccaucugugagacaacuccuacaaaugcaauagaugcugaaaugcaugaccuuaacugcaguuacaacauaugucccuauugugcaucuagacuaaccucagaugggcuugcuaggcauguaacucauugcccuaagcggaaagagaaaguagaagaaacugaauuguacuugaacuuagagagaauucccuggguuguaagaaagcuguugcagguaucagaguccaccgguguagcauuaaaaagaagcagcuggcugauugugcugcuugugcuguuugcaguuucauuaucaccaguucaaucagcaccuauuggucaugggaagacaauugaaacauaccaggucagggaggaauacacaaguauuugccucuuuguacugggaaguaucuuguucauagucucuugucuaaugaaagggcugguuaacaguguuggcaacaucuucuucccugggcuguccauuugcaagacgugcucuauagguaguauuaauggcuuugaaauugagucucauaagugcuauuguagcuuacuuuguugcccuuacuguaggcacugcucugcugacagggaaauucaucaauugcacuugagcaucugcaagaaaagaaaaacaggaaguaaugucaugcuugcuguuugcaagcgcauguguuucagagcaacuguggaagugagcaacaaggcccuaucuauccguagcaucaucaacaccacuuuuguugugugcauuuuaauacuagcagucuguguuguuagcacuucagcaguagagauggaaagccuaccagcugggaccugggaaagagaagaagaucuaacaaauuucugucaucaggaaugccaggucacggagacugagugccucugcccuuaugaggcucuaguacucagaaggccccuguuucuggacaguauagucaaaggcaagaaaaaccugcuaaacucaacaaguuuggaaacaagcuugucgauugaggcaccauggggggcaauaaauguucagucaaccuacaaaccaacuguaucagcugcaaacauagcacuuaguuggaguucaguugaacacagagguaauaagauuuugguuucaggcagaucagaaucaauuaugaagcuggaagaaaggacaggaaucagcugggaucuuggcguagaagaugccucugaaucuaagcuacucacagucucugucauggacuugucucagauguacucuccugucuucgaguacuugucaggugacagacaaguagaagaguggcccaaggcaaccuguacaggugacugcccagagagauguggcuguacaucaucaaccuguuugcauaaagaauggccccauucaagaaacuggagguguaaucccacuuggugcugggggguagggacuggcugcaccuguugugguuuagaugugaaagaccuuuuuacagacuauauguuugucaaguggaaagucgaauacauuaagacagaggccauaguguguguagaacuuaccagucaggaaaggcaguguagcuuaauugaggcggguacaagguucaauuuaggucccgugaccaucacauugucagaaccgaggaacauccaacaaaaacucccuccugaaauaaucacacugcauccuaggauugaagaagguuuuuuugaccugaugcauguacaaaaggugcugucagcaagcacaguguguaaguugcagaguugcacacauggugugccaggagaucuacaggucuaccacaucggaaauuuacuaaaaggagauaaaguuaacggacaccuaauucauaaaauugaaccacacuucaacacuucuuggaugucuugggauggcugugaccuagacuacuacugcaacaugggagauuggccuucuugcacauauaccgggguuacccagcacaaucaugcuucauuuauaaaccugcucaacauugaaacugacuauacaaaaagcuuccauuuucacucuaaaaggguuacugcacauggagacacaccacaauuagaucugaaggcaaggccaaacuauggcgcaggagagaucaccguacugguagagguugccgauauggaguuacacacaaagaagauugaaauaucaggccuaaaguuugcaagcuugacuuguacagguuguuaugcuuguaguuccgguaucuccuguaaaguuaggauucauguggaugaaccagaugaacuuacaguacauguuaaaagugaugauccagauguaguugcugcuagcucaagucucauggcaaggaagcuugaauuuggaacagacaguacauuuaaggcuuucucagccaugccaaaaaccuccuuauguuucuauauugucgaaagggaauacugcaagagcugcaguaaagaagacacacaaaaauguguuaacacgaagcuugagcauccacagagcauuuugaucgaacauaagggaacuauaaucggaaagcagaacaauaccugcacagcaaagacaaguugcugguuagagucaguuaagaguuucuuuuaugguuuaaagaacaugcuuaguggcauuuucggcaacguuuuuguaggcauuuucuuauuucuugcccccuucaucuugcuaauacuuuucuuuauguuuggguggaggauccuauuuugcuucaagugcuguagaagaaccagaggccuguuuagauauaaacaucucgaagacgaugaagaaacugguuacagaagaaucauugaaagacugaacaacaaaaaaggaaaaaacaagcugcuugauggugaaagacuugcugauagaagaauugccgaacuauucuccacaaaaacacacauuggc

SEQ ID NO: 3778 - RNA, 3495 nt, Artificial Sequence
  derived and/or modified CDS sequence (wt) from CCHVF(CCHVF K229_194)__KX013463.1__Gn-NSm-Gc
uccgaagagccaggugacgacugcauaucaagaacucagcuauugaagacagaaacagcagagauccaugacgacaacuauggugguccaggugacaaaauaacuaucugcaaugguucaaccauuguagaucagagacugggcagugaacuaggguguuauaccaucaacagggugaagucauucaagcuaugcgaaaacagugccacagggaaaaccugugagauagacagcacuccggucaagugcaggcaagguuuuuguuugaaaaucacccaagagggaaggggccacguaaaauuauccaggggcucagagguuguuuuggaugcuugcgacucgagcugugaaauaaugauaccuaaaggcacuggagauauccuaguagacuguucagguggacagcaacauuucuuaaaaggcaacuugauugaccuagggugcccucauaucccgcuauuggguaagauggccauuuacauuugcagaaugucaaaucaucccaggacaaccauggcuuuccucuucugguucaguuuuggcuauguaaucaccuguauauuuugcaaggcucuuuuuuauucauugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuagcuaggcaugugacacaaugcccuaagcgaaaggagaaaguugaggagacugaacuguauuugaaccuggaaagaauuccauggauagucagaaagcuguugcaaguaucagaguccacugguguggcauugaaacgaagcagcuggcugauugugcugcuuguguuacucacagucucauugucaccgguucaaucagcaccuguuggucaugguaagacaaucgaaacauaucagaccagagaaggauucacaaauaucugucucuuuauguuaggaagcauccuauucauaguuucuugccuggugaaggggcugguugacagugucagugacagcuucuuccccggccugucugucuguaagacaugcucuauuggcaguauaaauggcuuugaaauugaaucgcauaaaugcuacuguaguuuauuuugcugccccuacuguaggcacugcucugcugacagagaaauucaccaguugcacuuggguaucugcaaaaaaagaaaaacggggagcaaugucaugcuggcugucugcaagcgcaugugcuuuaaggcaaccauagaagcaagcagaagagcccugcucauccgaagcauuaucaauaccacuuuuguaauaugcauccuaacauuagcaaucuguguuguuagcaccucugcaguagagauggaaaaucuuccagcaggcacuugggagagagaggaagaccugacaaguuucugccaucaggaaugccagguaaccgagacggaaugccucuguccauacgaagcucuugugcucaggaaaccucuuuuuuuagacaguauaguuaaagguaagaaaaaucugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggaccugucacaaauguauuccccuguuuuugaguacuuaucaggagauagacagguugaagaauggcccaaggcaaccugcacaggugauugcccagaaagguguggcugcacaucaucaaccugcuugcauaaagaauggccucacucaagaaacuggagauguaaucccacuuggugcuggggaguaggaaccggcugcacaugcugcggaguggauguaaaagaccuuuuuacagaucacauguuuaucaaauggaagguugaauauauaaaaaccgaagccauaguauguguugagcucaccagccaagaaagacagugcagucugauugaggcagguacuagauucaacuuggguccugugacuaucacccugucugagccaagaaacauucagcagaagcuucccccugagaucauuacgcugcauccuaaaauugaagaaggcuucuuugacuugaugcaugugcaaaaaguguuaucugcaaguacaguguguaaacugcagaguugcacacaugguauaccaggagaucuacaaauuuaccacauuggcaaccuguugaaaggggauagauuaaacgggcaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaagaaaguugagauaucaggcuugaaauuugcaagucuggcuugcacggguugcuauucuuguagcucuggcaucuccuguaaagucagaauucauguagaugaaccggaugagcucacagugcauguaaagagcagugauccagaugugguugcagcuagcacaagccuuauggcaaggaagcuugaauuugggacagauagcacauucaaggcauuuucagcuaugcccaaaaccucuuuauguuuuuacauuguggagagggaauacugcaagagcugcagugaagaugauacaaaaaaauguguugacacaaaacuugagcagccacagagcauacuaauugagcacaaagggacgauaauuggaaagcaaaaugacacuugcacagccaaggcaaguuguuggcuagagucagucaagaguuuuuuuuauggauugaagaauaugcuuggcaguguuuuugguaauuuuuucguaggcauuuuguuauuccuugcccccuuugucuuguuggugcuuuucuuuauguuuggauggaaaaucuuguuuugcuuuaaguguugcaggaggaccagaggcuuguuuaaguauagacaccucaaagaugaugaggaaacaggcuacagaaagauuauugaaagacugaacagcaaaaaaggaaaaaacagacugcuugauggugagagguuggcugauaggaaaauugcugagcuguucucuacaaaaacacacauuggc

SEQ ID NO: 3779 - RNA, 3495 nt, Artificial Sequence
  derived and/or modified CDS sequence (wt) from CCHVF(CCHVF K229_243)__KX013466.1__Gn-NSm-Gc
uccgaagagccaggugaugacugcauaucaagaacucagcuauugaggacagaaacagcagagauccaugaugacaacuauggugguccaggugauaaaauaacuaucugcaacgguucaaccauuguagaucagagacugggcagugaacuaggguguuauaccaucaacagggugaagucauucaagcuaugcgaaaacagcgccacagggaaaaccugugagauagacagcacuccgguuaagugcaggcaagguuuuuguuuaaaaaucacccaagagggaaggggccacguaaaauuaucuagaggcucagagguugucuuggaugccugcgacucaagcugcgaaguaaugauaccuaaaggcacuggagauauccugguggacuguucagguggacagcaacauuucuuaaaagacaacuuaauugaccuagggugcccccauaucccgcuauuggguaaaauggccauuuacaucugcagaaugucaaaucauccuagaacaacuauggcuuuucucuucugguucagcuuuggcuaugugaucaccuguauauuuuguaaggcucuuuuuuauucauugauaauuauugggacacuagggaaaaagaucaagcaauauagggaauugaaaccucaaacuuguaccauaugugagacagcuccugucaaugcaauagaugcugaaaugcaugaccuuaacugcaguuacaauauaugcccuuauugugcaucaagauugaccuccgaugggcuggcuaggcaugugccacaaugccccaagcggaaggaaaaaguugaggagacugagcuguacuugaaccuggaaagaaucccuuggauugucagaaagcuauugcaagugucagaguccacugguguggcauugaaacgaagcagcuggcugauuguacugcuuguguuacucacaguuucauugucaccgguucaaucagcaccuguuggucaugguaaaacaaucgaaacauaucagaccagagaaggauucacaaguaucugucucuuuauguuaggaagcauccuguuuuuagucucuugcuuggugaaggggcugguugacagugucagugacagcuucuuccccggccugucugucuguaagacaugcucuauuggcaguauaaauggcuuugaaauugaaucgcauaaaugcuacuguagccuauuuugcugccccuacuguaggcacugcucugcugacagagaaauucaccaguuacacuugaguaucugcaaaaaaagaaaaacggguagcaaugucaugcuggcugucugcaaacgcaugugcuuuagggcaaccauagaagcaagcagaagagcccugcucauccgaagcauuaucaauaccacuuuuguaauaugcauuuuaacauugacaaucuguguuguuagcaccucugcaguagagauggaaaaccuuccagcaggcacuugggagagagaggaagaccugacaaauuucugucaucaggaaugccagguaaccgagacggagugccucuguccauacgaagcucuugugcucagaaaaccucuguucuuagacaguauaguuaaaggcaugaagaauuugcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguggaagaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcuggggaguaggaacuggcuguaccugcugcgggguggauguaaaagaccuuuuuacagaucacauguuugucaaauggaagguugaauauauaaaaacugaagccauaguauguguugagcucaccagccaggaaagacagugcagucugauugaggcagguacuagauucaacuugggcccugugacuaucacccugucugagccaagaaacauucagcagaagcuucccccugagauuaucacguugcaucccaaaguugaagagggcuucuuugacuugaugcaugugcaaaaaguguugucugcaaguacaguguguaaacugcagaguugcacacaugguauaccaggagaucuucaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacauugaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcauaccaagaaaguugagauaucaggcuugaaauuugcaagucuggcuugcacggguugcuaugcuuguagcucuggcaucuccuguaaagucaggauucauguagaugagccagaugagcucacaguacauguaaagagcagugauccagaugugguugcagcuagcacaagucucauggcgaggaagcuugaauuugggacagacaguacauucaaggccuuuucagcuaugcccaaaaccucuuuauguuuuuacauuguggagaaagaauacugcaagagcugcagugaagaggacacacaaaaauguguugacacaaaacuugagcagccacagagcauacuaauugagcacaaaggaacgauaauuggaaagcagaaugauacuugcacagccaaagcaagcuguuggcuagagucagucaagaguuuuuuuuauggauugaagaauaugcuugguagugucuuugguaacuuuuucauaggcauuuuguuauuccuuaccccuuuuguccuguuggugcuuuucuuuauguuuggauggaaaaucuuguuuugcuucaaauguugcaggaggaccagaggcuuacuuaaguauagacaccucaaagacgaugaggaaacaggcuacagaaggauuauugaaagacugaacaacaaaaaagggaaaaacagacugcuugauggugaaagguuggcugauaggaaaauugcugagcuguucuccacaaaaacacacauuggu

SEQ ID NO: 3780 - RNA, 3495 nt, Artificial Sequence
  derived and/or modified CDS sequence (wt) from CCHVF(CCHVF K315_14)__KX013469.1__Gn-NSm-Gc
uccgaagagccaggugacgacugcauaucaagaacucagcuauugaagacagaaacagcagaaauccaugacgacaacuauggugguccaggugacaaaauaacuaucugcaaugguucaaccguuguggaucagagacugggcagugaacuaggguguuauaccaucaacagggugaagucauucaagcuaugcaaaaacagugccacagggaaaaccugugagauagacagcacuccggucaagugcaggcaagguuuuuguuugaaaaucacccaagagggaaggggccacguaaaauuauccaggggcucagagguuguuuuggauguuugcgacucgagcugugaaauaaugauaccuaaaggcacuggagauauccuaguagacuguucagguggacagcaacauuucuuaaaagacaacuugauugaccuagggugcccucauaucccgcuauuggguaaaauggccauuuacauuugcagaaugucaaaucaucccaggacaaccauggcuuuccucuucugguucaguuuuggcuauguaaucaccuguauauuuugcaaggcucuuuuuuauucauugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaagggcuagcuaggcaugugacacaaugcccuaagcgaaaggagaaaguugaggagacugaacuguauuugaaccuggaaagaauuccuuggauagucagaaagcuauugcaagugucagaguccacugguguggcauugaaacgaagcaguuggcugauugugcugcuuguguuacucacagucucauugucaccgguccaaucagcaccuguuggucaugguaagacaaucgaaacauaucagaccagagaaggauucacaaguaucugucucuuuauguuaggaagcauccuauucauaguuucuugccugguaaaggggcugguuuacagugucagugacagcuucuuccccggccugucugucuguaagacaugcucuauuggcaguauaaauggcuuugaaauugaaucgcauaaaugcuacuguaguuuauuuugcugccccuacuguaggcacugcucugcugacagagaaauucaccaguugcacuugaguaucugcaaaaaaagaaaaacagggagcaaugucaugcuggcugucugcaagcgcaugugcuuuaaggcaaccauagaagcaagcagaagagcccugcucauccgaagcauuaucaauaccacuuuuguaauaugcauucuaacauuagcaaucuguguuguuagcaccucugcaguagagauggaagaccuuccagcaggcacuugggagagagaggaagaccuaacaaauuucugccaucaggaaugccaggugaccgagacggaaugccucuguccauacgaagcucuugugcucaggaaaccucuuuucuuagacaguauaguuaaagguaugaaaaaauugcuaaacucaacaagcuuagaaacaagcuuaucaauugaggcaccauggggagcaauaaauguccagucaaccuuuaaaccaacaguaucuacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggacuugucacaaauguauuccccuguuuuugaguacuuaucaggagauagacagguugaagaauggcccaaggcaaccugcacaggugauugcccagaaagguguggcugcacaucaucaaccugcuugcauaaagaauggccucauucaagaaacuggagauguaaucccacuuggugcuggggaguaggaaccggcugcacaugcugcggaguggauguaaaagaccuuuuuacagaccacauguuuaucaaauggaagguugaauauauaaaaaccgaagccauaguauguguugagcucaccagccaagaaagacagugcagucugauugaggcagguacuagauucaacuuggguccugugacuaucacccugucugagccaagaaacauucagcagaagcuucccccugagaucauuacgcugcaucccaaaauugaagaaggcuucuuugacuugaugcaugugcaaaaaguguuaucugcaaguacaguguguaaacugcagaguugcacacaugguauaccaggagaucuacaaauuuaccacaucgguaacuuguugaaaggggauagaguaaacgggcaucugauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaagaaaguugagauaucaggcuugaaauuugcaagucugacuuguacggguugcuaugccuguagcucuggcaucuccuguaaagucagaauucauguagaugaaccagaugagcucacagugcauguaaagagcagugauccagaugugguugcagcuagcacaagccuuauggcaaggaagcuugaauuugggacagauagcacauucaaggcauuuucagccaugcccaaaaccucuuuaugcuuuuacauuguagagagggaauacugcaagagcugcagugaagaugauacaaaaaaauguguugacacaaaacuugagcagccacagagcauacuaauugagcacaaggggacaauaauuggaaagcagaaugauacuugcacagccaaggcaaguuguuggcuagagucagucaagaguuuuuuuuauggacugaagaauaugcuuggcaguguuuuugguaguuuuuucguaggcauuuuguuauuccuugccccuuuugucuuguuggugcuuuucuuuauguuuggauggaaaaucuuguuuugcuuuaaguguugcaggaggaccagaggcuuguuuaaguauagacaccucaaagaugacgaggaaacaggcuacagaaggauuauugaaagacugaacagcaaaaaagggaaaaacagacugcuugauggugagagguuggcugauaggaaaauugcugagcuguucucuacaaaaacacacauuggc

SEQ ID NO: 3781 - RNA, 3495 nt, Artificial Sequence
  derived and/or modified CDS sequence (wt) from CCHVF(CCHVF K323_27)__KX013472.1__Gn-NSm-Gc
uccgaagagccaggugacgacugcauaucaagaacucagcuauugaagacagaaacagcagagauccaugacgacaacuauggugguccaggugacaaaauaacuaucugcaaugguucaaccauuguagaucagagacugggcagugaacuaggguguuauaccaucaacagggugaagucauucaagcuaugcgaaaacagugccacagggaaaaccugugagauagacagcacuccggucaagugcaggcaagguuuuuguuugaaaaucacccaagagggaaggggccacguaaaauuauccaggggcucagagguuguuuuggaugcuugcgacucgagcugugaaauaaugauaccuaaaggcacuggagauauccuaguagacuguucagguggacagcaacauuucuuaaaagacaacuugauugaccuagggugcccucauaucccgcuauuggguaaaauggccauuuacauuugcagaaugucaaaucaucccaggacaaccauggcuuuccucuucugguucaguuuuggcuauguaaucaccuguauauuuugcaaagcucuuuuuuauuuauugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuagcuaggcaugugacacaaugcccuaagcgaaaggagaaaguugaggagacugaacuguauuugaaccuggaaagaauuccuuggauagucagaaagcuauugcaagugucagaguccacugguguggcauugaaacgaagcaguuggcugacugugcugcuuguguuacucacagucucauugucaccgguccaaucagcaccuguuggccaugguaauacaaucgaaacauaucagaccagagagggauucacaaguaucugucucuuuauguuaggaagcauccuauucauaguuucuugccugguaaaggggcugguugacagugucagugacagcuucuuccccggccugucugucuguaagacaugcucuauuggcaguauaaauggcuuugaaauugaaucgcauaaaugcuacuguaguuuauuuugcugcccccacuguaggcaccgcucugcugacagagaaauucaccaguugcacuugaguaucugcaaaaaaagaaaaacggggagcaaugucaugcuggcugucugcaagcgcaugugccccaaggcaaccauagaagcaagcagaagagcccugcccauccgaagcaucaucaacaccacucuuguaaugugcauucuaacauuagcaaucuguguuguuagcaccucugcaguagagauggaagaccuuccagcaggcaccugggagagagaggaagaccuaacaaauuucugccaucaggaaugccaggugaccgagacggaaugccucuguccauacgaagcucuugugcucaggaaaccucuuuucuuagacaguauagccaaagguaugaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggauuugucacaaauguauuccccuguuuuugaguacuuaucaggagauagacagguugaagaauggcccaaggcaaccugcacaggugauugcccagaaagguguggcugcacaucaucaaccugcuugcauaaagaauggccucauucaagaaacuggagauguaaucccacuuggugcuggggaguaggaaccggcugcacaugcugcggaguggauguaaaagaccuuuuuacagaccacauguuuaucaaauggaagguugaauacauaaaaaccgaagccauaguauguguugagcucaccggccaagaaagacagugcagucugauugaggcagguacuagauucaacuuggguccugugacuaucacccugucugagccaagaaacauucagcagaagcuucccccugagaucauuacgcugcaucccaaaauugaagaaggcuucuuugacuugaugcaugugcaaaaaguguuaucugcaaguacaguguguaaacugcagaguugcacacaugguauaccaggagaucuacaaauuuaccacauuggcaacuuguugaaaggggauagaguaaacgggcaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaagaaaguugagauaucaggcuugaaauuugcaagucugacuuguacggguugcuaugcuuguagcucuggcaucuccuguaaagucagaauucauguagaugaaccagaugagcucacagugcauguaaagagcagugauccagauguuguugcagcuagcacaagccuuauggcaaggaagcuugaauuugggacagauagcacauucaaggcauuuucagcuaugcccaaaaccucuuuaugcuuuuacauuguggagagggaauacugcaagagcugcagugaagaugauacaaaaaaauguguugacacaaaacuugagcagccacagagcauacuaauugagcacaaagggacgauaauuggaaagcagaaugauacuugcacagccaaggcaaguuguuggcuggagucagucaagaguuuuuuuuauggauugaagaauaugcuuggcaguguuuuugguaguuuuuucguaggcauuuuguuauuccuugccccuuuugucuuguuggugcuuuucuuuauguuuggauggaaaaucuuguuuugcuuuaaguguugcaggaggaccagaggcuuguuuaaguauagacaccucaaugaugacgaggaaacaggcuacagaaggaucauugaaagacugaacagcaaaaaaggaaaaaacagacugcuugauggugagagguuggcugauaggaaaauugcugagcuguucucuacaaaaacacacauuggc

SEQ ID NO: 3782 - RNA, 3495 nt, Artificial Sequence
  derived and/or modified CDS sequence (wt) from CCHVF(CCHVF K340_6)__KX013475.1__Gn-NSm-Gc
uccgaagagccaggugacgacugcauaucaagaacucagcuauugaagacagaaacagcagagauccaugacgacaacuauggugguccaggugacaaaauaacuaucugcaaugguucaaccauuguagaucagagacugggcagugaacuaggguguuauaccaucaacagggugaagucuuucaagcuaugcgaaaacaguaccacagggaaaaccugugagauagacagcacuccggucaagugcaggcaaggcuuuuguuugaaaaucacccaagagggaaggggccacguaaaauuauccaggggcucagagguuguuuuggaugcuugcgacucgagcugugaaauaaugauaccuaaaggcacuggagauauccuaguagacuguucagguggacagcaacauuucuuaaaagacaacuugauugaccuagggugcccucauaucccgccauuggguaaaauggccauuuacauuugcagaaugucaaaucaucccaggacaaccauggcuuuccucuucugguucaguuuuggcuauguaaucaccuguauauuuugcaaggcucuuuuuuauucauugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuggcuaggcaugugacacaaugcccuaagcgaaaggagaaaguugaggagacugaacuguauuugaaccuggaaagaauuccuuggauagucagaaagcuauugcaagugucagaguccacugguguggcauugaaacgaagcaguuggcugauugugcugcuuguguuacucacagucucauugucaccgguccaaucagcaccuguuggucaugguaagacaaucgaaacauaucagaccagagagggauucacaaguaucugucucuuuauguuaggaagcauccuauucauaguuucuugccugguaaaggggcugguugacagugucagugacagcuucuuccccggccugucugucuguaagacaugcucuauuggcaguauaaauggcuuugaaauugaaucgcauaaaugcuacuguaguuuauuuuguugccccuacuguaggcacugcucugcugacagagaaauucaccaguugcacuugaguaucugcaaaaaaagaaaaacggggagcaaugucaugcuggcugucugcaagcgcaugugcuuuaaggcaaccauagaagcaagcagaagagcccugcucauccgaagcauuaucaauaccacuuuuguaaugugcauucuaacauuagcaaucuguguuguuagcaccucugcaguagagauggaagaccuuccagcaggcacuugggagagagaggaagaccuaacaaauuucugccaucaggaaugccaggugaccgagacggaaugccucuguccauacgaagcucuugugcucaggaaaccccuuuccuuagacaguauaguuaaagguaugaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggauuugucacaaauguauuccccuguuuuugaguacuuaucaggagauagacagguugaagaauggcccaaggcaaccugcacaggugauugcccagaaagguguggcugcacaucaucaaccugcuugcauaaagaauggccucauucaagaaacuggagauguaaucccacuuggugcuggggaguaggaaccggcugcacaugcugcggaguggauguaaaagaccuuuuuacagaccacauguuuaucaaauggaagguugaauauauaaaaaccgaagccauaguauguguugagcucaccagccaagaaagacagugcagucugauugaggcagguacuagauucaacuuggguccugugacuaucacccugucugagccaagaaacauucagcagaagcuucccccugagaucauuacgcugcaucccaaaauugaagaaggcuucuuugacuugaugcaugugcaaaaaguguuaucugcaaguacaguguguaaacugcagaguugcacacaugguauaccaggagaucuacaaauuuaccacauuggcaacuuguugaaaggggauagaguaaacggccaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccacucuaaaagagucacagcacauggagacacaccacaauuagacuuaaaagcaaggccgaccuacggugcaggugagaucacugugcugguugagguuacugacauggaguugcauaccaaaaaaguugagauaucaggcuugaaauuugcaagucugacuuguacggguugcuaugcuuguagcucuggcaucuccuguaaagucagaauucauguagaugaaccagaugagcucacagugcauguaaagagcagugauccagaugugguugcagcuagcacaagccuuauggcaaggaagcuugaauuugggacagauagcacauucaaggcauuuucagcuaugcccaaaaccucuuuaugcuuuuacauuguggagagggaauacugcaagagcugcagugaagaugauacaaaaaaauguguugacacaaaacuugagcagccacagagcauacuaauugagcacaaagggacgauaauuggaaagcagaaugauacuugcacagccaaggcaaguuguuggcuagagucagucaagaguuuuuuuuauggauugaagaauaugcuuggcaguguuuuugguaguuuuuucguaggcauuuuguuauuccuugccccuuucgucuuguuggugcuuuucuuuauguuuggauggaaaaucuuguuuugcuuuaaguguugcaggaggaccagaggcuuguuuaaguauagacacuucaaagaugacgaggaaacaggcuacagaaggauuauugaaagacugaacagcaaaaaaggaaaaaacagacugcuugauggugagagguuggcugauaggaaaauugcugagcuguucucuacaaaaacacacauuggc

SEQ ID NO: 3783 - RNA, 3495 nt, Artificial Sequence
  derived and/or modified CDS sequence (wt) from CCHVF(CCHVF Mamon)__KX013478.1__Gn-NSm-Gc
uccgaggagccaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauaccaucaacagggugaagucauucaagcuaugcgaaaacagcgccacagggaaaaccugugagauagacagcacuccgguuaagugcaggcaagguuuuuguuuaaaaaucacccaagagggaaggggccacguaaaauuaucuagaggcucagagguuguuucggaugcuugcgacucaagcugcgaaguaaugauaccuaaaggcacuggagauauccugguggacuguucagguggacagcaacauuucuuaaaagacaacuuaauugaccuagggugcccccauaucccgcuauuggguaaaauggccauuuacaucugcagaaugucaaaucauccuagaacaacuguggcuuuucucuucugguucagcuuuggcuaugugaucaccuguauauuuugcaaggcucuuuuuuauucauugauaauuauugggacacuagggaaaaagaucaagcaauauagggaauugaaaccucaaacuuguaccauaugugagacagcuccugucaaugcaauagacgcugaaaugcaugaccuuaacugcaguuacaauauaugcccuuauugugcaucaagauugaccuccgaugggcuagcuaggcaugugccacaaugccccaagcggaaggaaaaaguugaggagacugagcuguacuugaaccuggaaagaauuccuuggauugucagaaagcuauugcaagugucagaguccacugguguggcauuaaaacgaagcagcuggcugauuguacugcuuguguuacucacaguuucauugucaccgguucaaucagcaccuguuggucacgguaagacaaucgaaacauaucagaccagagaaggauucacaaguaucugucucuuuauguuaggaagcauccuguuuuuagucucuugcuuggugaaggggcugguugacagugucagugacagcuucuuccccggccugucugucuguaagacaugcucuauuggcaguauaaauggcuuugaaauugaaucgcauaaaugcuacuguagccuauuuugcugccccuacuguaggcacugcucugcugacagagaaauucaccaguuacacuugaguaucugcaaaaaaagaaaaacggguagcaaugucaugcuggcugucugcaaacgcaugugcuuuagggcaaccauagaagcaagcagaagagcccugcucauccgaagcauuauaaauaccacuuuuguaauaugcauuuuaacauugacaaucuguguuguuagcaccucugcaguagagauggaaaaccuuccaucaggcacuugggagagagaggaagaccugacaaauuucugucaucaggaaugccagguaaccgagacggagugccucuguccauacgaagcucuugugcucagaaaaccucuguucuuagacaguauaguuaaaggcaugaagaauuugcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguagaagaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcuggggaguaggaacuggcugcaccugcugcgggguggauguaaaagaccuuuuuacagaucacauguuugucaaauggaagguugaauauauaaaaacugaagccauaguguguguugagcucaccagccaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcaugugcaaaaaguguugucugcaaguacaguguguaaacugcagaguugcacacaugguauaccaggagaucuacaaguuuaccacauuggcaacuugcugaaaggugauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacauugaaacugauuacacgaaaaccuuccacuuccacucuaaaagaguuacagcacauggugacacaccacaauuagacuuaaaagcaaggccgaccuacggugcaggugagaucacugugcucguugagguugcugacauggaguugcauaccaagaaaguugagauaucaggcuuaaaauuugcaagucuggcuugcacggguugcuaugcuuguagcucuggcaucuccuguaaagucaggauucauguagaugagccagaugagcucacaguacauguaaagagcagugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaaugauacuugcacagccaagacaagcuguuggcuagagucagucaagaguuuuuuuuauggauugaaaaauaugcuugguaguguauuugguaacuuuuucauaggcauuuuguuauuccuugccccuuuuguccuguuggugcuuuucuuuauguuuggauggaaaaucuuguuuugcuucaaauguugcaggaggaccagaggcuuacuuaaguauagacaccucaaagacgaugaggaaacaggcuacagaaggauuauugaaagacugaacaacaaaaaaggaaaaaacagacugcuugauggugaaagguuggcugauaggaaaauugcugagcuguucuccacaaaaacacacauuggu

SEQ ID NO: 3784 - RNA, 3495 nt, Artificial Sequence
  derived and/or modified CDS sequence (wt) from CCHVF(CCHVF Min)__KX013481.1__Gn-NSm-Gc
uccgaggagccaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauaccaucaacagggugaagucguucaagcuaugcgaaaacagcgccacagggaaaaccugugagauagacagcacuccgguuaagugcaggcaagguuuuuguuuaaaaaucacccaagagggaaggggccacguaaaauuaucuagaggcucagagguuguuuuggaugcuugcgacucaagcugcgaaguaaugauaccuaaaggcacuggagauauccugguggacuguucagguggacagcaacauuucuuaaaagacaacuuaauugaccuagggugcccccauaucccgcuauuggguaaaauggccauuuacaucugcagaaugucaaaucauccuagaacaacuauggcuuuucucuucugguucagcuuuggcuaugugaucaccuguauauuuugcaaggcucuuuuuuauucauugauaauuauugggacacuagggaaaaagaucaagcaauauagggaauugaaaccucaaacuuguacuauaugugagacagcuccugucaaugcaauagacgcugaaaugcaugaccuuaacugcaguuacaauauaugcccuuauugugcaucaagauugaccuccgaugggcuagcuaggcaugugccacaaugccccaagcggaaggaaaaaguugaggagacugagcuguacuugaaccuggaaagaauuccuuggauugucagaaagcuauugcaagugucagaguccacugguguggcauugaaacgaagcagcuggcugauuguacugcuuguguuacucacaguuucauugucaccgguucaaucagcaccuguuggucaugguaagacaaucgaaacauaucagaccagagaaggauucacaaguaucugucucuuuauguuaggaagcauccuguuuuuagucucuugcuuggugaaggggcugguugacagugucagugacagcuucuuccccggccugucugucuguaagacaugcacuauuggcaguauaaauggcuuugaaauugaaucgcauaaaugcuacuguagccuauuuugcugccccuacuguaggcacugcucugcugacagagaaauucaccaguuacacuugaguaucugcaaaaaaagaaaaacggguagcaaugucaugcuggcugucugcaaacgcaugugcuuuagggcaaccauagaagcaagcagaagagcccugcucauccgaagcauuauaaauaccacuuuuguaauaugcauuuuaacauugacaaucuguguuguuagcaccucugcaguagagauggaaaaccuuccaucaggcacuugggagagagaggaagaccugacaaauuucugucaucaggaaugccagguaaccgagacggagugccucuguccauacgaagcucuugugcucagaaaaccucuguucuuagacaguauaguuaaaggcacgaagaauuugcuaaacucaacaagcuuagaaacaagcuuaucaauugaggcaccauggggagcaauaaauguccagucaaccuuuaaaccaacagugucgacugcaaacauagcacucaguuggagcucaguggagcacaggggcaacaagaucuuagucacaggcaggucugaaucaauuaugaaacuggaggaaaggacaggagucagcugggaucuaggcguagaagaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaauccuacuuggugcuggggaguaggaacuggcugcaccugcugcgggguggauguaaaagaccuuuuuacagaucacauguuugucaaauggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcaugugcaaaaaguguugucugcaaguacaguguguaaacugcagaguugcacacaugguauaccaggagaucuacaaguuuaccacauuggcaacuugcugaaaggggauaggauaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacauugaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcauaccaagaaaguugagauaucaggcuugaaauuugcaagucuggcuugcacggguugcuaugcuuguagcucuggcaucuccuguaaagucaggauucauguagaugagccagaugagcucacaguacauguaaagagcagugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaaugauacuugcacagccaaggcaagcuguuggcuagagucagucaagaguuuuuuuuauggauugaaaaauaugcuugguaguguauuugguaacuuuuucauaggcauuuuguuauuccuugccccuuuuguccuguuggugcuuuucuuuauguuuggauggaaaaucuuguuuugcuucaaauguugcaggaggaccagaggcuuacuuaaguauagacaccucaaagacgaugaggaaacaggcuacagaaggauuauugaaagacugaacaacaaaaaaggaaaaaacagacugcuugauggugaaagguuggcugauaggaaaauugcugagcuguucuccacaaaaacacacauuggu

SEQ ID NO: 3785 - RNA, 3495 nt, Artificial Sequence
  derived and/or modified CDS sequence (wt) from CCHVF(CCHVF Nakiwogo)__KX013484.1__Gn-NSm-Gc
gcagaaggagugagcaaugacugcguuucaaggacccagcuaaucaaaacagaaguugcagagauucacgaagauagcuacggugggccuggagaaaaaauaacaaucugcaacggcuccacaaucguggaccaaaggcuugguagcgaacuagguugcuacacaauuaaccgcgugaagacuuauaagcuuugugagaacagugccacagaaaaggguugugagaucgauaguguuccagucaaaugcaaacaaggguucugccucaaaguaacccaagagggcaggggccaugugaaacuaucuagaggaacggaaauuguccuggaugugugugacaccaguugugaguugaugauaccuaaaggcacuggagacauauugguggauugcucaggaggacagcagcacuucuugcaggacaacuugauugacuuagguugcccaaauguaccauuacuaggcaagauggcaauauauaucugcaggaugucgaaccauccuaagaccaccauggcuuuuuuguucugguucaguuuuggcuaugucaucacaugcguaguaugcaaagugcucuucuaucugcuaauugucauugggacacuaggaaagaaacuuaaacaguauagggaacuaaaaccucagacaugcauugucugugaaucaaucccugucaauguaauagaugcugaaaugcacgagcucaauugcaauuacaauauaugcccauacugugcguccagacugacuucagauggacuaguuagacaugugacucaaugucccaaaaggaaggaaaaggucgaggagacugagcuguacuugaaccuggagaggauaccuugguugguaagaagacuacugcaagugucagagucaacagggauggcucuaaagagaaguugcuggaugaccacacuccucauucugcuaguaguuucauugucuccaguucaaucugcuccaguuggucaggagaaagcaaucgaagucuaccaggugagagaaaguuacacaagcaugugccucuuuguauuaggaaguguucucuuugcagucuccuggcugguaaaggguuugauugacgguaucggcaacaguuuuuucccugggcuuucugucugcaaaacaugcucuauuggcagcauaaauggauuugaaauagagucccacaaaugcuauuguagucuguucuguuguccuuacugcagagcuugcucaucugauaaaaucacucaccgaaugcauuugaauaucugcaagaggaggaaaguggguagcaauguuaugcuggcugucuguaagcguaugugcuuuaaggcgacuguugaagcaagcaacucagcccugcucaucagaagcaucauaaacuccaccuuugugauaugcgugcugauucuaguuaucugugugguaagcacaucugcugucgacauggagaaucuaccagcaggcaucugggagagagaagaagaccuuacaaacuucugccaucaagaaugccaagugacagagacugagugucuuugcccguaugaagccuuaauucucagaaagccccuuuaccuggauagcauagccaaggggaugaaaagucuguuaaauucuacgaacuuagagacaagccugucgauugaggccccauggggagcaaucaauguucagucaacuuuuaaaccaacaguuucagcugccaacauagcacuuagcuggaguucaguugaacacaggggcaacaaaauccuaguuucgggcaggucagagucaauuaugaaacuggaagaacggaccggcaucagcuggagccuagguguagaggaugcuucugagucaaagacgcuuacuguuucugucauggaucugucucaaauguauucuccugucuuugaguaucugucaggugauagacaaguagaagaguggccaaaggccacuugcacaggcgacugcccagagagauguggcugcaccuccucaaccugcuugcauaaagaauggccgcacucgagaaacuggcgaugcaaccccacuugguguuggggaguagggacuggcugcaccugcugcggacuggauguuagagaccuuuucacggacuacaugauggucaaguggaaaguggaauauguaaaaacagaagcuauaauguguguugagcuaacuagucaggaaaggcaguguaguuuaauugaggcagguacaagguuuaaccugggcccugugacaauaacccugucagagccaagaaauguccagcaaaggcucccuuccgaaaucguuacacugcacccuaagauagaggaaggauucuuugauuugaugcaugugcaaaaaguacuauucugcaagcacaguuugcaagcuacaagcugcacacacggugucccaggcgauuugcaggucuaccauguuggcaaccuacugaaaggagacaagguuaaugggcacucaauucacaagauagagucucauuucaacacuucauggaugucaugggauggaugugaccuagacuacuuuugcaacaugggugacuggccuucauguacauauacuggagugacacagcacaaccgugcggcauucgucaacaugcucaauauugagacugauuacacaaagacuuuucacuuccauuccaagaggguuacggcacacggugacaccccucaacuggaucugaaggcaagaccaacauauggugcaggcgaggucacuguucuaguggagguugcagaucuggagcuacacacuaagaaaauagaagugucaggguugaaguuugcaagucugaccugcucugguuguuaugccugcaguuccggcaucuccugcaaaguuagaauucaugugaaugaaccagaugaguucacaguacacgugaaaagcaaugauccagacguuguggcagcaggaucaagucugauggcaaggaaaauagaguuaggggcugacagcaccuuuaaagccuuuucaucaaugccuaaaaacucuuugugcuuuuauauaguggaaagagacuacugcagcagcugcaccgaugaugacacucagaaguguguuaacacaaagcucgaacauccacaaagcauauuaauugagcauaagggaacaauaauugguaagcaaaaugacaccuguccgaccaaaacaagcugcuggcuagaaucagucaagaguuuuuuuuauggacugaaaaacaugcuggguggcaucuucgguaaugucuucuuaggcaucuuccuauuccuugcuccuuuugcacugcugauacucuucuucuucuucggguggaggcuucuguucugucugaaguguugcagaaggaccaggggucugcuaaaguauaaacaacuuaaggaugaagaagaagccggguacaagaaaaucaucgagaggcugaaugacaaaaagggcaaaagucgacuuuuugacggagagaggcucgcugacaggaagauugcugaacucuuuucaaccaaaacucauauaggg

SEQ ID NO: 3786 - RNA, 3495 nt, Artificial Sequence
  derived and/or modified CDS sequence (wt) from CCHVF(CCHVF Saf)__KX013487.1__Gn-NSm-Gc
uccgaggagccaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauaccaucaacagggugaagucauucaagcuaugcgaaaacagcgccacagggaaaaccugugagauagacagcacuccgguuaagugcaggcaagguuuuuguuuaaaaaucacccaagagggaaggggccacguaaaauuaucuagaggcucagagguuguuuuggaugcuugcgacucaagcugcgaaguaaugauaccuaaaggcacuggagauauccugguggacuguucagguggacagcaacauuacuuaaaagacaacuuaauugaccuagggugcccccauaucccgcuauuggguaaaauggccauuuacaucugcagaaugucaaaucauccuagaacaacuauggcuuuucucuucugguucagcuuuggcuaugugaucaccuguauauuuugcaaggcucuuuuuuauucauugauaauuauugggacacuagggaaaaagaucaagcaauauagggaauugaaaccucaaacuuguaccauaugugagacggcuccugucaaugcaauagacgcugaaaugcaugaccuuaacugcaguuacaauauaugcccuuauugugcaucaagauugaccuccgaugggcuagcuaggcaugugccacaaugccccaagcggaaggaaaaaguugaggagacugagcuguacuugaaccuggaaagaauuccuuggauugucagaaagcuauugcaagugucagaguccacugguguggcauugaaacgaagcagcuggcugauuguacugcuuguguuacucacaguuucauugucaccgguucaaucagcaccuguuggucaugguaagacaaucgaaacauaucagaccagagaaggauucacaaguaucugucucuuuauguuaggaagcauccuguuuuuagucucuugcuuggugaaggggcugguugacagugucagugacagcuucuuccccggccugucugucuguaagacaugcucuauuggcaguauaaauggcuuugaaauugaaucgcauaaaugcuacuguagccuauuuugcugccccuacuguaggcacugcucugcugacagagaaauucaccaguuacacuugaguaucugcaaaaaaagaaaaacggguagcaaugucaugcuggcugucugcaaacgcaugugcuuuagggcaaccauagaagcaagcagaagagcccugcucauccgaagcauuauaaauaccacuuuuguaauaugcauuuuaacauugacaaucuguguuguuagcaccucugcaguagagauggaaaaccuuccaucaggcacuugggagagagaggaagaccugacaaauuucugucaucaggaaugccagguaaccgagacggagugccucuguccauacgaagcucuugugcucagaaaaccucuguucucagacaguauaguuaaaggcaugaagaauuugcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguagaagaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcuggggaguaggaacuggcugcaccugcugcgggguggauguaaaagaccuuuuuacagaucacauguuugucaaauggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcaugugcaaaaaguguugucugcaaguacaguguguaaacugcagaguugcacacaugguauaccaggagaucuacaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacauugagacugauuacaugaaaaccuuccacuuccacucuaaaagaguuacagcacauggugacacaccacaauuagacuuaaaagcaaggccgaccuacggugcaggugagaucacugugcugguugagguugcugacauggaguugcauaccaagaaaguugagauaucaggcuugaaauuuguaagucuggcuugcacggguugcuaugcuuguagcucuggcaucuccuguaaagucaggauucauguagaugagccagaugagcucacaguacauguaaagagcagugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaaugauacuugcacagccaaggcaagcuguuggcuagagucagucaagaguuuuuuuuauggauugaaaaauaugcuugguaguguauuugguaacuuuuucauaggcauuuuguuauuccuugccccuuuuguccuguuggugcuuuucuuuauguuuggauggaaaaucuuguuuugcuucaaauguugcaggaggaccagaggcuuacuuaaguauagacaccucaaagacgaugaggaaacaggcuacagaaggauuauugaaagacugaacaacaaaaaaggaaaaaacagacugcuugauggugaaagguuggcugauaggaaaauugcugagcuguucuccacaaaaacacacauuggu

SEQ ID NO: 3787 - RNA, 3495 nt, Artificial Sequence
  derived and/or modified CDS sequence (wt) from CCHVF(CCHVF Ast199)__KX056051.1__Gn-NSm-Gc
uccgaagagccaggugacgacugcauaucaagaacucagcuauugaagacagaaacagcagagauccaugacgacaacuauggugguccaggugacaaaauaacuaucugcaaugguucaaccauuguagaucagagacugggcagugaacuaggguguuacaccaucaacagggugaagucauucaagcuaugcgaaaacagugccacagggaaaaccugugagauagacagcacuccggucaagugcaggcaagguuuuuguuugaaaaucacccaagagggaaggggccacguaaaauuauccaggggcucagagguuguuuuggaugcuugcgacucgagcugcgaaauaaugauaccuaaaggcacuggagauauccuaguagacuguucagguggacagcaacauuucuuaaaagacaacuugauugaccuagggugcccucauaucccgcuauuggguaagauggccauuuacauuugcagaaugucaaaucaucccaggacaaccauggcuuuccucuucugguucaguuuuggcuauguaaucaccuguauauuuugcaaggcucuuuuuuauucauugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuagcuaggcaugugacacaaugcccuaagcgaaaggagaaaguugaggagacugaacuguauuugaaccuggaaagaauuccauggauagucagaaagcuguugcaagugucagaguccacugguguggcauugaaacgaugcagcuggcugauugugcugcuuguguuacucacagucucauugucaccgguucaaucagcaccuguuggucaugguaagacaaucgaaacauaucagaccagagaaggauucacaaauaucugucucuuuauguuaggaagcauccuauucauaguuucuugccugguaaaggggcugguugacagugucagugacagcuucuuccccggccuaucugucuguaagacaugcucuauuggcaguauaaauggcuuugaaauugaaucgcacaaaugcuacuguaguuuauuuugcugccccuacuguaggcacugcucugcugacagagaaauucaccagcugcacuuggguaucugcaaaaaaagaaaaacggggagcaaugucaugcuggcugucugcaagcgcaugugcuuuaaggcaaccauagaagcaagcagaagagcccuacucauccgaagcauuaucaauaccacuuuuguaauaugcauccuaacauuagcaaucuguguuguuagcaccucugcaguagagauggaaaaucuuccagcaggcacuugggagagagaggaagaccugacaaauuucugccaucaggaaugccagguaaccgagacggaaugccucuguccauacgaagcucuugugcucaggaaaccucuuuucuuagacaguauaguuaaagguaugaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggauuugucacaaauguauuccccuguuuuugaguacuuaucaggagauagacagguugaagaauggcccaaggcaaccugcacaggugauugcccagaaagguguggcugcacaucaucaaccugcuugcauaaagaauggccucacucaagaaacuggagauguaaucccacuuggugcuggggaguaggaaccggcugcacaugcugcggaguggauguaaaagaccuuuuuacagaucacauguuuaucaaauggaagguugaauauauaaaaaccgaagccauaguauguguugagcucaccagccaagaaagacagugcagucugauugaggcagguacuagauucaacuuggguccugugacuaucacccugucugagccaaggaacauucagcagaagcuucccccugagaucauuacgcugcauccuaaaauugaagaaggcuucuuugacuugaugcaugugcaaaaaguguuaucugcaaguacaguguguaaacugcagaguugcacacaugguauaccaggagaucuacaaauuuaccacauuggcaacuuguugaaaggggauagauuaaacgggcaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaagaaaguugagguaucaggcuugaaauuugcaagucuggcuugcacggguugcuaugcuuguagcucuggcaucuccuguaaagucagaauucauguagaugaaccggaugagcucacagugcauguaaagagcagugauccagaugugguugcagcuagcacaagccuuauggcaaggaagcuugaauuugggacagauagcacauucaaggcauuuucagcuaugcccaaaaccucuuugugcuuuuacauuguggagagggaauacugcaagagcugcagugaagaugauacaaaaaaauguguugacacaaaacuugagcagccacagagcauacuaauugagcacaaagggacgauaauuggaaagcagaaugauacuugcacagccaaggcaaguuguuggcuagagucagucaagaguuuuuuuuauggauugaagaauaugcuuggcaguguuuuugguaauuuuuucguaggcauuuuguuauuccuugccccuuuugucuuguuggugcuuuucuuuauauuuggauggaaaaucuuguuuugcuuuaaguguugcaggaggaccagaggcuuguuuaaguauagacaccucaaagaugaugaggaaacaggcuacagaaagauuauugaaagacugaacagcaaaaaaggaaaaaacagacugcuugauggugagagguuggcugauaggaaaauugcugagcuguucucuacaaaaacacacauuggc

SEQ ID NO: 3788 - RNA, 3495 nt, Artificial Sequence
  derived and/or modified CDS sequence (wt) from CCHVF(CCHVF Ast149)__KX056054.1__Gn-NSm-Gc
uccgaagagccaggugacgacugcauaucaagaacucagcuauugaagacagaaacagcagagauccaugacgacaacuauggugguccaggugacaaaauaacuaucugcaaugguucaaccauuguagaucagagacugggcagugaacuaggguguuauaccaucaacagggugaagucauucaagcuaugcgaaaacagugccacagggaaaaccugugagauagacagcacuccggucaagugcaggcaagguuuuuguuugaaaaucacccaagagggaaggggccacguaaaauuauccaggggcucagagguuguuuuggaugcuugcgacucgagcugugaaauaaugauaccuaaaggcacuggagauauccuaguagacuguucagguggacagcaacauuucuuaaaagacaacuugauugaccuagggugcccucauaucccgcuauuggguaagauggccauuuacauuugcagaaugucaaaucaucccaggacaaccauggcuuuccucuucugguucaguuuuggcuauguaaucaccuguauauuuugcaaggcucuuuuuuauucguugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuagcuaggcaugugacacaaugcccuaagcgaaaggagaaaguugaggagacugaacuguauuugaaccuggaaagaauuccauggauagucagaaagcuguugcaagugucagaguccacugguguggcauugaaacgaagcagcuggcugauugugcuacuuguguuacucacagucucauugucaccgguucaaucagcaccuguuggucaugguaagacaaucgaaacauaucagaccagagaaggauucacaaauaucugucucuuuauguuaggaagcauccuauucauaguuucuugccugguaaaggggcugguugacagugucagugacagcuucuuccccggccuaucugucuguaagacaugcucuauuggcaguauaaauggcuuugaaauugaaucgcacaaaugcuacuguaguuuauuuugcugccccuacuguaggcacugcucugcugacagagaaauucaccagcugcacuuggguaucugcaaaaaaagaaaaacggggagcaaugucaugcuggcugucugcaagcgcaugugcuuuaaggcaaccauagaagcaagcagaagagcccuacccauccgaagcauuaucaauaccacuuuuguaauaugcauacuaacauuagcaaucuguguuguuagcaccucugcaguagagauggaaaaucuuccagcaggcacuugggagagagaggaagaccugacaaauuucugccaucaggaaugccagguaaccgagacggaaugccucuguccauacgaagcucuugugcucaggaaaccucuuuucuuagacaguauaguuaaagguaugaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggauuugucacaaauguauuccccuguuuuugaguacuuaucaggagauagacagguugaagaauggcccaaggcaaccugcacaggugauugcccagaaagguguggcugcacaucaucaaccugcuugcauaaagaauggccucacucaagaaacuggagauguaaucccacuuggugcuggggaguaggaaccggcugcacaugcugcggaguggauguaaaagaccuuuuuacagaucacauguuuaucaaauggaagguugaauauauaaaaaccgaagccauaguauguguugagcucaccagccaagaaagacagugcagucugauugaggcagguacuagauucaacuuggguccugugacuaucacccugucugagccaaggaacauucagcagaagcuucccccugagaucauuacgcugcauccuaaaauugaagaaggcuucuuugacuugaugcaugugcaaaaaguguuaucugcaaguacaguguguaaacugcagaguugcacacaugguauaccaggagaucuacaaauuuaccacauuggcaacuuguugaaaggggauagauuaaacgggcaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaagaaaguugagguaucaggcuugaaauuugcaagucuggcuugcacggguugcuaugcuuguagcucuggcaucuccuguaaagucagaauucauguagaugaaccggaugagcucacagugcauguaaagagcagugauccagaugugguugcagcuagcacaagccuuauggcaaggaagcuugaauuugggacagauagcacauucaaggcauuuucagcuaugcccaaaaccucuuugugcuuuuacauuguggagagggaauacugcaagagcugcagugaagaugauacaaaaaaauguguugacacaaaacuugagcagccacagagcauacuaauugagcacaaagggacgauaauuggaaagcagaaugauacuugcacagccaaggcaaguuguuggcuagagucagucaagaguuuuuuuuauggauugaagaauaugcuuggcaguguuuuugguaauuuuuucguaggcauuuuguuauuccuugccccuuuugucuuguuggcgcuuuucuuuauauuuggauggaaaaucuuguuuugcuuuaaguguugcaggaggaccagaggcuuguuuaaguauagacaccucaaagaugaugaggaaacaggcuacagaaagauuauugaaagacugaacagcaaaaaaggaaaaaacagacugcuugauggugagagguuggcugauaggaaaauugcugagcuguucucuacaaaaacacacauuggc

SEQ ID NO: 3789 - RNA, 3495 nt, Artificial Sequence
  derived and/or modified CDS sequence (wt) from CCHVF(CCHVF Ast137)__KX056057.1__Gn-NSm-Gc
uccgaagagccaggugacgacugcauaucaagaacucagcuauugaagacagaaacagcagagauccaugacgacaacuauggugguccaggugacaaaauaacuaucugcaaugguucaaccauuguggaucagagacugggcagugaacuaggguguuauaccaucaacagggugaagucauucaagcuaugcgaaaacagugccacagggaaaaccugugagauagacagcacuccggucaagugcaggcaaggguuuuguuugaaaaucacccaagagggaaggggccacguaaaauuauccaggggcucagagguuguuuuggaugcuugcgacucgagcugugaaauaaugauaccuaaaggcacuggagauauccuaguagacuguucagguggacagcaacauuucuuaaaagacaacuugauugaccuagggugcccucauaucccgcuauuggguaagauggccauucacauuugcagaaugucaaaucaucccaggacaaccauggcuuuccucuucugguucaguuuuggcuauguaaucaccuguauauuuugcaaggcucuuuuuuauucauugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuagcuaggcaugugacacaaugcccuaagcgaaaggagaaaguugaggagacugaacuguauuugaaccuggaaagaauuccauggauagucagaaagcuguugcaagugucagaguccacugguguggcauugaaacgaagcagcuggcugauugugcugcuuguguuacucacagucucauugucaccgguucaaucagcaccuguuggucaugguaagacaaucgaaacauaucagaccagagaaggauucacaaauaucugucucuuuauguuaggaagcauccuauucauaguuucuuaccugguaaaggggcugguugacagugucagugacagcuucuuccccggccuaucugucuguaagacaugcucuauuggcaguauaaauggcuuugaaauugaaucgcacaaaugcuacuguaguuuauuuugcugccccuacuguaggcacugcucugcugacagagaaauucaccagcugcacuuggguaucugcaaaaaaagaaaaacggggagcaaugucaugcuggcugucugcaagcgcaugugcuuuaaggcaaccauagaagcaagcagaagagcccuacucauccgaagcauuaucaauaccacuuuuguaauaugcauccuaacauuagcaaucuguguuguuagcaccucugcaguagagauggaaaaucuuccagcaggcacuugggagagagaggaagaccugacaaauuucugccaucaggaaugccagguaaccgagacggaaugccucuguccauacgaagcucuugugcucaggaaaccucuuuucuuagacaguauaguuaaagguacgaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggauuugucacaaauguauuccccuguuuuugaguacuuaucaggagauagacagguugaagaauggcccaaggcaaccugcacaggugauugcccagaaagguguggcugcacaucaucaaccugcuugcauaaagaauggccucacucaagaaacuggagauguaaucccacuuggugcuggggaguaggaaccggcugcacaugcugcggaguggauguaaaagaccuuuuuacagaucacauguuuaucaaauggaagguugaauauauaaaaaccgaagccauaguauguguugagcucaccagccaagaaagacagugcagucugauugaggcagguacuagauucaacuuggguccugugacuaucacccugucugagccaaggaacauucagcagaagcuucccccugagaucauuacgcugcauccuaaaauugaagaaggcuucuuugacuuaaugcaugugcaaaaaguguuaucugcaaguacaguguguaaacugcagaguugcacacaugguauaccgggagaucuacaaauuuaccacauuggcaacuuguugaaaggggauagauuaaacgggcaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccacucuaaaagggucacagcacauggagacacaccacaauuagacuuaaaagcaaggccgaccuacggugcaggugagaucacugugcugguugagguugcugacauggaguugcauaccaagaaaguugagguaucaggcuugaaauuugcaagucuggcuugcacggguugcuaugcuuguagcucuggcaucuccuguaaagucagaauucauguagaugaaccggaugagcucacagugcauguaaagagcagugauccagaugugguugcagcuagcacaagccuuauggcaaggaagcuugaauuugggacagauagcacauucaaggcauuuucagcuaugcccaaaaccucuuugugcuuuuacauuguggagagggaauacugcaagagcugcagugaagaugauacaaaaaaauguguugacacaaaacuugagcagccacagagcauacuaauugagcacaaagggacgauaauuggaaagcagaaugauacuugcacagccaaggcaaguuguuggcuagagucagucaagaguuuuuuuuauggauugaagaauaugcuuggcaguguuuuugguaauuuuuucguaggcauuuuguuauuccuugccccuuuugucuuguuggugcuuuucuuuauauuuggauggaaaaucuuguuuugcuuuaaguguugcaggaggaccagaggcuuguuuaaguauagacaccucaaagaugaugaggaaacaggcuacagaaagauuauugaaagacugaacagcaaaaaaggaaaaaacagacugcuugauggugagagguuggcugauaggaaaauugcugagcuguucucuacaaaaacacacauuggc

SEQ ID NO: 3790 - RNA, 3495 nt, Artificial Sequence
  derived and/or modified CDS sequence (wt) from CCHVF(CCHVF Ast133)__KX056060.1__Gn-NSm-Gc
uccgaagagccagaugacgacugcauaucaagaacucagcuauugaagacagaaacagcagagauccaugacgacaacuauggugguccaggugacaaaauaacuaucugcaaugguucaaccauuguagaucagagacugggcagugaacuaggguguuauaccaucaacagggugaagucauucaagcuaugcgaaaacagugccacagggaaaacuugugagauagacagcacuccggucaagugcagacaagguuuuuguuugaaaaucacccaagagggaaggggccacguaaaauuauccaggggcucagagguuguuuuggaugcuugcgacucgagcugugaaauaaugauaccuaaaggcacuggagauauccuaguagacuguucagguggacagcaacauuucuuaaaagacaacuugauugaccuagggugcccucauaucccgcuauuggguaaaauggccauuuacauuugcagaaugucaaaucaucccaggacaaccauggcuuuccucuucugguucaguuuuggcuauguaaucaccuguauauuuugcaaggcucuuuuuuauuuauugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuagcuaggcaugugacacaaugcccuaagcgaaaggagaaaguugaggagacugaacuguauuugaaccuggaaagaauuccuuggauagucagaaagcuauugcaagugucagaguccacugguguggcauugaaacgaagcaguuggcugauugugcugcuuguguuacucacagucucauugucaccgguccaaucagcaccuguuggucaugguaagacaaucgaaacauaucagaccagagagggauucacaaguaucugucucuuuauguuaggaagcauccuauucauaguuucuugccugguaaaggggcugguugacagugucagugacagcuucuuccccggccugucugucuguaagacaugcucuauuggcaguauaaauggauuugaaauugaaucgcauaaaugcuacuguaguuuauuuugcugccccuacuguaggcacugcucugcugacagagaaauucaccagcugcacuugaguaucugcaaaaaaagaaaaacggggagcaaugucaugcuggcugucugcaagcgcaugugcuuuaaggcaaccauagaagcaagcagaagagcccugcucauccgaagcauuaucaauaccacuuuuguaaugugcauucuaacauuagcaaucuguguuguuagcaccucugcaguagagauggaagaccuuccagcaggcacuugggagagagaggaagaccuaacaaauuucugccaucaggaaugccaggugaccgagacggaaugccucuguccauacgaagcucuugugcucaggaaaccucuuuucucagacaguauaguuaaagguaugaaaaauuugcuaaacucaacaagcuuagaaacaagcuuaucaauugaggcaccauggggagcaauaaauguccaaucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggauuugucacaaauguauuccccuguuuuugaguacuuaucaggagauagacagguugaagaauggcccaaggcaaccugcacaggugauugcccagaaagguguggcugcacaucaucaaccugcuugcauaaagaauggccucauucaagaaacuggagauguaaucccacuuggugcuggggaguaggaaccggcugcacaugcugcggaguggauguaaaagaccuuuuuacagaccacauguuuaucaaauggaagguugaauauauaaaaaccgaagccauaguauguguugagcucaccagccaagaaagacagugcagucugauugaggcagguacuagauucaacuuggguccugugacuauuacccugucugagccaagaaacauucagcagaagcuucccccugagaucauuacgcugcaucccaaaauugaagaaggcuucuuugacuugaugcaugugcaaaaaguguuauccgcaaguacaguguguaaacugcagaguugcacacaugguauaccaggagaucuacaaauuuaccacauuggcaacuuguugaaaggggauagaguaaacgggcaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaagaaaguugagauaucaggcuugaaauuugcaagucugacuuguacggguugcuaugcuuguagcucuggcaucuccuguaaagucagaauucauguagaugaaccagaugagcucacagugcauguaaagagcagugauccagaugugguugcagcuagcacaagccuuauggcaagaaagcuugaauuugggacagauagcacauucaaggcauuuucagcuaugcccaaaaccucuuuaugcuuuuacauuguggagagggaauacugcaagagcugcagugaagaugauacaaaaaaauguguugacacaaaacuugagcagccacagagcauacuaauugagcacaaagggacgauaauuggaaagcagaaugauacuugcacagccaaggcaaguuguuggcuagagucagucaagaguuuuuuuuauggauugaagaauaugcuuggcaguguuuuugguaguuuuuuuguaggcauuuuguuauuccuugccccuuuugucuuguuggugcuuuucuuuauguuuggauggaaaaucuuguuuugcuuuaaguguugcaggaggaccagaggcuuguuuaaguauagacaccucaaagaugacgaggaaacaggcuacagaaggauuauugaaagacugaacagcaaaaaaggaaaaaacagacugcuugauggugagagguuggcugauaggaaaauugcugagcuguucucuucaaaaacacacauuggc

SEQ ID NO: 3791 - RNA, 3495 nt, Artificial Sequence
  derived and/or modified CDS sequence (wt) from CCHVF(CCHVF SK/2015/human)__KX458183.1__Gn-NSm-Gc
ucugaagaaucuggugaugacugcauaucaagaacucgccuauugagaacagagacugcagagauccauggugauagcuauggugguccaggugacaagauuacuauuugcaaugguucaacuauuguagaucaaagacuggguagugagaugggguguuacacuaucaauagagugaagucauucaagcugugcgaaaacagugcaacagggaagagcugugaaauagacaguaucccaguuaggugcaggcaggguuauugccuaaaaaucacucaggagggaaggggccaugugaaauuauccaggggcucagagguugucuuggaugcaugcgacucaagcugugaaguaaugauaccuaagggcacaggugacauccuuguagacuguucaggugggcagcaacauuuuuugaaggacaacuuaauugaucuaggaugucccaauauuccauuauuagguaaaauggcuauuuauauuugcagaaugucgaaucacccuaagacaaccauggcuuuucucuuuugguucaguuuuggcuaugugauaaccuguauacucugcaaggcuauuuucuacuuauuaauaauuguuggaacacuagggaagagguuuaagcaguacagagaguuaaaaccccagaccugcaccauaugugagacaacuccugcaaaugcaauagaugcugaaaugcaugaccuuaacugcaguuacaccauaugccccuauugugcaucuagacuaaccucagaugggcuugcuaggcaugugacacaaugcccuaagcggaaggagaaaguagaagaaacugaauuguaccugaacuuagagagaauucccuggguuguaagaaagcuguugcagguaucggaguccacugguguugcauuaaaaagaaguagcuggcugauugugcugcuuguguuguucacaguuucauuaucaccaguucaaucagcacccaucggucaugggaagacaauugagacauaccaggccagggaggaauacacaggcauuugccucuuuguacuaggaaguauccuguuuauagucucuugucuagugaaagggcugguugacgguguuggcaacaucuucuuuccugggcuguccauuugcaaaacgugcucuauagguaguaucaauggcuuugaaauugagucucauaagugcuauuguagcuugcuuuguugccccuacuguaggcauugcucugcggauagagaaauucaccagcugcacuugagcaucugcaaaaaaagaaaaacaggaaguaaugucaugcuugcagucugcaagcgcaugugcuucagagcaacuauggaagugagcaauaaggcccuacuuauccguagcauuaucaacaccacuuuuguugugugcauauugauacuagcagucuguguuguuagcaccucagcaguagagauggaaagccuaccggcugggaccugggaaagagaagaagaccuaacaaauuucugucaucaggaaugccagguuacggagacugagugccucugcccuuaugaagcccuaguacucagaaggcccuuguuccuggauaguauaguaagaggcaugaaaaaucugcuaaacucaacaaguuuggagacaagcuuaucgauugaggcaccauggggagcaauaaauguucagucaaccuacaagccaacugugucaacugcaaacauagcacuuaguuggaguucaguugaacacagagguaauaagauuuugguuucaggcagaucagaaucaauuaugaagcuagaagaaaggacaggagucagcugggaccuuggcguagaagaugccucugaaucuaagcuacuuacagucucugucauggacuuaucucagauguacucuccugucuucgaguacuuaucaggugacagacaaguagaagaguggcccaaggcaaccuguacaggugacugcccagaaagauguggcugcacaacgucaaccugcuugcauaaagaauggccucauucaagaaacuggagauguaaucccacuuggugcuggggaguggggacuggcugcacuuguuguggauuagaugugaaagaccuuuuuacugauuauauguucgucaaguggaaaguugaauacauuaaaacagaggccauaguguguguggaacucaccagucaaggaaggcaaugcagcuugauugaggcgggcacaagguucaauuuagguucugugaccaucacauugucggaaccgaggaacauucaacauaagcucccuccugaaauaaucacauugcauccuaggauugaagaagguuucuuugaccugaugcauguacaaaaaguguugucagcuagcacaguguguaaguugcagaguugcacacacggugugccaggugaucuacaggucuaucauaucggaaauuuauuaaaaggggauaaagugaauggacaccuaauucauaaaauugagccacacuucaacacuuccuggauguccugggauggcugugacuuagacuacuacugcaacaugggagacuggccuucuuguacauauaccggaguuacccaacacaaucaugcuucauuuguaaaccuacucaacauugaaacugacuauacaaaaaacuuccacuuucacucuaaaaggguuacugcgcauggagacacaccacaauuagaucugaaagcaagaccaacuuacggcgcaggagaaaucacuguacugguagaaguugcugacauggaguuacacacgaagaaaauugaaauaucaggccuaaaauuugcaagccugacuugcacaggcuguuaugcuuguaguucuggcauuuccugcaaaguuaggauucauguggaugaaccagaugaacuuacaguacacguuaagagugaugauccagauguaguggcagcuagcucaagucucauggcaaggaagcuugaguuuggaacagacaguacguuuaaagcuuucucagccaugcccaaaaccuccuuauguuucuacauuguagaaagggaguacuguaagagcugcaguaaagaagacacacaaaaauguguuaacacaaaacuugagcaaccacagagcaucuugaucgaacauaggggaacuauaaucggaaagcagaacaauaccugcauagccaaagcaaguugcugguuagagucaguuaaaaguuucuuuuauggucuaaagaacaugcuuaguggcauuuuuggcaaucucuuucugggcaucuucuuauuucuugcccccuuuaucuuguuaauacuuuuuuucauguuuggauggaggauccuguuuugcuuuaaguguugcagaagaaccaggggccuguucaaguauagacaucucaaagacgaugaagaaacugguuacagaaggaucauugaaagacugaacaacaagaaagggaagaacaagcugcuugauggugaaagacuugccgauagaagaauugccgaacuauucuccacaaagacacacauuggc

SEQ ID NO: 3792 - RNA, 3495 nt, Artificial Sequence
  derived and/or modified CDS sequence (wt) from CCHVF(CCHVF YL16070)__KY354081.1__Gn-NSm-Gc
gcagaaggaggaagcagugacugcauuucaagaacucagcuaguuaaaacagagguugcagaaauucaugaggacaguuacggugggccuggugagaaaauaacaaucugcaaugguuccacaauuguagaucaaaggcuugguagugaauugggcugcuauacaaucaacagaguaaaauccuacaagcuaugcgagaacagugccucagggaaaagcugugaaauagauagcaucccagucaaaugcaaacaaggguuuugccucaaaauaacccaagaaggaagaggucauguaaaacuguccagagggacagaaauuguucuagaugucugugauuccagcugugagcugaugauaccuaagggcacuggagacauuuuaguggauugcucaggagggcaacagcauuuuuuacaaaacaaucugauugacuugggaugccccaaugucccauuacuggguaaaauggccauauaugucugcaggaugucaaaccacccaaaaacuaccauggcauuucuguucugguucagcuuuggcuaugucauuacauguauaguaugcaggguacucuucuacuugcugauugccaucggaacaguagggaaaaagcuaaaacaguauagagagcugaaaccacaaacaugcauuguuugugaaucugucccuguuaaugcaauagaugcugaaaugcaugagcuuaauugcaguuacaacauaugcccauacugugcuucuagacugucuacagacgggcucaucaggcacguaacucagugucccaaacggagggagaagguggaagagacugagcuauucuugaacuuggaaagaauaccuuggcuggugagaaagcuccuucaaguaucagagucaacaggaauggcucuaaagagaagcuguuggaugaucacacuccucauucuacuauugguuucgaugucaccaguccaaucugcaccgguaggcaaagaaagggcaaucgagaccuaucaagcaagagaagccuacacaggcauaugccucuuuguguuaggaaguguucuuuuugcgguauccuggcugacaaaggccuugauugauggcaucggcaacagcuucuucccuggacuuucugucugcaagacaugcuccauugguaguauaaauggauuugaaauagagucucauaaaugcuauugcagucuauucuguuguccuuacuguagagcuugcucauccgacaaaaacacucaccggaugcacuuaaauguuugcaaaaaaaggaaaauggguagcaaugucaugcuggcugucuguaaacguaugugcuuuagagcaaccauugaggcaagcaauaaggcuuuacugaucaggagcaucauaaauuccacuuuugugauuugcauauuaauccuaacaaucugugugguaagcaccuccgcaguugauauggaaaauuugccugcaggcaucugggagaaagaagaagaucuuacaaacuucugucaccaggagugucaagugacagaaacugaaugccucugcccguaugaggccaugguacucaggaagccacucuuccuggauagcauagccaagggaaugaaaagccuguugaacuccacgagcuuagaaacuagucugucaauugaagcuccguggggagcaaucaauguucagucaacuuucaaaccaacaguuucagcugcuaacauagcacuuagcuggaguucaguugaacacaggggcaacaaaauuuugguuucagguagaucagagucaaucaugaaauuagaagaaagaacaggagucagcuggaaccuggguguagaagaugcuucugagucaaagacgcuuacuguuuccgucauggaccugucacaaauguacucuccuguuuuugaguacuugucaggugacagacaaguggaggaauggccaaaggcaacuugcacaggugacuguccagagagaugcggcugcacuucaucaaccugcuuacauaaagaguggccacauucaagaaacuggagauguaauccuacuugguguugggggguggggacuggcugcacuugcugugggcuggaugugaaggauuuuuuuacugacuacauguugguaaaauggaaaguggaauauauaaagacagaagcuauagugugugucgagcuaacuagucaagagaggcaguguaguuuaauugaagcaggcacaagauuuaaccuaggcccuguaacaauaacccuaucagagccaagaaauguccagcagaggcuuccucccgaaauuguaacacugcauccuaaaauagaggaagguuuuuuugauuugaugcauguacaaaaaauacugucugcaagcacaguuugcaagcuacagagcugcacacacggugugccgggcgauuuucaggucuaccaugucgguaaccugcugaggggagacaagguuaauggacacucaauucacaagauagaaccacauuuuaauacuucauggaugucaugggaugguugcgaucuggacuauuucugcaauaugggggacuggccuucaugcacauacacuggaguaacacagcauaaccgugcugcauuuaucaacaugcucaacauugagacugacuauacaaaaacuuuccacuuucauucgaagagggucacggcacauggagauacuccccagcuagaccuaaaagcgagaccggcauauggugcuggcgaagucacuguucuaguggagguugcagacuuggaguugcacacaaagaaacuugaagugucagguuugaaaauugcaaguuugaccugcucuggguguuaugcaugcagcucuggcaucuccugcaaaguuagaauccauguaaaugaaccagacgaauucacagugcauguaagaaguagcgacccagauguuguagcagcaggaucaagucuuauggcaaggaaaauagaguuuggggcugacaguacauucaaggccuuuucaucaaugcccaaggacuccuuaugcuuuuacauaguagaaaaggauuacugcagcagcugcaccgacgaugacacacaaaagugugucaacacgaagcuugaccauccacagagcauacucauugagcacaaaggaacaauaauuggcaagcaaaaugacacuuguucgaccaaaacaagcugcuggcuaaaaucauuuaaggguuucuucuaugggcucaaaaacaugcugaguggcaucuuuggaaauguuuuuuuaggcauccucuuauuccuugcuccuuuuguacuacugauauuuuuuuucuuuuuuggguggaggcuucuguuuugucucaaauguugcaaaaaaacuaaaggacuguugaaauauaagcaccuuaaggacaaggaggaggcuggauacaaaaaaaucauugaaaggcuaaauggcaaaaaagguaaaagucaauuguuugauggugaaaggcuugcaaacaggaaaauugcugagcuuuuuucuacuaaaauucacauaggu

SEQ ID NO: 3793 - RNA, 3495 nt, Artificial Sequence
  derived and/or modified CDS sequence (wt) from CCHVF(CCHVF Oman_812956)__KY362518.1__Gn-NSm-Gc
uccgaagagucuggugaagacuguauaucaaggacucagcuguugaggacagaaacugcagaaauccauggugauaacuauggugguccaggugacaaaauaaccaucugcaaugguucaaccauuguagaucaaaggcuggguagugaacugggguguuacacuaucaauagggugaagucauuuaagcuaugcgaaaacagugccacagguaaguccugugaaauagauaacacuccaguaaaaugcaagcaagguuuuugcuugaaaauaacccaagaaggaaggggccacgugaagcuuucaagagacucagaaguuguccuggacgccugcgauucaagcugugaaauaaugauaccaaagggcacuggagacauccugguugacugcucaggugggcagcagcacuucuuaaaagacaaccugauugaucugggaugccccaacaucccauuauuaggcaaaauggcaaucuacauuuguagaaugucaaaucauccuaaaacaacuauggcuuuucuuuuuugguuuagcuuugguuaugugauaaccugcauacuuuguaaagucauuuuuuaucuauugauaguuguuggaacuuuagggaaaaaguuuaaacaguauagagaguuaaaaccucagaccugcacaauaugugaaacaacuccugucaaugcaauagaugcugagaugcacgaucucaauuguaguuacaauauauguccuuauugugcaucuagguuaacuucagauggucuugccagacauguaaugcaguguccuaagcggaaggaaaaaauagaagaaaccgaauuauaccugaacuuagaaagaaucccuuggguugucagaaaacuacugcagguaucagaauccacugguguagcacuaaagaggagcaguuggcugauugugcuacuugugcuucucacaguuucauugucaccaguacaaucagcaccuaucggucaugggaagaccauagaaacguaucaaacuagagaaggguacacaaguauuugucuuuuugugcuaggaagcauuuuguuuauaguuucucaccuaaugaaggggcugguugacaguguugguaacaguuuuuucccuggguuaucuaucugcaagacaugcucuauuggcaguauaaauggcuuugaaauugaaucucacaaauguuacuguagccuauuuuguugccccuacuguagacacugcucugccgauaaagaaauccauaaguugcauuugagcaucugcaaaaaaagaaaagcugggaguaaugucauguuggccgucuguaagcgcauguguuuuagggcaacuauggaagugagcaacaaggcucuacucauccgaagugucaucaacacuacuuuuguuguaugcauacuaauauuagcaguuuguguuguuagcaccuccgcaguagagauggaaagccugccagcuggcacuugggagagagaggaagaccuaacaaacuucugccaucaagaaugccaggucacugaaacugaaugucucugucccuaugaagcucuuguacucagaaagcccuuauuuuuugacaguauugcuaaggguaugaagaaccugcugaauucaacaagcuuagaaacaagcuuaucaauugaggcaccauggggagcaauaaacguccaaucuacuuucaaaccuacugugucaacugcaaacauagcacuuaguuggagcucaguggaacacagagguaauaagaucuugguuucaggcagaucagagucaaucaugaagcuagaagaaagaacaggaaucagcugggauuugggaguagaagaugccucugaguccaaauuacuuacuguuuccgucauggacuuaucacagauguacucuccugucuuugaguaccuaucaggugacagacaaguagaggaauggccaaaggcaaccuguacaggcgauugcccggaaagauguggcugcacaucaucaaccugccuacacaaggaauggccucacucaagaaacuggagaugcaaccccacuugguguuggggagucggcaccggaugcaccuguuguggacuagauguaaaggaccuuuuuacagauuacauguuuguuaaauggaaggucgaauauauaaaaacagaggcuauaguguguguugagcuuacuagccaagaaagacaauguagcuugauugaggcaggcacaagauucaacuuagguccugugacuaucacauuaucagagccaagaaacauucagcaaaagcucccuccagaaauugucacauuacauccuagaauugaagaagguuuuuuugacuuaaugcauguacagaagguacuaucagcaagcacagugugcaagcuacagaguugcacacauggcguaccaggagacuuacaggucuaccacaucggaaacuuacuaaaaggagacaaagugaaugggcaucugauacauaaaguugaaccacauuucaacaccuccuggaugucuugggacggcugugaccuagauuacuacugcaauaugggggauuggcccucuugcacguauacuggaguuacccaacauaaucaugcugcauuuguaaaccuacuuaacauugaaacugauuacacaaagaacuuccacuuucacucuaagagagucacugcacauggggacacuccacaauuagauuuaaaagccagaccaaauuauggugcaggugaaaucacugugcugguggaaguugcugacauggaguuacacacaaagaaaauugagauaucagguuugaaguuugcaagccuaaccugcacagguuguuaugcuuguagcucuggcaucucauguaagguuaggauccauguagaugaaccagaugagcuuacaguacaugugaagagugaagacccagacauaguugcugcuagcucaagucucauggcaagaaagcuugaauucgggacggauaguacauucaaagccuucucagccaugccuaaaaccuccuugugcuuuuacauuguugagagagaauacuguaaaagcugcaguaaagaagacacacaaaaguguguuaacgcaaagcuugagcgaccacagagcauuuuaauugagcacaaaggaacgauaauuggaaagcagaacgacacuugcacagcuaaagcaagcugcuggcuagagucagucaagaguuucuuuuauggacuaaagaacaugcuuaguggcauuuuuggcaauguuuucauagggauuuucuuauuccuugcuccuuuuauccuguuaauacuuuucuuuauguuuggguggagaauccuauucugcuuuaagugcugcaggagaacuagaggccuauuuaaguacagacaccucaaagaugaugaagaaaccgguuauaggaaaaucauugagagacuaaacaacaaaaaagguaaaaacaagcugcuugacggugaaagauuagcugauagaaagaucgcugagcuguucucuacaaaaacacacauuggc

SEQ ID NO: 3794 - RNA, 3495 nt, Artificial Sequence
  derived and/or modified CDS sequence (wt) from CCHVF(CCHVF UCCR4405)__KY484029.1__Gn-NSm-Gc
ucugaagagccaggugacgacugcauaucaagaacucagcuauugaagacagaaacagcagagauccaugacgacaacuauggugguccaggugacaaaauaacuaucugcaaugguucaaccauuguggaucagagacugggcagugaacuaggguguuauaccaucaacagggugaagucauucaagcuaugcgaaaacagugccacagggaaaaccugugagauagacagcacuccggucaagugcaggcaagguuuuuguuugaaaaucacccaagagggaaggggccacguaaaauuauccaggggcucagagguuguuuuggaugcuugcgacucgagcugugaaguaaugauaccuaaaggcacuggagauauccuaguagacuguucagguggacagcagcauuucuuaaaagacaacuugauugaccuagggugcccucauaucccgcuauuggguaagauggccauuuacauuugcagaaugucaaaucaucccaggacaaccauggcuuuccucuucugguucaguuuuggcuauguaaucaccuguauauuuugcaaggcucuuuuuuacucauugauaauuauugggacacuagggaaaaaaaucaagcaauauagggagcugaaaccucaaacuugcaccauaugugagacagcuccugucaaugcaauagaugcugaaaugcaugaccucaaauguaguuacaauauaugcccuuauugugcaucaagauugaccucugaugggcuagcuaggcaugugacacaaugcccuaagcgaaaggagaaaguugaggagacugaacuguacuugaaccuggaaagaauuccuuggauagucagaaagcuauugcaagugucagaguccacugguguagcauugaaacgaagcaguuggcugauugugcugcuuguguuacucacagucucauugucaccgguucaaucagcaccuguuggucaugguaagacaauugaaacauaucagaccagagaaggauucacaaguaucugucucuuuauguuaggaagcauccuauucauagucucuugccuaguaaaggggcugguugacagugucagugacagcuucuuccccggccugucugucuguaagacaugcucuauuggcaguauaaauggcuuugaaauugaaucgcauaaaugcuacuguaguuuauuuugcugccccuacuguaggcacuacucugcugacagagaaauucaccaguugcacuugaguaucugcaaaaaaaggaaaacggggagcaaugucaugcuggcugucugcaaacgcaugugcuuuaaggcaacuauagaagcaagcagaagagcccugcucauccgaaguauuaucaacaccacuuuuguaauauguauucuaauauuagcaaucuguguuguuagcaccucugcaguagagauggaaaaccuuccagcaggcacuugggagagagaggaagaccugacaaauuucugccaccaggaaugccaggugaccgagacggaaugccucuguccauacgaagcucuugugcucaggaaaccucuuuucuuagacaguacaguuaaagguaugaaaaauuugcuaaacucaacaagcuuggaaacaagcuuaucaauugaggcaccauggggagcaauaaauguccagucaaccuuuaaaccaacaguaucgacugcaaacauagcacucaguuggagcucaguggagcacagaggcaacaagaucuuggucacaggcaggucugaaucaauuaugaaacuagaggaaaggacaggagucagcugggaucuaggcguagaagaugccucugaauccaaauuacuuaccgucuccaucauggauuugucacaaauguauuccccuguuuuugaguacuuaucaggagauagacagguugaagaauggcccaaggcaaccuguacaggugauugcccagaaagguguggcugcacaucaucaaccugcuugcauaaagaauggccucacucaagaaacuggagauguaaccccacuuggugcuggggaguaggaaccggcugcacaugcugcggaguggauguaaaagaccuuuuuacagaucacauguuugucaaauggaagguugaauauauaaaaaccgaagccauaguauguguugagcucaccagccaagaaagacagugcagucugauugaggcagguacuagauucaacuuggguccugugacuaucacccugucugagccaagaaacauucagcagaagcuucccccugagaucauuacgcugcaucccaaaauugaagaaggcuucuuugacuugaugcauguacaaaaaguguuaucugcaaguacaguguguaaacugcagaguugcacacaugguauaccaggagaucuacaaauuuaccacauuggcaacuuguugaaaggggauagaguaaacgggcaucuaauucacaaaauugaaccacauuuuaacaccucuuggauguccugggaugguugugaccuagacuacuauugcaacauggggaauuggccuucuugcacauacacaggagugacccaacauaaucaugcugcauuuguaaauuugcuuaacauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaagaaaguugagauaucaggcuugaaauuugcaagucugguuugcacggguugcuaugcuuguagcucuggcauuuccuguaaagucagaauucauguagaugaaccagaugagcucacagugcauguaaagagcagugauccagaugugguugcagcuagcacaagccuuauggcaaggaagcuugaauuugggacagauagcauauucaaggcauuuucagcuaugcccaaaaccucuuuaugcuuuuacauuguggagagggaauacugcaagagcugcagugaagaugauacaaaaaaauguguugacacaaaacuugagcagccacagagcauacuaauugagcacaaagggacgauaauuggaaagcagaaugauacuugcacagccaaggcaaguuguuggcuagagucagucaagaguuuuuuuuauggauugaagaauaugcuuggcaguguuuuugguaauuuuuucguaggcauuuuguuauuccuugccccuuuugucuuguuggugcuuuucuuuauguuuggauggaaaaucuuguuuugcuuuaaguguugcaggaggaccagaggcuuguuuaaguauagacaccucaaagacgaugaggaaacaggcuacagaaggauuauugaaagacugaauaguaaaaaaggaaaaaacagacugcuugauggugagagguuggcugauaggaaaauugcugagcuguucuccacaaaaacacacauuggc

SEQ ID NO: 3795 - RNA, 3495 nt, Artificial Sequence
  derived and/or modified CDS sequence (wt) from CCHVF(CCHVF UCCR4459)__KY484032.1__Gn-NSm-Gc
uccgaagagucuggugaugacugcauaucaagaacucagcuaucgaggacagagacugcggaaauucacagugauaacuauggugguccaggugacaagauaaccaucugcaaugguucaacuauuguagaucagagauugggcagugaacuaggguguuacacuaucaauagaguaaagucauuuaagcuuugcgagaacagugccacagguaaauccugugaaauagauagcaccccaauuaaaugcaggcaggguuuuuguuuaaaaauuacucaggagggaaggggccacgugaagcuaucaagagguucagaaguugucuuggacgccugugauucaagcugugagauaaugauaccaaagggcacuggagacauccuaguugacuguucagguggacagcaacauuucuuaaaagauaacuugauugaucugggaugcccaaacaucccacuauuagguaagauggcuaucuacauuuguagaaugucaaaucauccuaaaacgacuauggcuuuucuuuuuugguuuagcuuugguuaugugauaaccuguauacucuguaaggucaucuucuaccuauuaauaguuguggggacguugggaaaaaaguucaaacaguauagagaguugaaaccucagaccuguaccauaugcgaaacaacuccuguuaaugcaauagaugcugaaaugcacgaccucaacugcaguuacaauauauguccuuacugugcaucuagguuaaccucagacggucuugccagacauguaaugcagugcccuaagcggaaggaaaaaguagaagaaaccgaauuauacuuaaacuuagaaagaauccccuggguuguuaggaaauuacugcaggugucagaauccaccgguguggcacuaaagaggaguaguuggcugguugugcuacuuguguuacuuacaguuucauugucaccaguacaaucagcaccuaucggccauggaaagacaguugaaacauaucaaaccagagaaggguacacaagcauuugccuuuuuguacuaggaagcaucuuauuuauagucucuugccuaaugaagggguugguugacaguguugguaacaguuuuuucccugguuuguccauuuguaagacauguucuauuggcagcauaaauggcuuugagauugaaucucacaaauguuacuguagccuauuuuguugccccuacuguagacacugcucugccgauagagaaauacauaaguugcacuugagcaucugcaagaaaaggaagacugggaguaaugucauguuggccgucuguaagcgcaugugcuuuagggcaacuguggaaguaagcaacaaggcucuacuuauccgaaacaucaucaauaccacuuuuguugugugcauacugauauuagcaguuuguguugucagcaccuccgcaguggagauggaaagccugccagcuggcacuugggagagagaggaagaucugacaaauuucugucaucaagaaugccaagucacugagacugaaugccucuguccuuacgaagcucuugugcucaggaaacccuuguuuucagacaguauugucaaaggcaugaagaacuugcuaaauucaacaagcuuagaaacaagcuuaucaauugaggcaccauggggagcuauaaauguccaaucaaccuucaaaccuacuguguccgcugcgaacauagcucuuaguuggagcucaguggaacacagggguaauaagauuuugguuucagguagaucagagucaauuaugaagcuagaggaaaggacaggaaucagcugggaucuagggguagaagaugccucugagucuaaauugcuuacugucucuauuauggacuugucacagauguauucuccugucuuugaguaccuaucaggugauagacaaguggaggaauggcccaaggcaaccugcacaggagauugcccagaaagauguggcugcacaucaucaaccugccuacacaaagaauggccccauucaagaaacuggagaugcaaccccaccugguguuggggagucggcacuggauguaccugcugugggcuggauguaaaagaccuuuuuacagauuacauguuugucaaguggaaaguugaguacauuaaaacagaagcuauaguguguguugagcuuacuagccaagagagacaauguagcuugauugaggcaggcacaagauucaacuuagguccugugaccaucacauugucagagccaagaaacauucagcaaaagcucccuccagagauaguuacauugcaucccagaauugaagaagguuucuuugauuuaaugcauguaaaaaaagugcuaucagcaaguacaguauguaagcuacagaguugcacacauggugugccaggggaccuacaggucuaccacauaggaaacuuguuaaaaggagacaaggugaaugggcaccugauucacaaaauugaaccacacuucaacacuuccuggaugucuugggacggcugugaccuagacuacuacuguaauaugggagacuggccaucuugcucauauacuggaguaacccagcacaaucaugcugcauuuguaaacaugcucaacaucgaaacugauuauacaaaaaucuuccacuuucacucuaagagaguuacugcacauggagacacaccacaauuagauuugaaagcuagaccaacuuauggugcaggugaaaucacugugcuaguggaaguugcugacauggaguuacacacaaagaaaauugagauaucagguuuaaaguuugcaagcuuaacuugcacaggcuguuaugcuuguagcucugguaucuccuguaagguuagaauccauguagaugagccugaugagcuuacaguacaugugaagagugaagacccagacauaguugcugcuagcucaagucucauggcuagaaaacuugaauuugggacagauagcacauucaaagccuuuucagccaugcccaaaaccuccuugugcuuuuacauuguggagagagaauauuguaaaagcugcaguaaagaagauacacaaaaaugugucaacacaaagcuugagcaaccacagagcauuuuaauugagcacaaaggaacgauaauugguaagcaaaacgacaccugcacaucuaaagcaggcuguuggcuagagucagucaagagcuucuuuuaugggcuaaaaaacaugcuuaguggcauuuuuggcaauguuuucauagggauuuucuuauuccuugcuccuuuuauccuuuuaauacuuuucuuuauguuuggauggagaauccuguucugcuuuaaauguugcagaagaacuagaggcuuauuuaaguacagacaccucaaggacgaugaagaaaccgguuacaggaaaaucauugagaggcugaacaacaaaaaagggaaaaacaaacugcuugauggugaaagauuagcugauaggaagauugcugagcuguucuccacaaagacacacauuggc

SEQ ID NO: 3796 - RNA, 3495 nt, Artificial Sequence
  derived and/or modified CDS sequence (wt) from CCHVF(CCHVF UCCR4401)__KY484035.1__Gn-NSm-Gc
ucagaagaacccagugaugacuguauaucaagaacucaacuauuaaggacagagacugcagagauccacggcgacaacuaugguggcccgggugacaaaauaaccaucugcaauggcucaacuauuguagaccaaagacugggcagugaacuaggaugcuacaccaucaauagagugaggucauucaagcuaugcgaaaacagugccacagggaagaauugugaaauagacagugucccaguuaaaugcaggcaggguuauugccuaagaaucacucaggaagggaggggccacguaaaauuaucuaggggcucagagguugucuuagaugcaugcgauacaagcugugaaauaaugauaccuaagggcacuggugacauccuaguugacuguucaggugggcagcaacauuuucuaaaggacaauuugauagaucuaggaugccccaaaauuccauuauugggcaaaauggcuauuuacauuugcagaaugucaaaccaccccaaaacaaccauggcuuuccucuucugguucagcuuuggcuauguaauaaccugcauacuuugcaaggccauuuuuuacuuguuaauaauuguuggaacacuagggaaaaggcucaagcaguauagagaguugaaaccucagacuugcaccauaugugagacaacuccuguaaaugcaauagaugcugagaugcaugaccucaauugcaguuacaacauuugucccuacugugcaucuagacuaaccucagaugggcuugcuaggcaugugauacaaugcccuaagcggaaggagaaaguggaagaaacugaacuguacuugaacuuagaaagaauuccuuggguuguaagaaagcuguugcaggugucagagucaacugguguggcauugaaaagaagcaguuggcugauugugcugcuugugcuauucacuguuucauuaucaccaguucaaucagcacccauuggucaagggaagacaauugaggcauaccgggccagggaaggguacacaaguauaugccucuuuguacuaggaaguauccuauuuauaguuucuugccuaaugaaagggcugguugacaguguuggcaacuccuucuucccuggacuguccauuugcaaaacgugcuccauaagcagcauuaauggcuuugaaauugagucccauaagugcuauugcagcuuauucuguugccccuauuguaggcacugcucuaccgauaaagaaauucauaagcugcacuugagcaucugcaaaaaaaggaaaacaggaaguaaugucauguuggcugucugcaagcucauguguuucagggccaccauggaaguaaguaacagagcccuguuuauccguagcaucaucaacaccacuuuuguuuugugcauacugauacuagcaguuuguguuguuagcaccucagcaguggagauggaaaaccuaccagcagggaccugggaaagagaagaagaccuaacaaauuucugucaucaggaaugccagguuacagagacugaaugccucugcccuuaugaagcucuaguacucagaaagccuuuauuccuagauaguacagcuaaaggcaugaaaaaucugcuaaauucaacaaguuuagaaacgaguuuaucaauugaggcaccauggggagcaauaaauguucagucaaccuacaaaccaacugugucaacugcaaacauagcacucaguuggagcucaguggaacacagaggcaauaagaucuugguuucaggcagaucagaaucaauuaugaagcuggaagaaaggacaggaaucagcugggaucucgguguagaagaugccucugaaucuaaacugcuuacaguaucugucauggacuugucucagauguacucuccugucuucgaguacuuaucaggggacagacagguggaagaguggcccaaagcaacuugcacaggugacugcccagaaagauguggcugcacaucaucaaccuguuugcacaaagaauggccucacucaagaaauuggagaugcaaucccacuuggugcugggguguagggacuggcugcaccuguuguggauuagaugugaaagaccuuuuuacagauuauauguuugucaaguggaaaguugaauacaucaagacagaggccauaguguguguagaacuuacuagucaggaaaggcaguguagcuugauugaagcgggcacaagguucaauuuagguccugugaccaucacacugucagaaccaagaaacauccaacaaaaacucccuccugaaauaaucacacugcauccuaggaucgaagaagguuuuuuugaccugaugcaugugcaaaagguguuaucggcaagcacaguguguaaguugcagaguugcacacauggugugccaggagaccuacaggucuaccacaucggaaauuuauuaaaaggggauaagguaaauggacaucuaauucauaaaauugagccacacuucaacaccuccuggauguccugggaugguugugaccuagacuacuacugcaacaugggagauuggccuucuugcacauacacaggggucacccaacacaaucaugcuucauuuguaaacuuacucaacauugaaacugauuacacaaagaacuuccacuuucacucuaaaagggucacugcacacggagauacaccacaacuagaucuuaaggcaagaccaaccuauggugcaggcgagaucacuguucugguagaaguugcugacauggaguuacauacaaagaagauugaaauaucaggcuuaaaauuugcaagcuuagcuugcacagguuguuaugcuuguagcucuggcaucucaugcaaaguuagaauucauguggaugaaccagaugaacuuacaguacauguuaaaagugaugauccagaugugguugcagcuagcucaagucucauggcaaggaagcuugaauuuggaacagacaguacauuuaaagcuuucucggccaugccuaaaacuucucuauguuucuacauuguugaaagagaacacuguaagagcugcagugaagaagacacaaaaaaauguguuaacacaaaacuugagcaaccacaaagcauuuugaucgaacacaagggaacuauaaucggaaagcaaaacagcacuugcacggcuaaggcaaguugcugguuagagucagucaagaguuuuuuuuauggccuaaagaacaugcuuaguggcauuuuuggcaaugucuuuaugggcauuuucuuguuccuugcccccuucauccuguuaauacuauucuuuauguuuggguggaggauccuauucugcuuuaaauguuguagaagaaccagaggccuguucaaguauagacaccucaaagacgaugaagaaacugguuauagaaggauuauugaaaaacuaaacaauaaaaaaggaaaaaacaaacugcuugauggugaaagacuugcugauagaagaauugccgaacuguucucuacaaaaacacacauuggc

SEQ ID NO: 3797 - RNA, 3495 nt, Artificial Sequence
  derived and/or modified CDS sequence (wt) from CCHVF(CCHVF UCCR4448)__KY484042.1__Gn-NSm-Gc
uccgaagaaaccagugaugacugcauaucaagaacucaacuauugaggacagagacugcagagauccacggcgacaacuaugguggcccgggugacaaaauaaccaucugcaacggcucaacuauuguagaccaaagacuaggcagugagcuaggguguuacacuaucaacagagugaagucauucaagcuaugcgaaaauagugccacagggaagagcugugaaauagacagugucccaguuaaaugcaggcaggguuauugccuaagaaucacucaggaagggaggggccauguaaaauuaucuaggggcucagagguugucuuagaugcaugugauacaagcugugaaauaaugauaccuaagggcacuggugacaucuugguugacuguucaggugggcagcaacauuuucuaaaggacaauuugauagaucuaggaugccccaaaauuccauuauugggcaaaauggcuauuuacauuugcagaaugucgaaucaccccaaaacaaccauggcuuuccucuucugguucagcuuuggcuacgugauaacuuguauacuuugcaaggccaucuucuacuuguuaauaauuauuggaacacuagggaaaagguucaagcaguauagagaguuaaaaccccagaccugcaccauaugugagacaacuccuguaaaugcaauagaugcugagaugcacgaccucaauugcaguuacaacauuugucccuacugugcaucuagacuaaccucagaugggcuugcuaggcauguaacacaaugcccuaagcggaaggagaaaguggaagaaacugaacuguacuugaacuuagaaagaauuccuuggguuguaagaaagcuguugcagguaucagaguccacugguguggcauugaaaagaagcagcuggcugauugugcugcuugugcuguucacgauuucauugucaccaguucaaucagcacccauuagucacgggaagacaauugaggcauaccgggccagggagggauacacaaguauaugucucuuuguacuaggaaguauccuauucauagucucuuaccuaaugaaagggcugguugacaguguuggcaacuccuucuucccuggacuguccauuugcaagacgugcuccacaagcagcauuaauggcuuugaaauugagucccauaagugcuauugcagcuuauucuguugcccuuauuguaggcacugcucugcugauaaagaaauucauaagcugcaccugagcaucugcaaaaaaagaaaaacaggaagcaaugucauguuggcugucugcaagcgcauguguuucagggccaccauggaaguaaguaacagagcccuguuuauccguagcaucaucaacaccacuuuuguuuuguguauacugauacuagcaguuuguguuguuagcaccucagcaguggagauggaaaaccuaccagccgggaccugggaaagagaagaagaccuaacaaauuucugucaucaggaaugucagguuacagagacugaaugccucugcccuuaugaagcucuaguacucagaaagccucuauuccuagauaguauaguuaaaggcaugaaaaaucugcuaaacucaacaaguuuagaaacaaguuuaucaauugaggcaccauggggggcaauaaauguucagucaaccuacaaaccaacugugucaacugcaaacauagcacucaguuggagcucuguggaacacagagguaauaagaucuugguuucaggcagaucagaaucaauuaugaagcuggaagaaaagacaggaaucagcugggaucucggcguagaagacgccucugagucuaaacugcuuacagucucugucauggacuugucucagauguacucuccugucuucgaguacuuaucaggagacagacagguggaagaguggcccaaagcaacuuguacaggugacugcccagaaagaugcggcugcacaucaucaacguguuugcacaaagaauggccccacucaagaaauuggagaugcaaucccacuuggugcugggguguagggacuggcugcaccuguuguggauuagaugugaaagaccuuuuuacagauuauauguuugucaaguggaaaguugaauauauuaagacagaggccauaguguguguagaacuuaccagucaggaaaggcaguguagcuugauugaagcgggcacaagguucaauuuagguccugugaccaucacacugucagaaccaagaaacauccaacagaagcucccuccugaaauaaucacacugcaucccaggaucgaagaagguuuuuuugaccugaugcauguacaaaaaguguuaucggcaagcacaguauguaaguugcagaguugcacacaugguguaccaggagaccuacaggucuaccacaucggaaauuuauugaaaggggauaagguaaauggacaucuaauucauaaaauugagccacacuucaacacuuccuggauguccugggaugguugugaccuggacuacuacugcaacaugggagauuggccuucuugcacauauacaggagucacccaacacaaucaugcuucauuuguaaaccugcucaacauugaaacugauuacacaaaaaacuuccacuuucacucuaaaagggucacugcacauggagacacaccacaacuagaucuuaaggcaagaccaaccuauggugcaggugagaucacuguacugguagaaguugcugacauggaauuacacacaaagaagauugaaauaucaggcuuaaaauuugcaagcuugacuugcacagguuguuaugcuuguagcucuggcaucucaugcaaaguuagaauucauguggaugaaccagaugaacuuacaguacauguuaaaagugaugauccagauguaguugcagcuagcucaagucucauggcaagaaagcuugaauuuggaacagacaguacauuuaaagcuuucucagccaugccuaaaacuucucuauguuucuacauuguugaaagagaacacuguaagagcugcagcgaagaagacacaaaaaaauguguuaacacaaaacuugagcaaccacaaagcauuuugaucgaacacaagggaacuauaaucggaaagcaaaacagcacuugcacagccaaggcgaguugcugguuagagucagucaaaaguuucuuuuauggucuaaagaacaugcuuagugguauuuuuggcaauguuuuuauagguauuuucuuguuccuugcccccuucauccuauuaauacuauucuuuauguuuggguggaagauccuauuuugcuuuaaauguuguagaagaacuagaggccuauucaaguauagacaccucaaggacgaugaagaaacugguuauagaaggauuauugaaagacuaaacaauaaaaaaggaaaaaacaaacugcuugauggugaaauacuugcugauagaagaauugccgaacuguucucuacaaaaacacacauuggc

SEQ ID NO: 3798 - RNA, 3495 nt, Artificial Sequence
  derived and/or modified CDS sequence (wt) from CCHVF(CCHVF SPU4/81 )__DQ157175.1__Gn-NSm-Gc
uccgaagaacccagugaugacugcauaucaagaacucaacuauugaggacagagacugcagagauccacggcgacaacuaugguggcccgggugacaaaauaaccaucugcaacggcucaacuauuguagaccaaagacuaggcagugagcuaggguguuacacuaucaacagagugaagucauucaagcuaugcgaaaauagugccacagggaagagcugugaaauagaaagugucccaguuaaaugcaggcaggguuauugccugagaaucacucaggaagggaggggccauguaaaauuaucuaggggcucagagguugucuuagaugcaugugauacaagcugugaaauaaugauaccuaagggcacuggugacaucuugguugacuguucaggugggcagcaacauuuucuaaaggacaauuugauagaucuaggaugccccaaaauuccauuauugggcaaaauggcuauuuacauuugcagaaugucgaaucaccccaaaacaaccauggcuuuccucuucugguucagcuuuggcuacguaauaacuuguauacuuugcaaggccaucuucuacuuguuaauaauuauuggaacacuagggaaaagguucaagcaguauagagaguuaaaaccucagaccugcaccauaugugagacaacuccuguaaaugcaauagaugcugagaugcacgaccucaauugcaguuacaacauuugucccuacugugcaucuagacuaaccucagaugggcuugcuaggcaugugacacaaugcccuaagcggaaggagaaaguggaagaaacugaacuguacuugaacuuagaaagaauuccuuggguuguaagaaagcuguugcagguaucagaguccacugguguggcauugaaaagaagcagcuggcugauugugcugcuugugcuguucacgguuucauugucaccaguucaaucagcacccauuggucacgggaagacaauugaggcauaccgggccagggagggauacacaaguauaugucucuuuguacuaggaaguauccuauucauagucucuugccuaaugaaagggcugguugacaguguuggcaacuccuucuucccuggacuguccauuugcaagacgugcuccauaagcagcauuaauggcuuugaaauugagucccauaagugcuauugcagcuuauucuguugccccuauuguaggcacugcucugcugauaaagaaauucauaagcugcacuugagcaucugcaaaaaaagaaaaacaggaaguaaugucauguuggcugucugcaagcgcauguguuucagggccaccauggaaguaaguaacagagcccuguuuauccguagcaucaucaacaccacuuuuguuuuguguauacugauacuagcaguuuguguuguuagcacgucagcaguggagauggaaaaccuaccagccgggaccugggaaagagaagaagaccuaacaaauuucugucaucaggaaugucagguuacagagacugaaugccucugcccuuaugaagcucuaguacucagaaagccucuauuccuagauaguauaguuaaaggcaugaaaaaucugcuaaacucaacaaguuuagaaacaaguuuaucaauugaggcaccauggggggcaauaaauguucagucaaccuacaaaccaacugugucaacugcaaacauagcacucaguuggagcucuguggaacacagaggcaauaagaucuugguuucaggcagaucagaaucaauuaugaagcuggaagaaaggacaggaaucagcugggaucucggcguagaagacgccucugagucuaaacugcuuacagucucugucauggacuugucucagauguacucuccugucuucgaguacuuaucaggagacagacagguggaagaguggcccaaagcaacuuguacaggugacugcccagaaagaugcggcugcacaucaucaacguguuugcacaaagaauggccccauucaagaaauuggagaugcaaucccacuuggugcugggguguagggacuggcugcaccuguuguggauuagaugugaaagaccuuuuuacagauuauauguuugucaaguggaaaguugaauauauuaagacagaggccauaguguguguagaacuuaccagucaggaaaggcaguguagcuugauugaagcgggcacaagguucaauuuagguccugugaccaucacacugucagaaccaagaaacauccaacagaagcucccuccugaaauaaucacacugcaucccaggaucgaagaagguuuuuuugacuugaugcauguacagaaaguguuaucggcaagcacaguauguaaguugcagaguugcacacaugguguaccaggagaccuacaggucuaccacaucggaaauuuauugaaaggggauaagguaaauggacaucuaauucauaaaauugagccacacuucaacacuuccuggauguccugggaugguugugaccuggacuacuacugcaacaugggagauuggccuucuugcacauacacaggagucacccaacacaaucaugcuucauuuguaaaccugcucaacauugagacugauuacacaaaaaacuuccacuuucacucuaaaagggucacugcacacggagacacaccacaacuagaucuuaaggcaagaccaaccuauggugcaggugagaucacuguacugguagaaguugcugacauggaguuacacacaaagaagauugaaauaucaggcuuaaaauuugcaagcuugacuugcacagguuguuaugcuuguagcucuggcaucucaugcaaaguuagaauucauguggaugaaccagaugaacuuacaguacauguuaaaagugaugauccagauguaguugcagcuagcucaagucucauggcaagaaagcuugaauuuggaacagacaguacauuuaaagcuuucucagccaugccuaaaacuucucuauguuucuacauuguugaaagagaacacuguaagagcugcagcgaagaagacacaaaaaaaugcgucaacacaaaacuugagcaaccacaaagcauuuugaucgaacacaagggaacuauaaucggaaagcaaaacagcacuugcacagccaaggcgaguugcugguuagagucagucaaaaguuuuuuuuauggucuaaagaacaugcuuagugguauuuuuggcaauguuuuuauagguauuuucuuguuccuuggccccuucaucuuguuaauacuauucuuuauguuuggguggaggauccuauuuugcuuuaaauguuguagaagaacuagaggccugcucaaguauagacaccucaaggaagaugaagaaacugguuauagaaggauuauugaaagacuaaacaauaaaaaaggaaaaaacaaacugcuugauggugaaagacuugcugauagaagaauugccgaacuguucucuacaaaaacacacauuggc

SEQ ID NO: 3799 - RNA, 3495 nt, Artificial Sequence
  derived and/or modified CDS sequence (wt) from CCHVF(CCHVF Sudan Al-Fulah 9-2008)__HQ378185.1__Gn-NSm-Gc
uccgaagaacccagugaugacugcauaucaagaacucaacuauugaggacagagacugcagaaauccacggcgacaacuaugguggcccgggugacaaaauaaccaucugcaacggcucaacuauuguagaccaaagacugggcagugaguuaggguguuacacuaucaauagagugaagucauucaagcuaugugaaaauagugccacugggaagagcugugugauagacagugucccaguuaaaugcaggcaggguuauugccuaaggauuacucaagaaggaaggggccauguaaaauuaucuaggggcucagagguugucuuagaugcaugcgauacaagcugugaaauaaugauaccuaagggcaccggugacauccuaguugacuguucaggugggcagcaacauuuucuaaaggacaauuugguagaucuaggaugccccaaaaucccauuacugggcaaaauggcuaucuacauuugcagaaugucgaaucaccccaaaacaaccauggcuuuccucuucugguucagcuuuggcuauguaauaacuuguauacuuugcaaggccaucuuuuacuuguuaauaauuauuggaacacuagggaaaagguucaggcaguauagagaguuaaagccucagaccugcaccauaugugagacaacuccuguaaaugcaauagaugcugagaugcaugaccucaauugcaguuacaacauuugucccuacugugcaucuagacuaaccucggaugggcuugcuaggcaugugacacagugcccuaagcggaaggagaaaguggaagaaacugaacuguacuugaacuuagaaagaauuccuuggguugugagaaagcuguugcagguaucagaguccaccgguguggcauugaaaagaagcagcuggcugauugugcugcuugugcuguucacgguuucauugucgccaguucaaucagcacccauuggucacgggaagacgauugaggcauaccgugccagggagggauacacaaguauaugucucuuuguacuaggaaguauccuauuuauagucucuugccuaaugaaaggguugguugacaguguuggcaacuccuucuucccuggacuguccauuugcaaaacgugcuccauaagcagcauuaauggcuuugaaauugagucccauaagugcuauugcagcuuguucuguugccccuauuguaggcacugcucugcugauaaagaaauucacaagcugcacuugagcaucugcaaaaaaaggaaaacaggaaguaaugucauguuggcuguuugcaagcgcauguguuucagggccaccauggaaguaaguaacagagcccuguuuauucguagcaucaucaauaccacuuuuguuuugugcauacugauacuagcaguuuguguuguuagcaccucagcaguggagauggaaaaccuaccagccgggacuugggaaagagaagaagaccuaacaaauuucugucaucaggaaugccaaguuacagagacugaaugccucugcccuuaugaagcucuaguacucagaaggccucuauuccuagacaguauaguuaaaggcaugaaaaaucugcuaaacucaacaaguuuagaaacaagucugucaauugaggcaccauggggggcaauaaauguucagucaaccuacaagccaacugugucgacugcaaauauagcacucagcuggagcucaguggaacacagaggcaauaagaucuugguuucaggcagaucagaaucaauuaugaagcuggaagaaaggacagggaucagcugggaucucggcguagaagacgccucugagucuaaacugcuuacagucucuguuauggauuugucucagauguacucuccugucuucgaguacuuaucaggagacagacagguggaggaguggcccaaagcaacuugcacaggugacugcccagaaagauguggcugcacaucaucaacaugucugcacaaagaauggccccacucaagaaauuggagaugcaaucccacuuggugcugggguguagggacuggcugcaccugcuguggauuagaugugaaagaccuuuuuacagauuauauguuugucaaguggaaaguugaauacaucaagacagaggccauaguguguguagaacucaccagucaggaaaggcaguguagcuugauugaagcaggcacaagguucaauuuagguccugugaccaucacacugucagaaccaagaaacauccaacagaagcucccuccugaaauaaucacacuacauccuaggauugaagaagguuuuuuugaccugaugcacguucagaaaguguuaucagcaagcacaguguguaaguugcagaguugcacacaugguguaccaggagaccuacaggucuaccacaucggaaauuuauuaaaaggggacaagguaaauggacaucuaauucauaaaauugagccacacuucaacacuuccuggauguccugggaugguugugaccuagacuacuacugcaacaugggagauuggccuucuugcacauacacaggagucacccaacacaaucaugcuucauuuguaaaccugcucaacauugaaacugauuacacaaaaaacuuccacuuucacucuaaaagggucacugcacacggagacacaccacaacuggaucuuaaggcaagaccaaccuauggugcaggugagauuacuguacugguagaaguugcugacauggaguuacacacaaagaagauugaaauaucaggcuuaaaauuugcaagcuugacuugcacagguuguuaugccuguagcucuggcaucucaugcaaaguuagaauucauguagacgaaccagaugaacuuacagugcauguuaaaagugaugauccagauguaguugcagcuagcucaagccucauggcaagaaagcuugaauuuggaacagacaguacauuuaaagcuuuuucagccaugccuaaaacuucgcuauguuucuacauuguugaaaaagaauacugcaagagcugcagugaagaagacacaaaaaaauguguuaacacaaaacuugagcaaccacagagcauuuugaucgaacacaagggaacuauaaucggaaagcaaaacagcacuugcacagccaaggugaguugcugguuagagucagccaagaguuuuuuuuauggucuaaaggacaugcuuaguggcauuuuuggcaaugucuuuauagguauuuucuuauuccuugcccccuucguccuguuagugcuguucuuuauguuuggguggaggauccuacuuugcuuuagauguuguagaagaacuagaggccuguucaaguauagacaccucaaggacgaugaagaaacugguuauagaaggauuauugaaagacuaaacaauaaaaagggaaaaaacaaacugcuugauggugaaagacuugcugauagaaaaauugcugaacuguucuccacaaaaacacacauuggu

SEQ ID NO: 3800 - RNA, 3495 nt, Artificial Sequence
  derived and/or modified CDS sequence (wt) from CCHVF(CCHVF NIV161064)__KY213713.1__Gn-NSm-Gc
uccgaagaaucuggugaugacugcauaucaagaacucagcuauugaggacagagacugcagagguccauggcgauaacuauggugguccaggugauaagauaaccaucuguaaugguucaacuguuguagaucaaagacuggguagugaacugggguguuacacuaucaauagagugaggucauucaagcuaugcgaaaacagugccacagggaagagcugugaaauagacaguaucccagucaaguguaagcaggguuauugccuaaaaaucacucaggaaggaaggggccaugugaaguuaucuagaggcucagaaguugucuuggauguaugugauucaagcugugaagugaugauaccuaagggcacuggugacauucuaguagauuguucaggugggcagcaacauuuuuuaaaagacaaccugguugaccuagggugucccaaaauuccguuacugggcaaaauggcuauuuauaucugcaggaugucgaaucaccccaagacaaccauggccuuccucuuuugguucagcuuuggcuaugugauaacuuguauacuuugcaaggccauuuuuuucuuauuaauaauuuuuggaacacuagggaaaagguucaagcaguacagagaguuaaaaccccagaccugcaccauaugugagacaacaccuguaaaugcaauagaugcugaaaugcaugaucucaacugcaguuacaauauaugucccuauugugcgucuagacugacuucagaugggcuugcuaggcaugugacacaauguccuagacggaaggagaaaguggaggaaaccgaauuauaccugaauuuagagagaauucccuggguuguaagaaagcuauugcaggugucagaguccacugguacaguauuaaaaaggagcagcuggcuaauuguauuacuugugcuguucacaguuucauugucaccaguucaaucagcacccauuggucacgggaaaacaauugaaacauaccggguuagggaagaauacacaaguauuugccucuuuguacuaggaaguauccuguuuauagucucuuuucuaaugaaaggacugguugacgguguuggcaacaucuucuuuccugggcuguccgucuguaagacaugcucuauagguagcauuaauggcuuugagauugagucccauaagugcuacuguagcuuguuuuguugcccuuacuguaggcacugcucugcugauggagaaauccaucagcugcacuugagcaucugcaaaaaaaggaagacaggaaguaaugucaugcuggcuguuugcaaacgcauguguuucagggcaacuauggaaguaagcaacaaggcccuauuuauccguagcauuaucaacaccacuuuuguugugugcauacugauacuagcgguuuguguuguuagcaccucagcaguagagauggaaagccuaccagcugggaccugggaaagagaagaagaccuaacaaauuucugccaucaggaaugccaggucacagagacugagugccucugcccuuaugaagcuuuagugcucagaaggccccuauuucuagauaguauagucaaagguaugaaaaaucugcuaaacucaacaagucuagaaacaagcuuaucaauugaggcaccauggggagcaauuaauguucagucaaccuacaaaccaacuguaucaacugcaaacauagcacuuaguuggagcucaguggaacacagaggcaauaagguuuuggucucaggcagaucagaaucaauuaugaagcuggaagaaaggacaggaaucagcugggaucuuggcguggaagaugccucugagucuaagcuacuuacaguuucagucauggacuugucucagauguacucuccugucuucgaguacuuaucaggugacagacaaguggaagaguggccuaaagcaaccugcacaggugacugcccagaaagauguggcugcacaucaucaaccugcuuacacaaagaguggccccacucaaggaauuggagauguaauccuacuugguguugggguguagggacuggcugcaccuguugugguuuagaugugaaagaccuuuucacagauuacauguucgucaaguggaaaguugaguacauuaagacagaggccauaguauguguagaacuaaccagucaggaaagacaguguagcuugauugaggcgggcacaagauucaauuuagguucugugacuauuacauugucagaaccaaggaacauucaacaaaagcucccuccugaaauaaucacacugcaccccaagauugaggaagguuuuuuugaccuaaugcauguacaaaaagugcuaucggcaagcacaguguguaaguugcagaguugcacacauggugugccaggagaucugcaggucuaccacaucggaaaccuauuaaaaggggacagaguaaacggacaccugauucauaaaauugagcaacacuucaacacauccuggaugucuugggaugguugugaccuagacuacuacuguaacaugggagacuggccuuccugcacauauaccggagucacucagcauaaccaugcuucauuuguaaaccugcucaacauugaaacugauuauacaaaaaccuuucacuuucacucuaaaaggguuacugcacauggagacacaccacagcuagaucugaaggcaaggccaaccuauggugcaggugaggucaccgugcugguggaaguugcugacauggaguuacacacaaagaagauugaaauaucaggcuuaaaauuugcaggccuaacuugcacagguuguuaugcuuguaguucuggcaucucuuguaaaguuagaauucauguagaugaaccagaugaacuuacaguacauguuaaaagugaugacccagauguaguugcagcuagcucaagucucauggcgaggaagcuugaguuuggaacagacaguacauuuaaagcuuucucagccaugccuaaaaccucccuauguuucuacauuguggaaagagaauacuguaagagcugcaguaaagaagauacacaaaaauguguuaacacgaaacucgaacaaccacagagcauuuugaucgaacauaagggaacuauaauuggaaagcaaaacaauacuugcacggcuaaagcgaguugcugguuagagucaguuaagaguuuuuuuuauggucugaagaauaugcucgguggcauauuuggcaauguuuuuauaggcauuuucacauuucuuacccccuuuaucuuguuaauacucuucuuuauguuuggguggaggauccuguuuugcuucaaguguugcagaagaaccagaggccuauucaaguacagacaccucaaagacgaugaagaaacugguuacagaaagaucauugaaagacugaacaacaaaaagggaaaaaacaggcugcuugauggugaaagacuugcugacagaaagauugcugaacuguucuccacaaaaacacacauuggc

SEQ ID NO: 3801 - RNA, 3495 nt, Artificial Sequence
  derived and/or modified CDS sequence (wt) from CCHVF(CCHVF 5180-R-2011)__KR814874.1__Gn-NSm-Gc
uccgaggagccaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauaccaucaacagggugaagucauucaagcuaugcgaaaacagcgccacagggaaaaccugugagauagacagcacuccgguuaagugcaggcaagguuuuuguuuaaaaaucacccaagagggaaggggccacguaaaauuaucuagaggcucagagguuguuuuggaugcuugcgacacaagcugcgaaguaaugauaccuaaaggcacuggagauauccugguggacuguucagguggacagcaacauuucuuaaaagacaauuuaauugaccuagggugcccccauaucccgcuauuggguaaaauggccauuuacaucugcagaaugucaaaucauccuagaacaacuauggcuuuucucuucugguucagcuuuggcuaugugaucaccuguauauuuugcaaggcucuuuuuuauucauugauaauuauugggacacuagggaaaaagaucaagcaauauagggaauugaaaccucaaacuuguaccauaugugagacagcuccugucaaugcaauagacgcugaaaugcaugaccuuaacugcaguuacaauauaugcccuuauugugcaucaagauugaccuccgaugggcuagcuaggcaugugccacaaugccccaagcggaaggaaaaaguugaggagacugagcuguacuugaaccuggaaagaauuccuuggauugucagaaagcuauugcaagugucagaguccacugguguggcauugaaacgaagcagcuggcugauuguacugcuuguguuacucacaguuucauugucaccgguucaaucagcaccuguuggucaugguaagacaaucgaaacauaucagaccagagaaggauucacaagugucugucucuuuauguuaggaagcauccuguuuuuagucucuugcuuggugaaggggcuaguugacagugucagugacagcuucuuccccggccugucugucuguaagacaugcucuauuggcaguauaaauggcuuugaaauugaaucgcauaaaugcuacuguagccuauuuugcugccccuacuguaggcacugcucugcugacagagaaauucaucaguuacacuugaguaucugcaaaaaaagaaaaauggguagcaaugucaugcuggcugucugcaaacgcaugugcuuuagggcaaccauagaagcaagcagaagagcccugcucauccgaagcauuauaaauaccacuuuuguaauaugcauuuuaacauugacaaucuguguuguuagcaccucugcaguagagauggaaaaccuuccaucaggcacuugggagagagaggaagaccugacaaauuucugucaucaggaaugccagguaaccgagacggagugccucuguccauacgaagcucuugugcucagaaaaccucuguucuuagacaguauaguuaaaggcaugaagaauuugcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguagaagaugccucugaauccaaauuacuuaccgucuccaucauggauuugucacaaauguauuccccuguuuuugaguacuugucaggagacagacagguugaagaauggcccaaagcaacuugcacaggugacugcccagaaaggugugguugcacaucaucaacuugcuugcauaaagaauggccucacucaagaaacuggagauguaaucccacuuggugcuggggaguaggaacuggcugcaccugcugcgggguggauguaaaagaccuuuuuacagaucacauguuugucaaauggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcaugugcaaaaaguguugucugcaaguacaguguguaaacugcagaguugcacacaugguauaccaggagaucuacaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaauaucgaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcauaccaagaaaguugagauaucaggcuuaaaauuugcaagucuggcuugcacggguugcuaugcuuguagcucuggcaucuccuguaaagucaggauucauguagaugagccagaugagcucacaguacauguaaagagcaaugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaaugauacuugcacagccaaggcaagcuguuggcuagagucagucaagaguuuuuuuuauggauugaaaaauaugcuugguaguguauuugguaacuuuuucauaggcauuuuguuauuccuugccccuuuuguccuguuggugcuuuucuuuauguucggauggaaaaucuuguuuugcuucaaauguugcaggaggaccagaggcuuacuuaaguauagacuccucaaagacgaugaggaaacaggcuacagaaggauuauugaaagacugaacaacaaaaaaggaaaaaacagacugcuugauggugaaagguuggcugauaggaaaauugcugagcuguucuccacaaaaacacacauuggu

SEQ ID NO: 3802 - RNA, 3495 nt, Artificial Sequence
  derived and/or modified CDS sequence (wt) from CCHVF(CCHVF 4574-ST-2008)__KR814870.1__Gn-NSm-Gc
uccgaagagucaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauaccaucaacagggugaagucauucaagcuaugcgaaaacagcgccacagggaaaaccugugagauagacagcacuccgguuaagugcaggcaagguuuuuguuuaaaaaucacccaagaaggaaggggccacguaaaauuaucuagaggcucagagguuguuuuggaugcuugcgacucaagcugcgaaguaaugauaccuaaaggcacuggagauaucuugguggacuguucagguggacagcaacauuucuuaaaagacaacuuaauugaccuagggugcccccauaucccgcuauuggguaaaauggccauuuacaucugcagaaugucaaaucauccuagaacaacuauggcuuuucucuucugguucagcuuuggcuaugugaucaccuguuuauuuugcaaggcucuuuuuuauucauugauaaucauugggacacuagggaaaaagaucaagcaauauagggaauugagaccucaaaccuguaccauaugugagacagcuccugucaaugcaauagaugcugaaaugcaugaccuuaacugcaguuacaauauauguccuuauugugcaucaagauugaccuccgaugggcuagcuaggcaugugccacaaugccccaagcggaaggaaaaaguugaggagacugagcuguacuugaaccuggaaagaauaccuuggauugucagaaagcuauugcaagugucagaguccacugguguggcauugaagcgaagcagcuggcugauuguacugcuuguguuacucacaguuucauugucaccgguucaaucagcaccuguuggucaugguaagacaaucgaaacauaucagaccagagaaggauucacaaguaucugucucuuuauguuaggaagcauccuguuuuuagucucuugcuuggugaaggggcugguugacagugucagugacagcuucuuccccggccugucugucuguaagacaugcuccauuggcaguauaaauggcuuugaaauugaaucgcauaaaugcuacuguagccuacuuugcugccccuacuguaggcacugcucugcugacagagaaauccaccaguuacacuugaguaucugcaaaaaaagaaaaacggguagcaaugucaugcuggcugucugcaaacgcaugugcuuuagggcaaccauagaagcaagcagaagagcccugcucauccgaagcauuauaaauaccacuuuuguaauaugcauuuuaacauuaacaaucuguguuguuagcaccucugcaguagagauggaaaaccuuccaucaggcacuugggagaaagaggaagaccugacaaauuucugucaucaggaaugccaggugaccgagacggagugccucuguccauacgaagcucuugugcucagaaaaccucuguucuuagacaguauaguuaaaggcaugaagaauuugcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguagaagaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcuggggaguaggaacuggcugcaccugcugcgggguggauguaaaagaccuuuuuacagaucacauguuugucaaguggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcauguacaaaaaguguugucugcaaguacaguguguaaacugcagaguugcacacaugguauaccaggagaucuacaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacauugaaacugauuacacgaaaaccuuccacuuccacucuaaaagaguuacagcacauggugacacaccacaauuagacuuaaaagcaaggccaaccuacggugcaggugagaucacugugcugguugagguugcugacauggaguugcauaccaagaaaguugagauaucaggccugaaauuugcaagucuggcuugcacggguugcuaugcuuguagcucuggcaucuccuguaaagucaggauucauguagaugagccagaugagcucacaguacauguaaagagcagugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaaugauacuugcacagccaaggcaagcuguuggcuagagucagucaagaguuuuuuuuauggauugaaaaauaugcuugguaguguauuuggcaacuuuuucauaggcauuuuguuauuccuugccccuuuuguccuguuggugcuuuucuuuauguuuggauggaaaaucuuguuuugcuucaaauguugcaggagggccagaggcuugcuuaaguauagacaccuaaaagacgaugaggaaacaggcuacagaaagauuauugaaaggcugaacaacaaaaaaggaaaaaacagacugcuugauggugaaagguuggcugauaggaaaauugcugagcuguucuccacaaaaacacacauuggu

SEQ ID NO: 3803 - RNA, 3495 nt, Artificial Sequence
  derived and/or modified CDS sequence (wt) from CCHVF(CCHVF 3010)__DQ019222.1__Gn-NSm-Gc
gcagaaggagugagcaaugacuguguuucaaggacccagcuaaucaaaacagaaguugcagagauucaugaagauaguuauggugggccuggagaaaaaauaacaaucugcaacggcuccacaaucguggaccaaagacucgguagcgaacuaggcugcuacacaaucaaccgugugaagacuuauaagcuuugugagaauagugcuacagagaaggguugugagaucgauagugucccagucaaaugcaaacaaggguucugccucaaaguaacccaagagggcaggggccauguaaaacuguccagaggaacggaaauuguccuagauguaugugacaccaguugugaguugaugauacccaaaggcacuggggacauauugguggacugcucaggaggacagcagcacuuuuugcaggauaacuugauugacuuagguuguccaaauguaccauuauuaggcaagauggcaauauauaucugcaggaugucaaaucauccuaaaacuaccauggcuuuuuuguucugguuuagcuuuggcuaugucaucacaugcauaguauguaaagugcuuuucuaucugcuaauugucaucgggacacuaaguaagaaacuuaaacaguauagggaauuaaaaccucaaacaugcauugucugugaaucaaccccuguuaaugcaauagaugcugaaaugcacgagcucaauuguaauuacaacauaugcccauacugcgcguccagacuaacuucagauggacuagucagacaugugaaucaaugucccaaaaggaaagaaaaggucgaggagacugaacuauacuugaaccuggagaggauaccuuggcuaguaaggaggcuacuacaagugucagagucaacggggauggcucuaaagagaaguugcuggaugaccacacuccucauucugcuaguaguuucauuaucgccaguucaaucugcuccaguuggucaggggaaagcagucgaagucuaccgggugagagaaagcuacacaagcauaugccucuuuguauuaggaaguguucucuuugcgguauccuggcugauaaaggguuugauugacgguaucggcaacaguuuuuucccugggcuuucugucugcaaaacaugcucuauuggcagcauaaauggguucgagauagagucucacaaaugcuauuguagucuguuuuguuguccuuauugcagagcuugcucaucugacaaaaucacucaccgaaugcauuugaacgucugcaagaaaaggaaagcggguagcaauguuaugcuggcugucuguaagcguaugugcuuuaaggcaacuguugaagcaagcaacacagccuugcucaucagggguaucauaaauuccacuuuugugauaugcguacugauccugguuaucugugugguaagcacaucugcuguugacauggagaaucuaccagcaggaaucugggagagagaagaagaccuuacaaacuuuugccaccaagaaugucaaguaacagaaacugagugucuuugcccguaugaagccuuaauucucagaaagccucuuuaccuagacagcauagccaaggggaugaaaagucugcuaaauucuacgaauuuagagacaagccugucgauugaggccccguggggagcaaucaauguucagucaacuuuuaaaccaacaguuucagcugccaauauagcacuuagcuggaguucaguugaacacagaggcaacaaaauccuaguuucgggcaggucagagucaauuaugaagcuggaagaaaggaccgguaucagcuggagccuagguguagaggaugcuucugagucaaagacgcugacuguuucugucauggaccuaucccaaauguauucucccgucuuugaguaucugucaggugauagacagguagaagaguggccaaaagccaccugcacaggcgacugccaagagagauguggcugcacuucuucaaccugcuugcauaaagaauggccacacucgagaaacuggcgaugcaaccccacuugguguuggggaguggggacuggcugcaccugcuguggauuggaugugagagaccuuuucacggacuacaugaugguuaaguggaaaguggaauauguaaaaacagaagcuauaauguguguugagcuaaccagucaggagaggcaauguaguuugauugaagcagguacaagauuuaaccuaggcccugugacaauaacccugucagagccaagaaacauccagcaaaggcucccuuccgaaaucguuacacugcacccuaagauagaagaaggguucuuugacuugaugcaugugcaaaagguacuaucugcaaguacagucugcaaacuacagagcugcacacacggugucccuggcgaucuacaggucuaccauguuggcaaccuacugaaaggagauaaggucaaugggcacucaauccacaagauagagucccauuucaacacuucauggaugucaugggauggaugugaucuagacuacuucugcaacaugggugacuggcccucauguacauacacuggagugacacagcacaaccgugcggcauucaucaauaugcucaauauugagacugauuauacaaagacuuuccacuuccauuccaagagaguaacggcacauggugacaccccucaacuggaucugaaggcaaggccuacauauggugcaggcgaagucacuguucuaguagagguugcagaucuggagcuacacaccaagaaaauugaagugucaggacugaaguuugcaagucugaccugcuccgguuguuacgccugcagcuccgguaucuccugcaaaguuagaauucaugugaaugaaccagaugaauuuacuguacaugugaaaagcagugauccagauguuguggcagcaggaucaaguuugauggcaaggaaaauagaguuuggggcugacagcaccuucaaagcuuucucaucaaugccuaaaaacucuuugugcuucuauauaguggaaagagacuacugcagcagcugcaccaaugaugacacucagaaguguguugacacaaagcucgaacauccacaaagcauauuaauugagcauaagggaacaauaauuggcaaacaaaacgacaccuguucgaccaaaacaagcuguuggcuagaaucagucaagaguuuuuuuuauggacuaaaaaacaugcuggguggcaucuucgguaaugucuucuuaggcaucuuccuguuccuugcuccuuuugcacugcuaauauucuucuucuucuucggguggaggcuucuguucugucugaaguguugcagaagaaccagggggcugcuaaaguauaaacaacuuaaggacgaagaagaagccggguacaagaaaaucaucgagaggcuaaaugacaaaaaaggcaaaagucgacuguuugacggagagaggcuugcagauaggaagauugcagaacucuuuucaaccaaaacucauauaggg

SEQ ID NO: 3804 - RNA, 3495 nt, Artificial Sequence
  derived and/or modified CDS sequence (wt) from CCHVF(CCHVF UG3010)__DQ211637.1__Gn-NSm-Gc
gcagaaggagugagcaaugacuguguuucaaggacccagcuaaucaaaacagaaguugcagagauucaugaagauaguuauggugggccuggagaaaaaauaacaaucugcaacggcuccacaaucguggaccaaagacucgguagcgaacuaggcugcuacacaaucaaccgugugaagacuuauaagcuuugugagaauagugcuacagagaaggguugugagaucgauagugucccagucaaaugcaaacaaggguucugccucaaaguaacccaagagggcaggggccauguaaaacuguccagaggaacggaaauuguccuagauguaugugacaccaguugugaguugaugauacccaaaggcacuggggacauauugguggacugcucaggaggacagcagcacuuuuugcaggauaacuugauugacuuagguuguccaaauguaccauuauuaggcaagauggcaauauauaucugcaggaugucaaaucauccuaaaacuaccauggcuuuuuuguucugguuuagcuuuggcuaugucaucacaugcauaguauguaaagugcuuuucuaucugcuaauugucaucgggacacuaaguaagaaacuuaaacaguauagggaauuaaaaccucaaacaugcauugucugugaaucaaccccuguuaaugcaauagaugcugaaaugcacgagcucaauuguaauuacaacauaugcccauacugcgcguccagacuaacuucagauggacuagucagacaugugaaucaaugucccaaaaggaaagaaaaggucgaggagacugaacuauacuugaaccuggagaggauaccuuggcuaguaaggaggcuacuacaagugucagagucaacggggauggcucuaaagagaaguugcuggaugaccacacuccucauucugcuaguaguuucauuaucgccaguucaaucugcuccaguuggucaggggaaagcagucgaagucuaccgggugagagaaagcuacacaagcauaugccucuuuguauuaggaaguguucucuuugcgguauccuggcugauaaaggguuugauugacgguaucggcaacaguuuuuucccugggcuuucugucugcaaaacaugcucuauuggcagcauaaauggguucgagauagagucucacaaaugcuauuguagucuguuuuguuguccuuauugcagagcuugcucaucugacaaaaucacucaccgaaugcauuugaacgucugcaagaaaaggaaagcggguagcaauguuaugcuggcugucuguaagcguaugugcuuuaaggcaacuguugaagcaagcaacacagccuugcucaucagggguaucauaaauuccacuuuugugauaugcguacugauccugguuaucugugugguaagcacaucugcuguugacauggagaaucuaccagcaggaaucugggagagagaagaagaccuuacaaacuuuugccaccaagaaugucaaguaacagaaacugagugucuuugcccguaugaagccuuaauucucagaaagccucuuuaccuagacagcauagccaaggggaugaaaagucugcuaaauucuacgaauuuagagacaagccugucgauugaggccccguggggagcaaucaauguucagucaacuuuuaaaccaacaguuucagcugccaauauagcacuuagcuggaguucaguugaacacaggggcaacaaaauccuaguuucgggcaggucagagucaauuaugaagcuggaagaaaggaccgguaucagcuggagccuagguguagaggaugcuucugagucaaagacgcugacuguuucugucauggaccuaucccaaauguauucucccgucuuugaguaucugucaggugauagacagguagaagaguggccaaaagccaccugcacaggcgacugccaagagagauguggcugcacuucuucaaccugcuugcauaaagaauggccacacucgagaaacuggcgaugcaaccccacuugguguuggggaguggggacuggcugcaccugcuguggauuggaugugagagaccuuuucacggacuacaugaugguuaaguggaaaguggaauauguaaaaacagaagcuauaauguguguugagcuaaccagucaggagaggcaauguaguuugauugaagcagguacaagauuuaaccuaggcccugugacaauaacccugucagagccaagaaacauccagcaaaggcucccuuccgaaaucguuacacugcacccuaagauagaagaaggguucuuugacuugaugcaugugcaaaagguacuaucugcaaguacagucugcaaacuacagagcugcacacacggugucccuggcgaucuacaggucuaccauguuggcaaccuacugaaaggagauaaggucaaugggcacucaauccacaagauagagucccauuucaacacuucauggaugucaugggauggaugugaucuagacuacuucugcaacaugggugacuggcccucauguacauacacuggagugacacagcacaaccgugcggcauucaucaauaugcucaauauugagacugauuauacaaagacuuuccacuuccauuccaagagaguaacggcacauggugacaccccucaacuggaucugaaggcaaggccuacauauggugcaggcgaagucacuguucuaguagagguugcagaucuggagcuacacaccaagaaaauugaagugucaggacugaaguuugcaagucugaccugcuccgguuguuacgccugcagcuccgguaucuccugcaaaguuagaauucaugugaaugaaccagaugaauuuacuguacaugugaaaagcagugauccagauguuguggcagcaggaucaaguuugauggcaaggaaaauagaguuuggggcugacagcaccuucaaagcuuucucaucaaugccuaaaaacucuuugugcuucuauauaguggaaagagacuacugcagcagcugcaccaaugaugacacucagaaguguguugacacaaagcucgaacauccacaaagcauauuaauugagcauaagggaacaauaauuggcaaacaaaacgacaccuguucgaccaaaacaagcuguuggcuagaaucagucaagaguuuuuuuuauggacuaaaaaacaugcuggguggcaucuucgguaaugucuucuuaggcaucuuccuguuccuugcuccuuuugcacugcuaauauucuucuucuucuucggguggaggcuucuguucugucugaaguguugcagaagaaccagggggcugcuaaaguauaaacaacuuaaggacgaagaagaagccggguacaagaaaaucaucgagaggcuaaaugacaaaaaaggcaaaagucgacuguuugacggagagaggcuugcagauaggaagauugcagaacucuuuucaaccaaaacucauauaggg

SEQ ID NO: 3805 - RNA, 2916 nt, Artificial Sequence
  derived and/or modified CDS sequence (wt) from CCHFV(10200, Artificial)__U39455.2__Gn-4aa-Gc
ucagaagaacccagugaugacuguguaucaagaacucaacuauuaaggacagagacugcagagauccacggcgacaacuaugguggcccgggugacaaaauaaccaucugcaauggcucaacuauuguagaccaaagacugggcagugaacuaggaugcuacaccaucaauagagugaggucauucaagcuaugcgaaaacagugccacagggaagaauugugaaauagacagugucccaguuaaaugcaggcaggguuauugccuaagaaucacucaggaagggaggggccacguaaaauuaucuaggggcucagagguugucuuagaugcaugcgauacaagcugugaaauaaugauaccuaagggcacuggugacauccuaguugacuguucaggugggcagcaacauuuucuaaaggacaauuugauagaucuaggaugccccaaaauuccauuauugggcaaaauggcuauuuacauuugcagaaugucaaaccaccccaaaacaaccauggcuuuccucuucugguucagcuuuggcuauguaauaaccugcauacuuugcaaggcuauuuuuuacuuguuaauaauuguuggaacacuagggagaaggcucaagcaguauagagaguugaaaccucagacuugcaccauaugugagacaacuccuguaaaugcaauagaugcugagaugcaugaccucaauugcaguuacaacauuugucccuacugugcaucuagacuaaccucagaugggcuugcuaggcaugugauacaaugcccuaagcggaaggagaaaguggaagaaacugaacuguacuugaacuuagaaagaauuccuuggguuguaagaaagcuguugcaggugucagagucaacugguguggcauugaaaagaagcaguuggcugauugugcugcuugugcuauucacuguuucauuaucaccaguucaaucagcacccauugguagaaagccuuuauuccuagauaguacagcuaaaggcaugaaaaaucugcuaaauucaacaaguuuagaaacgaguuuaucaauugaggcaccauggggagcaauaaauguucagucaaccuacaaaccaacugugucaacugcaaacauagcacucaguuggagcucaguggaacacagaggcaauaagaucuugguuucaggcagaucagaaucaauuaugaagcuggaagaaaggacaggaaucagcugggaucucgguguagaagaugccucugaaucuaaacugcuuacaguaucugucauggacuugucucagauguacucuccugucuucgaguacuuaucaggggacagacagguggaagaguggcccaaagcaacuugcacaggugacugcccagaaagauguggcugcacaucaucaaccuguuugcacaaagaauggccucacucaagaaauuggagaugcaaucccacuuggugcugggguguagggacuggcugcaccuguuguggauuagaugugaaagaccuuuuuacagauuauauguuugucaaguggaaaguugaauacaucaagacagaggccauaguguguguagaacuuacuagucaggaaaggcaguguagcuugauugaagcgggcacaagguucaauuuagguccugugaccaucacacugucagaaccaagaaacauccaacaaaaacucccuccugaaauaaucacacugcauccuaggaucgaagaagguuuuuuugaccugaugcaugugcaaaagguguuaucggcaagcacaguguguaaguugcagaguugcacacauggugugccaggagaccuacaggucuaccacaucggaaauuuauuaaaaggggauaagguaaauggacaucuaauucauaaaauugagccacacuucaacaccuccuggauguccugggaugguugugaccuagacuacuacugcaacaugggagauuggccuucuugcacauacacaggggucacccaacacaaucaugcuucauuuguaaacuuacucaacauugaaacugauuacacaaagaacuuccacuuucacucuaaaagggucacugcacacggagauacaccacaacuagaucuuaaggcaagaccaaccuauggugcaggcgagaucacuguucugguagaaguugcugacauggaguuacauacaaagaagauugaaauaucaggcuuaaaauuugcaagcuuagcuugcacagguuguuaugcuuguagcucuagcaucucaugcaaaguuagaauucauguggaugaaccagaugaacuuacaguacauguuaaaagugaugauccagaugugguugcagcuagcucaagucucauggcaaggaagcuugaauuuggaacagacaguacauuuaaagcuuucucggccaugccuaaaacuucucuauguuucuacauuguugaaagagaacacuguaagagcugcagugaagaagacacaaaaaaauguguuaacacaaaacuugagcaaccacaaagcauuuugaucgaacacaagggaacuauaaucggaaagcaaaacagcacuugcacggcuaaggcaaguugcugguuagagucagucaagaguuuuuuuuauggccuaaagaacaugcuuaguggcauuuuuggcaaugucuuuaugggcauuuucuuguuccuugcccccuucauccuguuaauacuauucuuuauguuuggguggaggauccuauucugcuuuaaauguuguagaagaaccagaggccuguucaaguauagacaccucaaagacgaugaagaaacugguuauagaaggauuauugaaaaacuaaacaauaaaaaaggaaaaaacaaacugcuugauggugaaagacuugcugauggaagaauugccgaacuguucucuacaaaaacacacauuggc

SEQ ID NO: 3806 - RNA, 2916 nt, Artificial Sequence
  derived and/or modified CDS sequence (wt) from CCHFV(IbAr10200, Artificial)__AF467768.2__Gn-4aa-Gc
ucagaagaacccagugaugacuguauaucaagaacucaacuauuaaggacagagacugcagagauccacggcgacaacuaugguggcccgggugacaaaauaaccaucugcaauggcucaacuauuguagaccaaagacugggcagugaacuaggaugcuacaccaucaauagagugaggucauucaagcuaugcgaaaacagugccacagggaagaauugugaaauagacagugucccaguuaaaugcaggcaggguuauugccuaagaaucacucaggaagggaggggccacguaaaauuaucuaggggcucagagguugucuuagaugcaugcgauacaagcugugaaauaaugauaccuaagggcacuggugacauccuaguugacuguucaggugggcagcaacauuuucuaaaggacaauuugauagaucuaggaugccccaaaauuccauuauugggcaaaauggcuauuuacauuugcagaaugucaaaccaccccaaaacaaccauggcuuuccucuucugguucagcuuuggcuauguaauaaccugcauacuuugcaaggccauuuuuuacuuguuaauaauuguuggaacacuagggaaaaggcucaagcaguauagagaguugaaaccucagacuugcaccauaugugagacaacuccuguaaaugcaauagaugcugagaugcaugaccucaauugcaguuacaacauuugucccuacugugcaucuagacuaaccucagaugggcuugcuaggcaugugauacaaugcccuaagcggaaggagaaaguggaagaaacugaacuguacuugaacuuagaaagaauuccuuggguuguaagaaagcuguugcaggugucagagucaacugguguggcauugaaaagaagcaguuggcugauugugcugcuugugcuauucacuguuucauuaucaccaguucaaucagcacccauugguagaaagccuuuauuccuagauaguacagcuaaaggcaugaaaaaucugcuaaauucaacaaguuuagaaacgaguuuaucaauugaggcaccauggggagcaauaaauguucagucaaccuacaaaccaacugugucaacugcaaacauagcacucaguuggagcucaguggaacacagaggcaauaagaucuugguuucaggcagaucagaaucaauuaugaagcuggaagaaaggacaggaaucagcugggaucucgguguagaagaugccucugaaucuaaacugcuuacaguaucugucauggacuugucucagauguacucuccugucuucgaguacuuaucaggggacagacaggugggagaguggcccaaagcaacuugcacaggugacugcccagaaagauguggcugcacaucaucaaccuguuugcacaaagaauggccucacucaagaaauuggagaugcaaucccacuuggugcugggguguagggacuggcugcaccuguuguggauuagaugugaaagaccuuuuuacagauuauauguuugucaaguggaaaguugaauacaucaagacagaggccauaguguguguagaacuuacuagucaggaaaggcaguguagcuugauugaagcgggcacaagguucaauuuagguccugugaccaucacacugucagaaccaagaaacauccaacaaaaacucccuccugaaauaaucacacugcauccuaggaucgaagaagguuuuuuugaccugaugcaugugcaaaagguguuaucggcaagcacaguguguaaguugcagaguugcacacauggugugccaggagaccuacaggucuaccacaucggaaauuuauuaaaaggggauaagguaaauggacaucuaauucauaaaauugagccacacuucaacaccuccuggauguccugggaugguugugaccuagacuacuacugcaacaugggagauuggccuucuugcacauacacaggggucacccaacacaaucaugcuucauuuguaaacuuacucaacauugaaacugauuacacaaagaacuuccacuuucacucuaaaagggucacugcacacggagauacaccacaacuagaucuuaaggcaagaccaaccuauggugcaggcgagaucacuguucugguagaaguugcugacauggaguuacauacaaagaagauugaaauaucaggcuuaaaauuugcaagcuuagcuugcacagguuguuaugcuuguagcucuggcaucucaugcaaaguuagaauucauguggaugaaccagaugaacuuacaguacauguuaaaagugaugauccagaugugguugcagcuagcucaagucucauggcaaggaagcuugaauuuggaacagacaguacauuuaaagcuuucucggccaugccuaaaacuucucuauguuucuacauuguugaaagagaacacuguaagagcugcagugaagaagacacaaaaaaauguguuaacacaaaacuugagcaaccacaaagcauuuugaucgaacacaagggaacuauaaucggaaagcaaaacagcacuugcacggcuaaggcaaguugcugguuagagucagucaagaguuuuuuuuauggccuaaagaacaugcuuaguggcauuuuuggcaaugucuuuaugggcauuuucuuguuccuugcccccuucauccuguuaauacuauucuuuauguuuggguggaggauccuauucugcuuuaaauguuguagaagaaccagaggccuguucaaguauagacaccucaaagacgaugaagaaacugguuauagaaggauuauugaaaaacuaaacaauaaaaaaggaaaaaacaaacugcuugauggugaaagacuugcugauagaagaauugccgaacuguucucuacaaaaacacacauuggc

SEQ ID NO: 3807 - RNA, 2916 nt, Artificial Sequence
  derived and/or modified CDS sequence (wt) from CCHFV(Turkey-Kelkit06, Artificial)__GQ337054.1__Gn-4aa-Gc
uccgaagagccaggugaugacugcauaucaagaacucagcuauugaggacagaaacagcagagauccaugaugacaacuauggugguccaggugauaaaauaacuaucugcaacgguucaaccauuguagaucagagacugggcagugaacuaggguguuauaccaucaacagggugaagucauucaagcuaugcaaaaacagcgccacagggaaaaccugugagguagacagcacuccgguuaagugcaggcaagguuuuuguuuaaaaaucacccaagagggaaggggccacguaaaauuaucuagaggcucagagguuguccuggaugcuugcgacucaagcugugaaguaaugauaccuaaaggcacuggggauauccuaguggacuguucaggugggcagcaacauuucuuaaaagacaacuuaauugaccuagggugcccccauaucccgcuauuggguaggauggcuauuuacauuugcagaaugucaaaucauccuagaacaaccauggcuuuucucuucugguucagcuuuggcuauguuaucacuuguauauuuugcaaggcucuuuuuuauucauugauaauuauuggaacacuaggaaaaaagaucaagcaauauagggaacugaaaccucaaaccugcaccauaugugagacagcuccugucaaugcaauagaugcugaaaugcaugaccucaacuguaguuacaauauaugcccuuauugugcaucaagauugaccuccgaugggcuagccaggcauguaacgcaaugccccaagcggaaagagaaaguugaggagacugaacuguaccugaaccuggaaagaauuccuuggauugucagaaagcuauugcaggugucagaguccacugguguggcauugaaacgaagcagcuggcugauuguacugcuuguguuacugacaguuucguugucgccgguucagucagcaccuguugguagaaaaccucuuuucuuggacaguauaguuaaagguaugaaaaauuugcuaaacucaacaagcuuggaaacaagcuuaucaauugaggcaccauggggagcaauaaauguccaaucaaccuuuaaaccaacuguaucgacugcaaacauagcacucaguuggagcucaguggugcacagaggcaacaagaucuuggucacaggcaggucugaaucaauuaugaaacuggaggaaaggacaggagucagcugggaucuaggcguagaagaugccucugaauccaaauuacuuaccguuucuaucauggauuugucacaaauguauucuccuguuuuugaguacuugucaggagacagacagguugaagaauggcccaaagcaacuuguacaggugauugcccggaaaggugugguugcacaucaucaaccugcuuacauaaagaauggucucacucaagaaacuggagauguaaucccacuuggugcuggggaguaggaaccggcugcaccugcugcgggguggauguaaaagaucuuuuuaccgaucacauguuugucaaauggaaaguugaauacauaaaaacugaagcuauaguauguguugcgcucaccagccaagaaagacagugcagucugauugaggcagguacuagauucaacuugggcccugugacuauuacccugucugagccaagaaacauucagcagaagcuuccuccugagauuaucacguugcaucccaaaauugaagaaggcuucuuugacuugaugcauguacaaaaaguguugucugcaaguacaguguguaaacugcagaguugcacacaugguauaccaggagaucuacaaguuuaccacauuggcaacuuguugaaaggggauagaguaaacgggcaucuaauucacaaaauugaaucacauuucaacaccucuuggauguccugggaugguugugacuuagacuacuacugcaacaugggggauuggccaucuugcacauacacaggagugacccagcauaaccaugcugcauuuguaaacuugcuuaacauugaaacugauuacacgaaaaccuuccacuuccacucuaaaagagucacagcacauggugacacaccacaauuggacuuaaaagcaaggccgaccuacggugcaggugggaucacugugcugguugagguugcugacauggaguugcauaccaagaaaguugaaauaucaggcuugaaauuugcaagucuggcuugcacggguugcuaugcuuguagcucuggcaucuccuguaaaguuaggauucauguagaugaaccagaugagcucacaguacauguaaagagcagugauccagaugugguugcagcuagcacaagucucauggcgaggaagcuugaauuugggacagacagcacauucaaggccuuuucagcuaugcccaaaaccucucuauguuuuuacauuguggagagagaauacugcaagagcugcagugaagaugauacacaaaaauguguugacacaagacuugagcagccacagagcauacuaauugagcacaaaggaacgauaauuggaaagcagaaugauacuugcacagccaaggcaagcuguuggcuagagucagucaagaguuuuuuuuauggauugaagaauaugcuuggcaguguuuuugguaaucuuuucauaggcauuuuguuauuccuugccccuuuuguccuguuggugcuuuucuuuauguuuggguggaaaaucuuguuuugcuuuaaauguugcaggaggaccagaggcuuauuuaaguauagacaccucaaagacgaugaggaaacaggcuacagaaggauuauugaaagacugaacagcaaaaaagggaaaaacaggcugcuugauggugauagacuggcugauaggaaaauugcugagcuguucuccacaaaaacacacauuggc

SEQ ID NO: 3808 - RNA, 2919 nt, Artificial Sequence
  derived and/or modified CDS sequence (wt) from CCHFV(SR3, Artificial)__AJ538199.1__Gn-4aa-Gc
uccgaagaaucuggugaugacugcauaucaagaacucagcuauugaggacagagacugcagagguccauggcgacaacuacggugguccaggugauaagauaaccaucuguaaugguucaacuguuguagaucaaagacuggguagugaacuaggguguuacacuaucaauagagugaggucauucaagcuaugcgaaaacagugccacagggaagagcugugaaauagacaguaucccagucaaguguaagcaggguuauugccuuaaaaucacucaggaaggaaggggccaugugaaguuaucuagaggcucagaaguugucuuggauguaugugauucaagcugugaagugaugauaccuaagggcacuggugacauucuaguagauuguucaggugggcagcaacauuuuuuaaaagacaaccugguugaccuagggugucccaaaauuccguuacugggcaaaauggcuauuuauaucugcaggaugucgaaucaccccaagacaaccauggccuuccucuuuugguucagcuuuggcuaugugauaacuuguauacuuugcaaggccauuuuuuucuuauuaauaauuuuuggaacacuagggaaaagguucaagcaguacagagaguugaaaccccagaccugcaccauaugugagacaacaccuguaaaugcaauagaugcugaaaugcaugaucucaacugcaguuacaauauaugucccuauugugcgucuagacugacuucagaugggcuugcuaggcauguaacacaauguccuagacggaaggagaaaguggaggaaaccgaauuauaccugaauuuagagagaauucccuggguuguaagaaagcuauugcaggugucagaguccacugguacaguauuaaaaaggagcagcuggcuaauuguauuacuugugcuguucacaguuucauugucaccaguucaaucagcacccauuggucucagaaggccccuauuucuagauaguauagucaaagguaugaaaaaucugcuaaacucaacaagucuagaaacaagcuuaucaauugaggcaccguggggagcaaucaauguucagucaaccuacaaaccaacugucucaacugcaaacauagcacuuaguuggagcucaguggaacacagaggcaauaagguuuuggucucaggcagaucagaaucaauuaugaagcuggaagaaaggacaggaaucagcugggaucuuggcguggaagaugccucugagucuaagcuacuuacaguuucaguuauggacuugucucagauguacucuccugucuucgaguacuuaucaggugacagacaaguggaagaguggccuaaagcaaccugcacaggugacugcccagaaagauguggcugcacaucaucaaccugcuuacacaaagaguggccccacucaaggaauuggagauguaauccuacuuggugcugggguguagggacuggcugcaccuguugugguuuagaugugaaagaccuuuucacagauuacauguucgucaaguggaaaguugaguacauuaagacagaggccauaguauguguagaacuaaccagucaggaaagacaguguagcuugauugaggcgggcacaagauucaauuuagguucugugacuauuacauugucagaaccaaggaacauucaacaaaagcucccuccugaaauaaucacacugcaccccaagauugaggaagguuuuuuugaccuaaugcauguacaaaaagugcuaucggcaagcacaguguguaaguugcagaguugcacacauggugugccaggagaucugcaggucuaccacaucggaaaccuauuaaaaggggacagaguaaacggacaccugauucauaaaauugagcaacacuucaacacauccuggaugucuugggaugguugugaccuagacuacuacuguaacaugggagacuggccuuccugcacauauaccggagucacucagcauaaccaugcuucauuuguaaaccugcucaacauugaaacugauuauacaaaaaccuuucacuuucacucuaaaaggguuacugcacauggagacacaccacaacuagaucugaaggcaaggccaaccuauggugcaggugagaucaccgugcugguggaaguugcugacauggaguuacacacaaagaagauugaaauaucaggcuuaaaauuugcaggccuaacuugcacagguuguuaugcuuguaguucuggcaucucuuguaaaguuagaauucauguagaugaaccagaugaacuuacaguacauguuaaaagugaugacccagauguaguugcagcuagcucaagucucauggcgaggaagcuugaauuuggaacagacaguacauuuaaagcuuucucagccaugccuaaaaccucccuauguuucuacauuguggaaagggaauacuguaaaagcugcaauaaagaagauacacaaaaauguguuaacacgaaacucgaacaaccacagagcauuuugaucgaacauaagggaacuauaauuggaaagcaaaacaauacuugcacggcuaaagcgaguugcugguuagagucaguuaagaguuucuuuuauggucugaagaauaugcucgguggcauauuuggcaauguuuuuauaggcauuuucacauuucuuacccccuuuaucuuguuaauacuuuucuuuauguuuggguggaggauccuguuuugcuucaaguguugcagaaggaccagaggccuauucaaguacagacaccucaaagacgaugaagaaacugguuacagaaagaucauugaaagacugaacaacaaaaaaggaaaaaacaggcugcuugauggugaaagacuugcugacagaaagauugcugaacuguucuccacaaaaacacacauuggc

SEQ ID NO: 3809 - RNA, 2919 nt, Artificial Sequence
  derived and/or modified CDS sequence (wt) from CCHFV(UCCR4413, Artificial)__KY484038.1__Gn-4aa-Gc
ucagaaagcagcgcuagugguugcauuucaaggacccagaugaucaagucagaaacagcagagauccacgacgacaucuacggaggaccuggugagaagcuuaccaucuguaaugguaccacuguuguagaucaaagacugggcagugaacuagguugcuacacaaucaacagaauuaagaccuauaaauugugugaaaacagugucaaagaaaaaacuugugagauugacaguguaccagucaaguguagacaggggcuuuguuugaagauaacucaagaaggaagaggccauguuaagcuuuccagaggcucagagauuguccuggacauuugugacucuaguugugaauugaugauaccuaaaggcacuggggacauauugguagauuguucuggaggacagcaacauuuuuuacaggauaaccugguugacuuagguugcccuaacaucccccuacuugggaaaguggcuaucuacauaugcagaaugucaaaucaccccaagacuaccauggcauuucucuucugguucaguuuugguuaugugaucacaugcauauugugcaaaauacucuuuuaccuacucauaaucacuggcacacuagggaaaaaacuaaagcaguauagagagcucaagccacaaacauguaccauaugugaaucaacaccugugaaugcaauagaugcugagaugcaugaccucaacuguaguuacaacauaugcccuuauugugcaucuagacugacuucagaugggcucauaaggcaugugaaucugugccccaagaggaaggagaaaguugaagagacagaacuguauuugaacuuagaaagaauaccuugguuugugagaaagcuuuuacaggugucugaaucuacaggaguagcucucaaaagaagcaguuggcuauugauacuuguuauauugcucacaguuucuaugucaccaguucagucggcaccaauuaauagaaaaccacucuuccugaguaguauagucaaggguaagaagaaucugcuaaacucagcaaguuuagaaacaagccugucaauugaggcaccauggggagccauaaaugcucaguccaccuuuaaacccaccauaucaacugcaaauauagcacucagcuggagcucaguggagcauagaggcaauaaaguuuugguuucagguagaucagagucuaucaugaaacucgaggagcgaacaggaaucaguuggaaccuagggguagaggacgcaucagagucaagaaugcuaacggucucugucauggacuugucacagauguacuuaccaguauuugaauaucugucuggugacaggcaaguggaagaguggccaaaagcaaccuguacaggugacuguccagaaagaugcggcugcacaucaucaaccugcuugcauaaagaauggccgcacucaagaaacuggagaugcaaucccacuugguguugggggguuggaacaggaugcacaugcugcggauuagacgugaaagaccuguucacugauuauauguuuguuaaguggaagguugaguauauuaagacugaagccauaguuuguguugaguuaaccagccaagagagacagugcagcuuaauugaggccggcacaagauucaacuuaggucccgugacaauaacauuaucagaaccaaggaacauccaacaaaagcucccuucagagauagucacacugcaucccaaaauagaagaaggcuucuuugaccucaugcaugugcaaaagguacuaucugcuagcacggugugcaagcugcagagcugcacgcacggaguggcgggagaccugcaggucuaucauguuggcaauuuauuaaaaggggacaaaauaaauggacauucgauucacaagauugaaccacaucucaacacaucauggaugucuugggauggcugugaucuagacuauuacugcaauaugggagauuggcccucuugcacauacacaggggugacacaacacaaucaugcagcauuugucaaccuacuaaacauugaaacugauuacaccaaaagcuuccacuuucacucaaaaagaguaacagcacauggagacacuccccaacuggaccugaaggcgcggcccauguauggugcaggcgaaauaacugucuugguggagguugcugacauggaauugcacucaaagaacauugagaucucaggucuaaaauuugcaagcuugaccugcucaggcuguuaugccugcagcucagguauuucaugcaaagucagaauccauguagacgagcccgaugagcuagcaguacauguaaagagugaugaucuggauguuguggcagcuaguucaagucuuauggcaagaaaaauagaauucggaacagauagcacauuuaaagcuuucucaucuaugccaaaagaaucuuuaugcuucuacauuguugaaagagacuucuguaaaaguugugcagcagaagacacacaaaaaugugugaaagcaaaacuugaacagccacaaagcauacuuauugaacacaaagggacaauaauugggaaacaaaaugacacuugcucaaccaaaacaagcuguugguuggagucauucaaaagcuucuuuuaugggcuaaaaaacaugcuaagcggcguuuuuggcagugcuauuaugggcauucucuuguuccuugcccccuuuaucuuguuaauacuuuucuucuuuuuuggauggagaaucuuauucugccuaagauguuguagaaggaccagagggcuguuuaaguacaagcauaucaaggaugaugaggaagcaggcuacaaaaaaaucauugagaagcuuaacaacaaaaaagggggaacaaguaaauuguuagauggugagagacuugcggacagaaagauugccgaacuuuucucaacaaaagcacacaucggc

SEQ ID NO: 3810 - RNA, 2916 nt, Artificial Sequence
  derived and/or modified CDS sequence (wt) from CCHFV(66019, Artificial)__AB069669.1__Gn-4aa-Gc
uccgaagagucuggugacgacugcauaucuagaacucagcuauugaggacagagacugcagagguccauggugacaacuauggugguccaggugacaaaauaacuaucuguaaugguucaaccauuguggaucaaagacuuggcagugaacugggguguuauacuaucaauagagugaagucauucaagcuaugcgaaaauaguggcacgggaaaauccuguaagauagauaacaccccaguuaagugcaggcaggguuuuugcuuaaaaauuacucaggaaggaaggggccaugugaagcuaucgagaggcucagaaguugucuuagaugccugcgacucaagcugugaaauaaugauaccgaagggcacaggagacauccuaguagacuguucaggugggcaacaacauuucuuaaaagauaacuugguugaucuaggaugcccuaacauuccacuauuagguaaaauggcuaucuacauuugcaggaugucaaaucacccuaaaacaacuauggcuuuucucuuuugguuuaguuucggcuauguaauaacauguauauuuuguaaaaucauuuuuuacuuguugauagucguggggacauuggggaaaaaguucaaacaguaccgggagcugaaaccucagacuuguacuauaugugaaacaacuccuaccaaugcaauagaugcugaaaugcacgaucuuaaaugcaguuacaauauaugcccuuauugugcaucuagauuaaccucggacgggcuugccaggcaugugacacaaugcccuaagcgaaaagagaaaguagaagagacugaacuguacuugaacuuggaaagaauuccuuggauugucagaaaacuacugcaagugucagagucuaccgguguggcacugaaaaggagcaguuggcuaauuguguuacuugugcuacuuacaguuucauugucaccgguucaaucagcacccauuggaaggaaaccccuauucucagacaguauagucaagggcaugaaaaaccugcuaaauucaacuagcuuggaaacaagcuuaucaauugaagcaccauggggagcaauaaacguccagucaaccuuuaaacccaccguuucaacugcaaacauagcacuuagcuggaguucaguagaacacagagguaacaaaauuuuggucucaggcagaucagaaucaauuaugaagcuagaagaaaggacaggaaucagcugggaucugggcguagaagaugccucugagucuaaguugcuuacuguuucugucauggauuugucacagauguauucuccugucuuugaguacuuaucaggugacagacagguagaggaguggcccaaagcaaccugcacagguaauugcccagauagguguggcugcacaucaucaaccugcuuacacaaggaauggccccauucaaggaauuggagaugcaaccccacuugguguuggggagucggcacuggaugcaccugcuguggacuagaugugaaagaucuuuuuacagauuauauguuugucaaguggaaaguugaauacauaaagaccgaggccauagugugcguugagcucaauagccaagaaaggcagugcagcuugauugaggcaggcacaagauucaacuuggguccugugaccaucacguugucagaaccaagaaacauucagcagaagcuuccuucugaaauaaucacauugcauccuagaauugaggaaggcuucuucgaucugaugcauguucaaaaggugcugucugcaaguacaguaugcaagcuacaaagcugcacacauggugugccaggagacuuacagaucuaccacauuggcaacuuguuaaaaggggauaggguaaaugggcaucugauucacaaaauugagccacacuucaacacuucuuggauguccugggauggcugugaccuagauuacuacuguaacaugggggauuggcccucuugcacauauacuggagugacccaacauaaccaugcugcuuuuguaaacuuacuuaacaucgaaacugauuacacaaagaacuuccauuuucauucuaagagaguuacugcacauggagacacaccacagcuggauuugaaagcuagaccaacuuacggugcgggugaaaucacuguacuaguggagguugcugacauggaguuacacacaaaaaagauugcgauaucaggucugaaauuugcaaguuugacuugcacagguugcuaugcuuguagcucuggcaucuccuguaaagucaggauucauguggaugaaccagaugagcuuacaguacaugugaaaagugaagauccggacauuguugcagccagcucaagccucauggcaaggaagcuugaauuugggacagacagcacauucaaggccuucucagccaugcccaaaaccuccuugugcuucuacauuguagagagagaauacugugagagcugcagcaaagaagacacacagaaauguguuaacacaaagcuugagcaaccacaaagcauuuuaauugagcacaaaggaacaauaaucggaaagcaaaaugacacuugcacagccaaagcaagcugcugguuagagucaguaaagaguuuuuuuuauggauugaagaacaugcuuagcggcaucuucggcaacguuuuuauaggcauuuucuuauuccuugcuccuuuuauucuguuaauacucuucuuuauguuuggguggagaauccuguuuugcuuuaaguguugcagaaggaccagaggcuuauucaaguacagauaucucaaggacgacgaagagucugguuacagaagaaucauugaaagauuaaacaacaaaaaaggaaaaaacaaguuacuugacggugaaagacuagcugacaggaggaucgcugaguuguucucuaccaaaacacacauuggu

SEQ ID NO: 3811 - RNA, 2916 nt, Artificial Sequence
  derived and/or modified CDS sequence (wt) from CCHFV(7001, Artificial)__AB069670.1__Gn-4aa-Gc
gcagaaggaggaagcagugacugcauuucaagaacucagcuaguuaaaacggagguugcagaaauucaugaggacaguuacggugggccuggugagaaaauaacaaucugcaaugguuccacaauuguagaucaaaggcuugguagugaauugggcuguuauacaaucaacagaguaagauccuacaagcuaugcgagaacagugccucagggaaaagcugugaaauagauagcaucccagucaaaugcaaacaaggguuuugccucaaaauaacccaagaaggaagaggucauguaaaacuguccagagggacagaaauuguucuagaugucugugauuccagcugugagcugaugauacccaagggcacuggagacauuuuaguggauugcucaggagggcaacagcauuuuuuacaaaacaaucugauugacuugggaugccccaaugucccauuacuggguaaaauggccauauaugucugcagaaugucaaaccacccaaaaacuaccauggcauuucuguucugguucagcuuuggcuaugucauuacauguauagcaugcaggguacucuucuacuugcugauugccaucggaacaguagggaaaaagcuaaaacaguauagagagcugaaaccacaaacaugcauugucugugaaucugucccuguuaaugcaauagaugcugaaaugcaugagcuuaauugcaguuacaauauaugcccauacugugcaucuagacugucuacagacgggcucaucaggcacguaacucagugucccaaacggagggagaagguggaagagacugagcuauucuugaacuuggaaagaauaccuuggcuggugagaaagcuccuucaaguaucagagucaacaggaauggcucuaaagagaagcuguuggaugaucacacuccucauucuacuauugguuucgauaucaccaguccaaucugcaccgguaggcaggaagccacucuuccuggauaacauagccaagggaaugaaaagccuguugaacuccacgagcuuagaaacuagucugucaauugaagcuccguggggagcaaucaauguccagucaacuuucaaaccaacaguuucagcugcuaacauagcacuuagcuggaguucaguugaacacaggggcaacaaaauuuuaguuucagguagaucagagucaaucaugaaauuagaagaaagaacaggagucagcuggaaucuggguguagaagaugcuucugagucaaagacgcuuacuguuuccgucauggaccugucacaaauguacucuccuguuuuugaguacuugucaggugacagacaaguggaggaauggccaaaggcaacuugcacaggugacuguccagagagaugcggcugcacuucgucaaccugcuuacauaaagaguggccacauucaagaaacuggcgauguaauccuaccugguguugggggguggggacuggcugcacuugcugugggcuggauguaaaggauuuuuuuacugacuacaugcugguaaaauggaaaguggaauauauaaagacagaagcuauagugugugucgagcugacuagucaagagaggcaguguaguuuaauugaagcaggcacaagauuuaaccuaggcccuguaacaauaacccuaucagagccaagaaauguccagcagaggcuuccucccgaaauuguaacacugcauccuaaaauagaggaagguuuuuuugauuugaugcauguacaaaaaauacugucugcaagcacaguuugcaagcuacagagcugcacacacggugugccgggcgauuuucaggucuaccaugucgguaaccugcugaggggagacaagguuaauggacacucaauucacaagauagaaccacauuuuaauacuucauggaugucaugggaugguugcgaucuggacuauuucugcaauaugggggacuggccuucaugcacauacacuggagugacacagcauaaccgugcugcauuuaucaacaugcucaacauugagacugacuauacaaaaacuuuccacuuucauucgaagagggucacggcacauggagauacuccccagcuagaccuaaaagcgagaccggcauauggugcuggcgaggucacuguucuaguggagguugcagacuuggaguugcacacaaagaaacuugaagugucagguuugaaaauugcaaguuugaccugcucuggguguuaugccugcagcucuggcaucuccugcaaaguuagaauccauguaaaugaaccagaugaauuuacaguacauguaagaaguagcgacccagauguuguagcagcaggaucaagucuuauggcaaggaaaauagaguuuggggcugacaguacauucaaggccuuuucaucaaugcccaaggacuccuuaugcuuuuacauaguagaaaaggauuacugcagcagcugcaccgacgaugacacacaaaagugugucaacacgaagcuugaccauccacagagcauacucauugagcacaaaggaacaauaauuggcaagcaaaaugacacuuguucgaccaagacaagcugcuggcuagaaucaguuaaggguuuuuucuaugggcuaaaaaacaugcuaaguggcaucuuuggaaauguuuuuuuaggcaucuucuuauuccuugcuccuuuugugcuacugauauuuuuuuucuuuuuuggguggaggcuucuguuuugucucaaauguugcagaagaacuagaggacuguugaaauacaagcaccuuaaggaugaagaggaggcuggauacaaaaaaaucauugaaaggcuaaauggcaaaaaagguaaaagucaauuguuugauggugaaaggcuugcagacaggaagauugcugagcuuuuuucuacuaaaauucacauaggu

SEQ ID NO: 3812 - RNA, 2916 nt, Artificial Sequence
  derived and/or modified CDS sequence (wt) from CCHFV(75024, Artificial)__AB069671.1__Gn-4aa-Gc
ucugaagaaucuggugaugacugcauaucaagaacucagcuauugaggacagagacugcagagauccauggugauaacuauggcgguccgggugacaagauuacuauuugcaaugguucgacaauuguagaucaaagacuggguagugagaugggguguuacacuaucaauagggugaagucauucaagcugugcgaaaacagugcaacagggaagagcugugaaauagacaguaucccaguuaagugcaggcaggguuauugccuaaaaaucacucaggaaggaaggggccaugugaaauuauccaggggcucagagguugucuuggaugcaugcgacucaagcugugaaguaaugauaccuaagggcacaggugacauccugguagacuguucaggugggcagcaacauuuuuugaaggacaacuuaauugaucuaggaugucccaguauuccauuacuggguaaaauggcuauuuauauuugcagaaugucgaaucacccuaagacaaccauggcuuuccucuuuugguucaguuuuggcuaugugauaacuuguauacucugcaaggcuauuuucuacuuauuaauaauuguuggaacgcuagggaagagguuuaagcaguacagagaguuaaaaccccagaccuguaccauaugugagacaacuccugcaaaugcaauagaugcugaaaugcaugaccuuaacugcaguuacaacauaugucccuauugugcaucuagacuaaccucagacgggcuugcuaggcaugugacacaaugcccuaagcggaaggagaaaguagaagaaacugaauuguacuugaacuuagagagaauucccuggguuguaagaaagcuguugcagguaucggaguccaccgguguugcauuaaaaagaagcagcuggcugauugugcugcuugugcuguucgcaauuucauuaucaccaguucaaucagcacccaucgguagaaggcccuuguuccuggacaguauaguuagaggcaugaaaaaucagcuaaacucaacaaguuuagaaacaagcuuaucgauugaggcaccauggggagcaauaaauguucagucaaccuacaaaccaacugugucaacugcaaacauagcacuuaguuggagcucaguugaacacagagguaauaagauuuugguuucaggcagaucagaaucaauuaugaagcuggaagaaaggacaggaaucagcugggaccuuggcguagaagaugccucugaaucuaagcuacuuacagucucugucauggacuugucucagauguacucuccugucuucgaguacuuaucaggugacagacaaguagaagaguggcccaaggcaaccuguacaggagacugcccagaaagauguggcugcacaacaucaaccugcuugcauaaagaauggccccauucaagaaacuggagauguaaucccacuuggugcugggggguggggacuggcugcacuuguuguggauuagaugugaaagaccuuuuuacagauuauaugauugucaaguggaaaguugaauacauuaaaacagaggccauaguguguguggaacucaccagucaggaaaggcaguguagcuugauugaggcaggcacaagguucaauuuagguucugugaccaucacauugucagaaccgaggaacauucaacaaaagcucccuccugaaauaaucacauugcauccuaggauugaagaagguuuuuuugaccugaugcauguacaaaaaguguugucagcuagcacaguguguaaguugcagaguugcacacacggugugccaggugaucuacaggucuaccaugucggaaauuuauuaaaaggagauaaggugaauggacaccuaauucauaaaauugagccacacuuaaacacuuccuggauguccugggauggcugugaucuagacuacuauugcaacaugggagacuggccuucuuguacauauaccggaguuacccaacacaaucaugcuucauuuguaaaccugcucaacauugaaacugacuauacaaaaagcuuccacuuucacucuaaaaggguuacugcacacggagacacaccacaauuagaucugaaggcaagaccaaccuacggcgcaggagaaaucacuguacugguagaaguugcugacauggaguucacaccgaagaagauugaaauaucaggccuaaaauuugcaagccugacuugcacaggcuguuaugcuuguaguucuggcauuuccugcaaaguuaggauucauguggaugaaccagaugaacuuacaguacauguuaagagugaugauccagauguaguagcagcuagcucaagucucauggcaaggaagcuugaguuuggaacagacaguacauuuaaagcuuucucagcuaugcccaaaacuuccuuauguuucuacauugucgaaagggaguacuguaagagcugcaguaaagaagacacacaaaaauguguuaacacaaaacuugagcaaccacagagcauuuugaucgaacauaagggaacuauaauuggaaagcaaaacaauaccugcacagccaaagcaaguugcugguuagagucgguuaaaaguuucuuuuauggucuaaagaacaugcuuaguggcauuuuuggcaaucuuuuuaugggcaucuucuuauuucuugcccccuucaucuuguuaauacuuuucuuuauguuuggauggaggauccuguuuugcuuuaaguguugcagaagaaccaggggccuguucaaguauagacaucucaaagacgaugaagaaacugguuacaggaggaucauugaaagacugaacaacaagaaggggaagaacaagcugcuugauggugaaagacuugccgauagaagaauugccgaacuauucuccacaaaaacacacauuggc

SEQ ID NO: 3813 - RNA, 2916 nt, Artificial Sequence
  derived and/or modified CDS sequence (wt) from CCHFV(7803, Artificial)__AB069672.1__Gn-4aa-Gc
ucugaagaaucuggugaugacugcauaucaagaacucagcuauugaggacagagacugcagagauccauggugauaacuauggugguccgggugacaagauuacuauuugcaaugguucgacaauuguagaucaaagacuggguagugagaugggguguuacacuaucaauagggugaagucauucaagcugugcgaaaacagugcaacagggaagagcugugaaauagacaguaucccaguuaagugcaggcaggguuauugccuaaaaaucacucaggaaggaaggggccaugugaaauuauccaggggcucagagguuaucuuggaugcaugcgacucaagcugugaaguaaugauaccuaagggcacaggugacauccugguagacuguucaggugggcagcaacauuuuuugaaggacaacuuaauugaucuaggaugucccaguauuccauuauuggguaaaauggcuauuuauauuugcagaaugucgaaucacccuaagacaaccauggcuuuccucuuuugguucaguuuuggcuaugugauaacuuguauacucugcaaggcuauuuucuacuuauuaauaauuguuggaacgcuagggaagagguuuaagcaguacagagaguuaaaaccccagaccuguaccauaugugagacaacuccugcaaaugcaauagaugcugaaaugcaugaccuuaacugcaguuacaacauaugucccuauugugcaucuagacuaaccucagacgggcuugcuaggcaugugacacaaugcccuaagcggaaggagaaaguagaagaaacugaauuguacuugaacuuagagagaauucccuggguuguaagaaagcuguugcagguaucggaguccaccgguguugcauuaaaaagaagcagcuggcugauugugcugcuugugcuguucgcaauuucauuaucaccaguucaaucagcacccaucaguagaaggcccuuguuccuggacaguauaguuagaggcaugaaaaauccgcuaaacucaacaaguuuagaaacaagcuuaucgauugaggcaccauggggagcaauaaauguucagucaaccuacaaaccaacugugucaacugcaaacauagcacuuaguuggagcucaguugaacacagagguaauaagauuuugguuucaggcagaucagaaucaauuaugaagcuggaagaaaggacaggaaucagcugggaccuuggcguagaagaugccucugaaucuaagcuacuuacagucucugucauggacuugucucagauguacucuccugucuucgaguacuuaucaggugacagacaaguagaagaguggcccaaggcaaccuguacaggagacugcccagaaagauguggcugcacaacaucaaccugcuugcauaaagaauggccccauucaagaaacuggagauguaaucccacuuggugcugggggguggggacuggcugcacuuguuguggauuagaugugaaagaccuuuuuacagauuauaugauugucaaguggaaaguugaauacauuaaaaccagaggcauaguguguguggaacucaccagucaggaaaggcaguguagcuugauugaggcgggcacaagguucaauuuagguucugugaccaucacauugucagaaccgaggaacauucaacaaaagcucccuccugaaauaaucacauugcauccuaggauugaagaagguuuuuuugaccugaugcauguacaaaaaguguugucagcuagcacaguguguaaguugcagaguugcacacacggugugccaggugaucuacaggucuaccaugucggaaauuuauuaaaaggagauaaggugaauggacaccuaauucauaaaauugagccacacuuaaacacuuccuggauguccugggauggcugugaccuagacuacuacugcaacaugggagacuggccuucuuguacauauaccggaguuacccaacacaaucaugcuucguuuguaaaccugcucaacauugaaacugacuauacaaaaagcuuccacuuucacucuaaaaggguuacugcacacggagacacaccacaauuagaucugaaggcaagaccaaccuacggcgcaggagaaaucacuguacugguagaaguugcugacauggaguucacaccgaagaagauugaaauaucgggccuaaaauuugcaagccugacuugcacaggcuguuaugcuuguaguucuggcauuuccugcaaaguuaggauucauguggaugaaccagaugaacuuacaguacauguuaagagugaugauccagauguaguagcagcuagcucaagucucauggcaaggaagcuugaguuuggaacagacaguacauuuaaagcuuucucagcuaugcccaaaacuuccuuauguuucuacauugucgaaagggaguacuguaagagcugcaguaaagaagacacacaaaaauguguuaacacaaaacuugagcaaccacagagcauuuugaucgaacauaagggaacuauaauuggaaagcaaaacaauaccugcacagccaaagcaaguugcugguuagagucgguuaaaaguuucuuuuauggucuaaagaacaugcuuaguggcauuuuuggcaauuuuuuuaugggcaucuucuuauuucuugcccccuucaucuuguuaauacuuuucuuuauguuuggauggaggauccuguuuugcuuuaaguguugcagaagaaccaggggccuguucaaguauagacaucucaaagacgaugaagaaacugguuacaggaggaucauugaaagacugaacaauaagaaggggaagaacaagcugcuugauggugaaagacuugccgauagaagaauugccgaacuauucuccacaaaaacacacauuggc

SEQ ID NO: 3814 - RNA, 2916 nt, Artificial Sequence
  derived and/or modified CDS sequence (wt) from CCHFV(79121, Artificial)__AB069673.1__Gn-4aa-Gc
gcagaaggaggaagcagugacugcauuucaagaacucagcuaguuaaaacggagguugcagaaauucaugaggacaguuacggugggccuggugagaaaauaacaaucugcaaugguuccacaauuguagaucaagggcuugguagugaauugggcuguuauacaaucaacagaguaagauccuacaagcuaugcgagaacagugccucagggaaaagcugugaaauagauagcaucccagucaaaugcaaacaaggguuuugccucaaaauaacccaagaaggaagaggucauguaaaacuguccagagggacagaaauuguucuagaugucugugauuccagcugugagcugaugauacccaagggcacuggagacauuuuaguggauugcucaggagggcaacagcauuuuuuacaaaacaaucugauugacuugggaugccccaaugucccauuacuggguaaaauggccauauaugucugcagaaugucaaaccacccaaaaacuaccauggcauuucuguucugguucagcuuuggcuaugucauuacauguauagcaugcaggguacucuucuacuugcugauugccaucggaacaguagggaaaaagcuaaaacaguauagagagcugaaaccacaaacaugcauugucugugaaucugucccuguuaaugcaauagaugcugaaaugcaugagcuuaauugcaguuacaauauaugcccauacugugcaucuagacugucuacagacgggcucaucaggcacguaacucagugucccaaacggagggagaagguggaagagacugagcuauucuugaacuuggaaagaauaccuuggcuggugagaaagcuccuucaaguaucagagucaacaggaauggcucuaaagagaagcuguuggaugaucacacuccucauucuacuauugguuucgauaucaccaguccaaucugcaccgguaggcaggaagccacucuuccuggauagcacagccaagggaaugaaaagccuguugaacuccacgagcuuagaaacuagucugucaauugaagcuccguggggagcaaucaauguccagucaacuuucaaaccaacaguuucagcugcuaacauagcacuuagcuggaguucaguugaacacaggggcaacaaaauuuuaguuucagguagaucagagucaaucaugaaauuagaagaaagaacaggagucagcuggaaucuggguguagaagaugcuucugagucaaagacgcuuacuguuuccgucauggaccugucacaaauguacucuccuguuuuugaguacuugucaggugacagacaaguggaggaauggccaaaggcaacuugcacaggugacuguccagagagaugcggcugcacuucgucaaccugcuuacauaaagaguggccacauucaagaaacuggcgauguaauccuaccugguguugggggguggggacuggcugcacuugcugugggcuggauguaaaggauuuuuuuacugacuacaugcugguaaaauggaaaguggaauauauaaagacagaagcuauagugugugucgagcugacuagucaagagaggcaguguaguuuaauugaagcaggcacaagauuuaaccuaggcccuguaacaauaacccuaucagagccaagaaauguccagcagaggcuuccucccgaaauuguaacacugcauccuaaaauagaggaagguuuuuuugauuugaugcauguacaaaaaauacugucugcaagcacaguuugcaagcuacagagcugcacacacggugugccgggcgauuuucagaucuaccaugucgguaaccugcugaggggagacaagguuaauggacacucaauucacaagauagaaccacauuuuaauacuucauggaugucaugggaugguugcgaucuggacuauuucugcaauaugggggacuggccuucaugcacauacacuggagugacacagcauaaccgugcugcauuuaucaacaugcucaacauugagacugacuauacaaaaacuuuccacuuucauucgaagagggucacggcacauggagauacuccccagcuagaccuaaaagcgagaccggcauauggugcuggcgaggucacuguucuaguggagguugcagacuuggaguugcacacaaagaaccuugaagugucagguuugaaaauugcaaguuugaccugcucuggguguuaugccugcagcucuggcaucuccugcaaaguuagaauccauguaaaugaaccagaugaauuuacaguacauguaagaaguagcgacccagauguuguagcagcaggaucaagucuuauggcaaggaaaauagaguuuggggcugacaguacauucaaggccuuuucaucaaugcccaaggacuccuuaugcuuuuacauaguagaaaaggauuacugcagcagcugcaccgacgaugacacacaaaagugugucaacacgaagcuugaccauccacagagcauacucauugagcacaaaggaacaauaauuggcaagcaaaaugacacuuguucgaccaagacaagcugcuggcuagaaucaguuaaggguuuuuucuaugggcuaaaaaacaugcuaaguggcaucuuuggaaauguuuuuuuaggcaucuucuuauuccuugcuccuuuugugcuacugauauuuuuuuucuuuuuuggguggaggcuucuguuuugucucaaauguugcagaagaacuagaggacuguugaaauacaagcaccuuaaggaugaagaggaggcuggauacaaaaaaaucauugaaaggcuaaauggcaaaaaagguaaaagucaauuguuugauggugaaaggcuugcagacaggaagauugcugagcuuuuuucuacuaaaauucacauaggu

SEQ ID NO: 3815 - RNA, 2916 nt, Artificial Sequence
  derived and/or modified CDS sequence (wt) from CCHFV(8402, Artificial)__AB069674.1__Gn-4aa-Gc
uccgaagagucuggugaugacugcauaucaagaacucagcuauugaggacagagacugcggaaauucacaaugauaacuauggugguccaggugacaagauaaccaucugcaaugguucaacuguuguggaucagagauugggcagugaacugggguguuacacuaucaauagaguaaagucauuuaagcuuugcgagaacagugccacaggcaaauccugugaaauagauagcaccccagucaaaugcaggcaggguuucuguuugaaaauuacucaggagggaaggggccacgugaagcuaucgagagguucagaaguuguccuggacgccugcgauucaagcugugaaauaaugauaccaaagggcaccggagacauccuaguugacuguucagguggacagcaacauuucuuaaaagauaacuugauugaucuaggaugcccaaacaucccacuauuaggcaagauggcuaucuacauuuguagaaugucaaaucauccuaaaacgacuauggcuuuucuuuuuugguuuagcuuugguuauguggugaccuguauacucuguaaggucaucuucuaucuauuaauaguuguggggacguuggggaaaaaguucaaacaguauagagaguugaaaccucagaccuguaccauaugcgaaacaacuccuguuaaugcaauagaugcugaaaugcacgaccucaacugcaguuacaauauauguccuuacugugcaucuagguuaaccucagauggucuugccagacauguaaugcagugcccuaagcggaaggaaaaaauagaagaaaccgaauuauacuuaaacuuggaaagaauccccuggguuguuaggaaauuacugcaggugucagaauccaccgguguggcacuaaagaggaguaguuggcugguugugcuacuuguguuacuuacaguuucauugucaccaguacaaucagcaccuaucggcaggaaacccuuguuuucagacagcauugucaaaggcaugaagaacuugcuaaauucaacaagcuuagaaacaagcuuaucaauugaggcaccauggggagcaauaaauguccaaucaaccuucaaaccuacugugucagcugcgaauauagcucuuaguuggagcucaguggaacacagggguaauaagauuuugguuucagguagaucagagucaaucaugaagcuagaggaaaggacaggaaucagcugggaucuagggguagaagaugcuucugagucuaaauugcuuacugucucuguuauggacuugucacagauguacucuccugucuuugaguaccuaucaggugacagacaaguggaggaauggcccaaggcaaccugcacaggagauugcccagaaagauguggcugcacaucaucaaccugccuacacaaagaauggccccauucaagaaacuggagaugcaaccccaccugguguuggggagucggcacuggauguaccugcugugggcuggauguaaaagaccuuuuuacagauuacauguuuaucaaguggaaaguugaguacauuaaaacagaagcuauaguguguguugagcuuacuagccaagagagacaauguaccuugauugaggcaggcacaagauucaacuuagguccugugaccaucacauugucagagccaagaaacauucagcaaaagcucccuccagagauaguuacauugcaccccagaauugaagaagguuucuuugauuuaaugcauguacaaaaggugcuaucagcaaguacaguguguaagcuacagaguugcacacauggugugccaggggaccuacaggucuaucacauaggaaacuuguuaaaaggagacaaggugaaugggcaccugauucacaaaauugaaccacacuucaacacuuccuggaugucuugggacggcugugaccuagacuacuacuguaauaugggggauuggccaucuugcacauauacuggaguaacccagcacaaucaugcugcauuuguaaacaugcucaacaucgaaacugauuauacaaaaaacuuccacuuucacucuaagagaguuacugcacauggagacacaccacaauuagauuugaaagcuagaccaacuuauggugcaggugaaaucacugugcugguggaaguugcugacauggaguuacacacaaagaaaauugagauaucagguuugaaguuugcaagcuuaacuugcacaggcuguuaugcuuguagcucugguaucuccuguaagguuagaauccauguagaugagccagaugagcuuacaguacaugugaagagugaagacccagacauaguugcugcuagcucaagucucauggcuagaaaacuugaauuugggacagauaguacauucaaagccuuuucagccaugcccaaaaccuccuuaugcuuuuacauuguggagagagaauauuguaaaagcugcagcaaagaagauacacaaaaaugugucaacacaaagcuugagcaaccacagagcauuuuaaucgagcacaaaggaacgauaauugguaagcagagcaacaccugcacagcuaaagcaagcuguuggcuagagucagucaagagcuucuuuuaugggcuaaagaacaugcuuaguggcauuuuuggcaauguuuucauagggguuuucuuauucuuugcuccuuuuauccuuuugauacuuuucuuuauguuuggauggagaauccuguucugcuuuaaauguugcagaagaacuagaggccuuuuuaaguacagacaccucaaggacgaugaagaaaccgguuacaggaaaaucauugagagacugaacaacaaaaaagggaaaaacaaacugcuugauggugaaagauuagcugauaggaagauugcugagcuguucuccacaaagacacacauuggc

SEQ ID NO: 3816 - RNA, 2916 nt, Artificial Sequence
  derived and/or modified CDS sequence (wt) from CCHFV(88166, Artificial)__AB069675.1__Gn-4aa-Gc
uccgaagagucuggugaugacugcauaucaagaacucagcuauugaggacagagacugcggaaauucacagugauaacuauggugguccaggugacaagauaaccaucugcaaugguucaacuguuguggaucagagauugggcagugaacuaggguguuacacuaucaauagaguaaagucauuuaagcuuugcgagaacagugccacaggcaaauccugugaaauagauagcaccccagucaaaugcaggcaggguuucuguuugaaaauuacucaggagggaaggggccacgugaagcuaucgagagguucagaaguuguccuggacgccugcgauucaagcugugaaauaaugauaccaaagggcacuggagacauccuaguugacuguucagguggacagcaacauuucuuaaaagauaacuugauugaucuaggaugcccaaacaucccacuauuaggcaagauggcuaucuacauuuguagaaugucaaaucauccuaaaacgacuauggguuuucuuuuuugguuuagcuuugguuauguggugaccuguauacucuguaaggucaucuucuaucuauuaauaguuguggggacguuggggaaaaaguucaaacaguauagagaguugaaaccucagaccuguaccauaugcgaaacaacuccuguuaaugcaauagaugcugaaaugcacgaccucaacugcaguuacaauauauguccuuacugugcaucuagguuaaccucagauggccuugccagacauguaaugcagugcccuaagcggaaggaaaaaauagaagaaaccgaauuauacuuaaacuuggaaagaauccccuggguuguuaggaaauuacugcaggugucagaauccaccgguguggcacuaaagaggaguaguuggcugguugugcuacuuguguuacuuacaguuucauugucaccaguacaaucagcaccuaucggcaggaaacccuuguuuucagacagcauugucaaaggcaugaagaacuugcuaaauucaacaagcuuagaaacaagcuuaucaauugaggcaccauggggagcaauaaauguccaaucaaccuucaaaccuaccaugucagcugcgaauauagcucuuaguuggagcucaguggaacacagggguaauaagauuuugguuucagguagaucagagucaaucaugaagcuagaggaaaggacaggaaucagcuggaaucuagggguagaagaugcuucugagucuaaauugcuuacugucucuguuauggacuugucacagauguacucuccugucuuugaguaccuaucaggugacagacaaguggaggaauggcccaaggcaaccugcacaggagauugcccagaaagauguggcugcacaucaucaaccugccuacacaaagaauggccccauucaagaaacuggagaugcaaccccaccugguguuggggagucggcacuggauguaccugcugugggcuggauguaaaagaccuuuuuacagauuacauguuuaucaaguggaaaguugaguacauuaaaacagaagcuauaguguguguugagcuuacuagccaagagagacaauguaccuugauugaggcaggcacaagauucaacuuagguccugugaccaucacauugucagagccaagaaacauucagcaaaagcucccuccagagauaguuacauugcaccccagaauugaagaagguuucuuugauuuaaugcauguacaaaaggugcuaucagcaaguacaguguguaagcuacagaguugcacacauggugugccaggggaccuacaggucuaucacauaggaaacuuguuaaaaggagacaaggugaaugggcaccugauucacaaaauugaaccacacuucaacacuuccuggaugucuugggacggcugugaccuagacuacuacuguaauaugggggauuggccaucuugcacauauacuggaguaacccagcacaaucaugcugcauuuguaaacaugcucaacaucgaaacugauuauacaaaaaacuuccacuuucacucuaagagaguuacugcacauggagacacaccacaauuagauuugaaagcuagaccaacuuauggugcaggugaaaucacugugcugguggaaguugcugacauggaguuacacacaaagaaaauugagauaucagguuugaaguuugcaagcuuaacuugcacaggcuguuaugcuuguagcucugguaucuccuguaagguuagaauccauguagaugagccagaugagcuuacaguacaugugaagagugaagacccagacuuaguugcugcuagcucaagucucauggcuagaaaacuugaauuugggacagauaguacauucaaagccuuuucagccaugcccaaaaccuccuuaugcuuuuacauuguggagagagaauauuguaaaagcugcagcaaagaagauacacaaaaaugugucaacacaaagcuugagcaaccacagagcauuuuaaucgagcacaaaggaacgauaauugguaagcagaacaacacaugcacagcuaaagcaagcuguuggcuagagucagucaagagcuucuuuuaugggcuaaagaacaugcuuaguggcauuuuuggcaauguuuucauagggguuuucuuauucuuugcuccuuuuauccuuuugauacuuuucuuuauguuuggauggagaauccuguucugcuuuaaauguugcagaagaacuagaggccuuuuuaaguacagacaccucaaggacgaugaagaaaccgguuacaggaaaaucauugagagacugaacaacaaaaaagggaaaaacaaacugcuugauggugaaagauuagcugauaggaagauugcugagcuguucuccacaaagacacacauuggc

SEQ ID NO: 3817 - RNA, 2916 nt, Artificial Sequence
  derived and/or modified CDS sequence (wt) from CCHFV(BA88166, Artificial)__AF338470.1__Gn-4aa-Gc
uccgaagagucuggugaugacugcauaucaagaacucagcuauugaggacagagacugcggaaauucacagugauaacuauggugguccaggugacaagauaaccaucugcaaugguucaacuguuguggaucagagauugggcagugaacuaggguguuacacuaucaauagaguaaagucauuuaagcuuugcgagaacagugccacaggcaaauccugugaaauagauagcaccccagucaaaugcaggcaggguuucuguuugaaaauuacucaggagggaaggggccacgugaagcuaucgagagguucagaaguuguccuggacgccugcgauucaagcugugaaauaaugauaccaaagggcacuggagacauccuaguugacuguucagguggacagcaacauuucuuaaaagauaacuugauugaucuaggaugcccaaacaucccacuauuaggcaagauggcuaucuacauuuguagaaugucaaaucauccuaaaacgacuauggguuuucuuuuuugguuuagcuuugguuauguggugaccuguauacucuguaagggcaucuucuaucuauuaauaguuguggggacguuggggaaaaaguucaaacaguauagagaguugaaaccucagaccuguaccauaugcgaaacaacuccuguuaaugcaauagaugcugaaaugcacgaccucaacugcaguuacaauauauguccuuacugugcaucuagguuaaccucagauggccuugccagacauguaaugcagugcccuaagcggaaggaaaaaauagaagaaaccgaauuauacuuaaacuuggaaagaauccccuggguuguuaggaaauuacugcaggugucagaauccaccgguguggcacuaaagaggaguaguuggcugguugugcuacuuguguuacuuacaguuucauugucaccaguacaaucagcaccuaucggcaggaaacccuuguauuuagacagcauugucaaaggcaugaagaacuugcuaaauucaacaagcuuagaaacaagcuuaucaauugaggcaccauggggagcaauaaauguccaaucaaccuucaaaccuaccaugucagcugcgaauauagcucuuaguuggagcucaguggaacacagggguaauaagauuuugguuucagguagaucagagucaaucaugaagcuagaggaaaggacaggaaucagcuggaaucuagggguagaagaugcuucugagucuaaauugcuuacugucucuguuauggacuugucacagauguacucuccugucuuugaguaccuaucaggugacagacaaguggaggaauggcccaaggcaaccugcacaggagauugcccagaaagauguggcugcacaucaucaaccugccuacacaaagaauggccccauucaagaaacuggagaugcaaccccaccugguguuggggagucggcacuggauguaccugcugugggcuggauguaaaagaccuuuuuacagauuacauguuuaucaaguggaaaguugaguacauuaaaacagaagcuauaguguguguugagcuuacuagccaagagagacaauguaccuugauugaggcaggcacaagauucaacuuagguccugugaucaucacauugucagagccaagaaacauucagcaaaagcucccuccagagauaguuacauugcaccccagaauugaagaagguuucuuugauuuaaugcauguacaaaaggugcuaucagcaaguacaguguguaagcuacagaguugcacacauggugugccaggggaccuacaggucuaucacauaggaaacuuguuaaaaggagacaaggugaaugggcaccugauucacaaaauugaaccacacuucaacacuuccuggaugucuugggacggcugugaccuagacuacuacuguaauaugggggauuggccaucuugcacauauacuggaguaacccagcacaaucaugcugcauuuguaaacaugcucaacaucgaaacugauuauacaaaaaacuuccacuuucacucuaagagaguuacugcacauggagacacaccacaauuagauuugaaagcuagaccaacuuauggugcaggugaaaucacugugcugguggaaguugcugacauggaguuacacacaaagaaaauugagauaucagguuugaaguuugcaagcuuaacuugcacaggcuguuaugcuuguagcucugguaucuccuguaagguuagaauccauguagaugagccagaugagcuuacaguacaugugaagagugaagacccagacauaguugcugcuagcucaagucucauggcuagaaaacuugaauuugggacagauaguacauucaaagccuuuucagccaugcccaaaaccuccuuaugcuuuuacauuguggagagagaauauuguaaaagcugcagcaaagaagauacacaaaaaugugucaacacaaagcuugagcaaccacagagcauuuuaaucgagcacaaaggaacgauaauugguaagcagaacaacacaugcacagcuaaagcaagcuguuggcuagagucagucaagagcuucuuuuaugggcuaaagaacaugcuuaguggcauuuuuggcaauguuuucauagggguuuucuuauucuuugcuccuuuuauccuuuugauacuuuucuuuauguuuggauggagaauccuguucugcuuuaaauguugcagaagaacuagaggccuuuuuaaguacagacaccucaaggacgaugaagaaaccgguuacaggaaaaucauugagagacugaacaacaaaaaagggaaaaacaaacugcuugauggugaaagauuagcugauaggaagauugcugagcuguucuccacaaagacacacauuggc

SEQ ID NO: 3818 - RNA, 2916 nt, Artificial Sequence
  derived and/or modified CDS sequence (wt) from CCHFV(BA66019, Artificial)__AF350448.1__Gn-4aa-Gc
uccgaagagucuggugacgacugcauaucuagaacucagcuauugaggacagagacugcagagguccauggugacaacuauggugguccaggugacaaaauaacuaucuguaaugguucaaccauuguggaucaaagacuuggcagugaacugggguguuauacuaucaauagagugaagucauucaagcuaugcgaaaauaguggcacgggaaaauccuguaagauagauaaacacccaguuaagugcaggcaggguuuuugcuuaaaaauuacucaggaaggaaggggccaugugaagcuaucgagaggcucagaaguugucuuagaugccugcgacucaagcugugaaauaaugauaccgaagggcacaggagacauccuaguagacuguucaggugggcaacaacauuucuuaaaagauaacuugguugaucuaggaugcccuaacauuccacuauuagguaaaauggcuaucuacauuugcaggaugucaaaucacccuaaaacaacuauggcuuuucucuuuugguuuaguuucggcuauguaauaacauguauauuuuguaaaaucauuuuuuacuuguugauagucguggggacauuggggaaaaaguucaaacaguaccgggagcugaaaccucagacuuguacuauaugugaaacaacuccuaccaaugcaauagaugcugaaaugcacgaucuuaaaugcaguuacaauauaugcccuuauugugcaucuagauuaaccucggacgggcuugccaggcaugugacacaaugcccuaagcgaaaagagaaaguagaagagacugaacuguacuugaacuuggaaagaauuccuuggauugucagaaaacuacugcaagugucagagucuaccgguguggcacugaaaaggagcaguuggcugauuguguuacuugugcuacuuacaguuucauugucaccgguucaaucagcacccauuggaaggaaaccccuauucucagacaguauagucaagggcaugaaaaaccugcuaaauucaacuagcuuggaaacaagcuuaucaauugaagcaccauggggagcaauaaacguccagucaaccuuuaaacccaccguuucaacugcaaacauagcacuuagcuggaguucaguagaacacagagguaacaaaauuuuggucucaggcagaucagaaucaauuaugaagcuagaagaaaggacaggaaucagcugggaucugggcguagaagaugccucugaaucuaaguugcuuacuguuucugucauggauuugucacagauguauucuccugucuuugaguacuuaucaggugacagacagguagaggaguggcccaaagcaaccugcacaggugauugcccagauagguguggcugcacaucaucaaccuguuuacacaaagaauggccccauucaagaaauuggagaugcaaccccacuugguguuggggagucggcacuggaugcaccugcuguggacuagaugugaaagaucuuuuuacagauuauauguuugucaaguggaaaguugaauacauaaagaccgaggccauagugugcguugagcucaauagccaagaaaggcagugcagcuugauugaggcaggcacaagauucaacuuggguccugugaccaucacguugucagaaccaagaaacauucagcagaagcuuccuccugaaauaaucacauugcauccuagaauugaggaagguuucuucgaucugaugcauguucaaaaggugcugucugcaaguacaguaugcaagcuacaaagcugcacacauggugugccaggagacuuacagaucuaccacauuggcaacuuguuaaaaggggauaggguaaaugggcaucugauucacaaaauugagccacacuucaacacuucuuggauguccugggauggcugugaccuagauuacuacuguaacaugggggauuggcccucuugcacauauacuggagugacccaacauaaccaugcugcuuuuguaaacuuacuuaacaucgaaacugauuacacaaagaacuuccauuuucauucuaaaaggguuacugcccauggagacaccccacaacuggaucuuaaagcuagaccaacuuacggugcgggugaaaucacuguucugguggagguugcugacauggaguuacacacaaaaaagauugcgauaucaggucugaaauuugcaaguuugacuugcacagguugcuaugcuuguagcucuggcaucuccuguaaagucaggauucauguggaugaaccagaugagcuuacaguacaugugaaaagugaagauccggacauuguugcagccagcucaagccucauggcaaggaagcuugaauuugggacagacagcacauucaaggccuucucagccaugcccaaaaccuccuugugcuucuacauuguagagagagaauacugugagagcugcagcaaagaagacacacagaaauguguuaacacaaagcuugagcaaccacaaagcauuuuaauugagcacaaaggaacgauaaucggaaagcaaaaugacacuugcacagccaaagcaagcugcugguuagagucaguaaagaguuuuuuuuauggauugaagaacaugcuuagcggcaucuucggcaacguuuuuauaggcauuuucuuauuccuugcuccuuuuauucuguuaauacucuucuuuauguuuggguggagaauccuguuuugcuuuaaguguugcagaaggaccagaggcuuauucaaguacagauaucucaaggacgacgaagagucugguuacagaagaaucauugaaagauuaaacaacaaaaaaggaaaaaacaaguuacuugacggugaaagacuagcugacaggaggaucgcugaguuguucucuaccaaaacacacauuggu

SEQ ID NO: 3819 - RNA, 2916 nt, Artificial Sequence
  derived and/or modified CDS sequence (wt) from CCHFV(BA8402, Artificial)__AF350449.1__Gn-4aa-Gc
uccgaagagucuggugaugacugcauaucaagaacucagcuauugaggacagagacugcggaaauucacaaugauaacuauggugguccaggugacaagauaaccaucugcaaugguucaacuguuguggaucagagauugggcagugaacugggguguuacacuaucaauagaguaaacucuuuuaaccuuugcgaaaacacugccacgggcaaauccugugaaauagauagcaccccagucaaaugcaggcaggguuucuguuugaaaauuacucaggagggaaggggccacgugaagcuaucgagagguucagaaguuguccuggacgccugcgaaucaagcugugaaauaaugauaccaaagggcaccggagacauccuaguugacuguucagguggacagcaacauuucuuaaaagauaacuugauugaucuaggaugcccaaacaucccacuauuaggcaagauggcuaucuacauuuguagaaugucaaaucauccuaaaacgacuauggcuuuucuuuuuugguuuagcuuugguuauguggugaccuguauacucuguaaggucaucuucuaucuauuaauaguuguggggacguuggggaaaaaguucaaacaguauagagaguugaaaccucagaccuguaccauaugcgaaacaacuccuguuaaugcaauagaugcugaaaugcacgaccucaauugcaguuacaauauauguccauacugugcaucuaggccaaccucagauggucuugccagacauguuaugcagugcccuaagcggaaggaaaaaauugaagaaaccgcauuauacuuaaacuuggaaagaauccccuggguuguuaggaaauuacugcaggugucagaauccaccgguguggcacuaaagaggaguaguuggcugguugugcuacuugugcuacuuacaguuucauugucaccaguacaaucagcaccuaucggcaggaaacccuuguuuucagacagcauugucaaaggcaugaagaacuugcuaaauucaacaagcuuagaaacaagcuuaucaauugaggcaccauggggagcaauaaauguccaaucaaccuucaaaccuacugugucagcugcgaauauagcucuuaguuggagcucaguggaacacagggguaauaagauuuugguuucagguagaucagaaucaaucaugaagcuagaagaaaggacaggaaucagcugggaucuagggguagaagaugcuucugaaucuaaauugcuuacugucucuguuauggacuugucacagauguacucuccugucuuugaguaccuaucaggugacagacaaguggaggaauggcccaaggcaaccugcacaggagauugcccagaaagauguggcugcacaucaucaaccugccuacacaaagaauggccccauucaagaaacuggagaugcaaccccaccugguguuggggagucggcacuggauguaccugcugugggcuggauguaaaagaccuuuuuacagauuacauguuuaucaaguggaaaguugaguacauuaaaacagaagcuauaguguguguugagcuuacuagccaagagagacaauguaccuugauugaggcaggcacaagauucaacuuagguccugugaccaucacauugucagagccaagaaacauucagcaaaagcucccuccagagauaguuacauugcaccccagaauugaagaagguuucuuugauuuaaugcauguacaaaaggugcuaucagcaaguacaguguguaagcuacagaguugcacacauggugugccaggggaccuacaggucuaucacauaggaaacuuguuaaaaggagacaaggugaaugggcaccugauucacaaaauugaaccacacuucaacacuuccuggaugucuugggacggcugugaccuacacuacuacuguaauaugggggauuggccaucuugcacauauacuggagucacccagcacaaucaugcugcauuuguaaacaugcucaacaucgaaacugauuauacaaaaaacuuccacuuucacucuaagagaguuacugcacauggagacacaccacaauuagauuugaaagcuagaccaacuuauggugcaggugaaaucacugugcugguggaaguugcugacauggaguuacacacaaagaaaauugagauaucagguuugaaguuugcaagcuuaacuugcacaggcuguuaugcuuguagcucugguaucuccuguaagguuagaauccauguagaugagccagaugagcuuacaguacaugugaagagugaagaccccgacauaguugcugcuagcucaagucucauggcuaggaagcuugaauuugggacagauaguacauucaaagccuuuucagccaugcccaaaaccuccuuaugcuucuacauuguggagagagaauauugugaaagcugcagcaaagaagauacacaaaaauguguuaacacaaagcuugagcaaccacagagcauuuuaaucgagcacaaaggcacgauaauugguaagcagagcaacaccugcacagcuaaagcaagcuguuggcuagagucagucaagagcuucuuuuaugggcuaaagaacaugcuuaguggcauuuuuggcaauguuuucauagggguuuucuuauucuuugcuccuuuuauccuuuugauacuuuucuuuauguuuggauggagaauccuguucugcuuuaaauguugcagaagaacuagaggccuuuuuaaguacagacaccucaaggacgaugaagaaaccgguuacaggaaaaucauugagagacugaacaacaaaaaagggaaaaacaaacugcuugauggugaaagauuagcugauaggaagauugcugagcuguucuccacaaagacacacauuggc

SEQ ID NO: 3820 - RNA, 2916 nt, Artificial Sequence
  derived and/or modified CDS sequence (wt) from CCHFV(Matin, Artificial)__AF467769.2__Gn-4aa-Gc
uccgaagagucuggugaugacuguauaucaagaacucagcuauugaggacagagacugcggaaauucacagugauagcuaugguggaccaggugauaagauaaccaucugcaaugguucaacuguuguagaucagagguugggcagugaacuaggguguuacacuauaaauagaguaaagucauuuaagcuuugcgagaacagugccacagguaaauccugugaaauagauagcaccccaguuaaaugcaggcaggguuuuugcuuaaaaauuacucaggagggaaggggccacgugaagcugucgagagguucagaaguugucuuggaugccugugacucaagcugugaaauaaugauaccaaagggcacuggagacauccuaguugacuguucaggugggcagcaacauuucuuaaaagauaaccugauugaucugggaugccccaacauuccacuauuaggcaaaauggccaucuacauuuguagaaugucaaaucaucccaaaacaacuaugguuuuucuuuuuugguuuagcuuugguuauguaauaaccuguauacucuguaaggucaucuucuaucuauuaauaguuguagggacauuagggaaaaaguucaaacaguauagagaguugaaaccucagaccuguaccauaugcgaaacaacuccuguuaaugcaauagaugcugaaaugcacgaccuuaacugcaguuacaauauauguccuuacugugcauccagguugacaucagauggucuugccagacauguaaugcagugccccaaacggaaggaaaaaauagaagaaaccgaauuauacuuaaacuuagaaaggaucccuuggguuguuaggaaauuacugcaggugucagaaucuaccgguguggcacuaaagaggaguagcuggcugguugugcuacuuguguuacuuacaguuucacuaucaccaguacaaucagcaccuaucggcagaaaacccuuguuuuuagacaguauuauuaaggguaugaagaacuugcuaaauucaacaagcuuagaaacaagcuuaucaauugaggcaccauggggagcaauaaauguccaaucaacuuucaaaccuacuaugucagcugcgaacauagcgcuaaguuggagcucaguggaacacagagguaauaagauuuugguuucaggcagaucagagucgaucaugaagcuagaggaaaggacaggaaucagcugggaucuaggaguagaagaugccucugagucuaaauugcuuacuguaucuguuauggacuuaucacagauguauucuccugucuuugaguacuuaucaggugauagacaaguggaggaauggcccaaggcaaccugcacaggcgauuguccagaaagauguggcugcacaucaucaaccugccuacacaaagaauggccccauucaagaaacuggagaugcaauccuacuugguguuggggagucggcacuggauguaccugcugugggcuagacguaaaagaccuuuuuacugauuacauguuugucaaguggaaaguugaauacauuaaaacggaaguuauaguguguguugagcuuacuagccaagaaagacaauguagcuugauugaggcaggcacaagauucaacuuagguccugugaccauuacauugucagagccaagaaacauucagcaaaagcucccuccagagauagucacauugcaucccagaauugaagaagguuucuuugauuuaaugcauguacaaaaagugcuaucagcaaguacagugugcaagcuacagaguugcacacauggugugccaggggaccuacaggucuaccacauaggaaacuuguuaaaaggagauaaggugaacgggcacuugauucacaaaauugaaccacacuucaacacuuccuggaugucuugggacggcugugaccuagacuacuacuguaauaugggggauuggccaucuugcucauauacuggaguaacccaacacaaucaugcugcauuuguaaacaugcucagcaucgaaacugauuauacaaaaaacuuccacuuucacucuaagagaguuacugcacauggagacacaccacaauuagaucugaaagcuaggccaacuuacggugcaggugaaaucacugugcugguagagguugcugacauggaauuacauacaaagaaaauugagauaucagguuugaaguuugcaagcuuaacuugcacaggauguuaugcuuguagcucugguaucuccuguaagguuagaauccauguagaugaaccagaugagcuuacaguacaugugaagagugaagacccagacauaguugcugcuagcucaagucucauggcuagaaagcuugaauuugggacagauaguacauucaaagccuuuucagccaugcccaaaaccuccuuaugcuuuuacauuguggagagagaauauuguaaaaguugcaguaaagaagacacacaaaaaugugucaacacaaagcuugagcaaccacagagcaucuuaaucgagcauaaagggacgauaauuggaaagcaaaacgacaccuguacagccaaagcaagcugcuggcuggagucagucaaaaguuuuuuuuauggacuaaagaacaugcuuaguggcauuuuuggcaauguuuucauagggauuuucuuauuccuugcuccuuuugcccuuuuaauacuuuucuuuauguuuggauggagaauccuguucugcuuuaaauguugcagaagaacuagaggccuauuuaaauacagacaccucaaggacgacgaagaaaccgguuacaggaaaaucauugagaggcugaacaacaaaaaagguaaaaacaaacugcucgacggugaaagacuagcugacaggaagaucgcugagcuguucuccacaaaaacacacguuggc

SEQ ID NO: 3821 - RNA, 2916 nt, Artificial Sequence
  derived and/or modified CDS sequence (wt) from CCHFV(Baghdad 12, Artificial)__AJ538197.2__Gn-4aa-Gc
ucugaagaaucuggugaugacugcauaucaagaacucggcuauugagaacagagacugcagagauccauggugacagcuauggugguccgggugacaaaauuacuauuugcaacgguucaacuauuguagaucaaagacugggaagugagaugggguguuacacuaucaauagagugaagucauucaagcugugcgaaaacagugcaacaggaaagagcuguaaaauagacaguaucccaguuaagugcagacaggguuauugccuaaaaaucacucaggaaggaaggggccaugugaaauuauccaggggcucagagguugucuuggaugcaugcgacucaagcugugaaguaaugauaccuaaaggcacaggugacaucuuaguagacuguucaggugggcagcaacauuuuuugaaggauaacuugauugaucuaggaugccccaacauuccauuauuagguaaaauggcuauuuauauuugcagaaugucaaaucacccuaagacaaccauggcuuuccucuuuugguucaguuuugguuaugugauaaccuguauacucugcaaggccaucuucuacuuauuaauaauuguugggacacuagggaaaagguuuaagcaguacagagaguuaaaaccccagaccuguacuauaugugagacaacuccuguaaaugcaauagaugcugaaaugcaugaccuuaacugcaguuacaauauaugucccuauugugcaucuagauuaaccucagaugggcuugcuaggcaugugacacaaugcccuaagcggaaggagaaaguggaagaaacugaauuguacuugaacuuagagaggauucccuggguuguaagaaagcuguugcagguaucagaguccacagguguugcauuaaagagaagcagcuggcugauugugcugcuugugcuacuugcaguuucaucaucaccaguucaaucagcacccaucgguagaaagcccuuguuccuggauaguauagucaaaggcacgaaaaaucugcuaaacucaacaaguuuagaaacaagcuuaucgauugaggcaccauggggagcaauaaauguucagucaaccuauaaaccaacugugucaacugcaaacauagcacuuaguuggaguucaguugaacacagagguaacaagauuuugguuucaggcagaucagaaucaauuaugaagcuagaagagagaacaggaaucaguugggaucuuggcguagaagaugccucugaaucuaagcuacuuacagucucugucauggacuugucucagauguacucuccugucuuugaguacuuaucaggugacagacaaguagaagaauggcccaaggcaaccuguacaggugacugcccagaaagauguggcugcacaacaucaaccugcuugcauaaagaauggccccauucaagaaacuggagauguaaucccacuuggugcuggggagugggaacuggcugcacuuguugcggauuagaugugaaggaccuuuuuacagauuauauguucgucaaauggaaaguugaauacauuaaaacagaugccauaguguguguggaacucacuagucaagaaaggcaaugcagcuugauugaggcagguacaagguuuaacuuagguucugugaccaucacauugucagaaccgaggaacauucagcaaaagcucccuccugaaauaaucacauuacauccuaggauugaagaagguuuuuuugaccugaugcauguacaaaaaguguugucagcuagcacaguguguaaguugcagaguugcacacacggugugccaggugaucuacaggucuaccacaucggaaauuuauuaaaaggggauaaagugaauggacaccuaauucauaaaauugagccacauuuuaacacuucuuggauguccugggauggcugugacuuagacuacuauugcaauaugggagacuggccuucuugcacauauaccggaguuacccaacacaaucaugcuucauuuguaaaccugcucaacauugaaacugauuacacaaaaagcuuccacuuucacucuaaaaggguuacugcacauggagauacaccacaguuagaucugaagguaagaccaaccuacggcgcaggagaaaucacuguacugguagaaguugcugacauggaguugcacacgaagaagauugaaauaucaggccuaaaauuugcaagccugacuugcacaggcuguuaugcuuguagcucuggcauuuccugcaaaguuaggauacauguggaugaaccggaugaacucacaguacacgucaaaagugaugauccagauguaguagcagcuagcucaagucucauggcaaggaagcuugaguuuggaacagacagcacauuuaaagcuuucuccgccaugccaaaaacuuccuuauguuucuacauugucgaaagggaguacuguaaaagcugcaguaaagaagauacacaaaaauguguuaacacaaaacuugagcaaccacagagcauuuugauugaacauaagggaacuauaaucggaaagcaaaacaauaccugcacagccaaaacaaguugcugguuagagucaguuaaaaguuucuuuuauggucuaaagaauaugcuuaguggcauuuuuggcaauuuuuucaugggcaucuucuuauuucuugcccccuuuaucuuguuaauacuuuucuuuauguuuggauggaggauccuguuuugcuuuaaguguugcagaagaaccaggggccuguuuaaguacagacaucucaaagaugaugaagaaacugguuauagaaggaucauugaaagacugaacaacaagaaagggaagaacaagcugcuugauggugaaagacuugccgauagaaggauugccgaacuauucuccacaaaaacacauauuggc

SEQ ID NO: 3822 - RNA, 2916 nt, Artificial Sequence
  derived and/or modified CDS sequence (wt) from CCHFV(VLG/TI29414, Artificial)__AY179961.1__Gn-4aa-Gc
uccgaggagccaggugaugacugcauaucaagaacucagcuauugagggcagaaccagcagagauccaugaugacaacuauggugguccaggugauaaaauaacuaucugcaaugguucaaccauuguagaucagagacugggcagugaacuaggguguuauaccaucaacagggugaagucauucaagcuaugcgaaaacagcgccacagggaaaaccugugagauagacagcacuccgguuaagugcaggcaagguuuuuguuuaaaaaucacccaagagggaaggggccacguaaaauuaucuagaggcucagagguuguuuuggaugcuugcgacucaagcugcgaaguaaugauaccuaaaggcacuggagauauccugguggacuguucagguggacagcaacauuucuuaaaagacaauuuaauugaccuagggugcccccauaucccgcuauuggguaaaauggccauuuacaucugcagaaugucaaaucauccuagaacaacuauggcuuuucucuucugguucagcuuuggcuaugugaucaccuguauauuuugcaaggcucuuuuuuauucauugauaauuauugggacacuagggaaaaagaucaagcaauauagggaauugaaaccucaaacuuguaccauaugugagacagccccugucaaugcaauagacgcugaaaugcaugaccuuaacugcaguuacaauauaugcccuuauugugcaucaagauugaccuccgaugggcuagcuaggcaugugccacaaugccccaagcggaaggaaaaaguugaagagacugagcuguacuugaaccuggaaagaauuccuuggaaugucagaaagcuauugcaagugucagaguccacugguguggcauugaaacgaagcagcuggcugauuguacugcuuguguuacucacaguuucauugucaccgguucaaucagcaccuguugguagaaaaccucuguucuuagacaguauaguuaaaggcaugaagaauuuacuaaacucaacaaacuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguagaagaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcugggaaguaggaacuggcugcaccugcugcggguggaauguaaaagaccuuuuuacagaucacauguuugucaaauggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacgcugcaucccaaaguugaagagggcuucuuugacuugaugcaugugcaaaaaguguugucugcaaguacaguguguaaacugcagaguugcacacaugguauaccaggagaucuacaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggaaugacccagcauaaccaugcugcauuuguaaacuugcuuaauaucgaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcauaccaagaaaguugagauaucaggcuuaaaauuugcaagucuggcuugcacggguugcuaugcuuguagcucuggcaucuccuguaaagucaggauucauguagaugagccagaugagcucacaguacauguaaagagcaaugauccagaugugauugcagcuagcacaagucucauggcgaggaagcuugaauuugggacagacaguacauucaaggccuuuucagcuaugcccaaaaccucuuuauguuuuuacauugcggagagagaauacugcaagagcugcagugaagaggacacacaaaaauguguugacacaaaacuugagcagccacagagcauacuaauugagcacaaaggaacgauaauuggaaagcagaaugauacuugcacagccaaggcaagcuguuggcuagagucagucaagaguuuuuuuuauggauugaaaaauaugcuugguaguguauuugguaacuuuuucauaggcauuuuguuauuccuugccccuuuuguccuguuggugcuuuucuuuauguuuggauggaaaaucuuguuuugcuucaaauguugcaggaggaccagaggcuuacuuaaguauagacuccucaaagacgaugaggaaacaggcuacagaaggauuauugaaagacugaacaacaaaaaaggaaaaaacagacugcuugauggugaaagguuggcugauaggaaaauugcugagcuguucuccacgaaaacacacauuggu

SEQ ID NO: 3823 - RNA, 2916 nt, Artificial Sequence
  derived and/or modified CDS sequence (wt) from CCHFV(TADJ/HU8966, Artificial)__AY179962.1__Gn-4aa-Gc
ucugaagaaucuggugacgacugcauaucaagaacucagcuacugaggacagagacugcagagauccauggugaugauuauggugguccgggugacaagauuaccauuugcaaugguucgacuauuguagaucaaagacuggguagugaacugggguguuacacuaucaauagagugaagucauucaagcugugcgaaaacagugcaacagggaagaacugcgaaauagacagcgucccaguuaaaugcaggcaggguuauugccuaaaaauuacucaggaaggaaggggccaugugaaauuauccaggggcucagagguuguuuuggaugcaugcgauucaagcugugaaguaaugauaccuaagggcacaggugacaucucaguagacuguucaggagggcagcaacauuuuuugaaagacaacuuaauugaucugggaugucccaagauuccauuauuggguaaaauggccauuuauauuugcagaaugucgaaucacccuaaaacaaccauggcuuuccucuuuugguucaguuuuggcuaugugauaacccguauacucugcaaggccauuuucuacuuauuaauaauuguuggaacacuagggaagagguuuaagcaauauagagaguuaaaaccccagaccuguaccauaugugagacaacuccugcaaaugcaauagaugcugaaaugcaugaccuuaacugcaguuacaacauaugucccuauugugcaucuagacugaccucagauggacucgcuaggcaugugacacaaugcccuaagcggaaggagagaguagaagaaacugaauuguacuugaacuuagaaagaauucccuggauuguaagaaagcuguugcagguaucggaguccacugguguugcauuaaaaagaagcagcuggcugauugugcuacuugugcuguucacaguuucauuaucaccaguucaaucagcacccauugguagaaggccccuguuccuggauaguauagucaaaggcaugaaaaauccgcuaaacuccacaaguuuagaaacaagcuugucgauugaggcaccauggggggcaauaaauguucagucaacuuacaagccaacuguuucaacugcaaacauagcacuuaguuggaguucaauugaacacagagguaauaauauuuugguuucaggcagaucagaaucaauuaugaagcuggaagaaagaacaggaauuaguggggaucuuggcguugaagaugccucugaauccaagcuacuuacagucucuguuauggacuugucucagauguacuccccugucuucgaguacuuaucaggugacagacaaguagaagaguggcccaaggcaaccuguacaggugacugcccagaaagauguggcugcacaucaucaaccugcuuacauaaagaauggccccauucacgaaacuggagaugcaaucccacuuggugcugggggguggggacuggcugcaccuguuguggauuagaugugaaagaccuauuuauagauuauauguucgucaaguggaaaguugauuacauuaaaacagaagccauaguguguguagaacucaccagucaggaaaggcaguguagcuugguugaggcgggcacaagguucaauuuagguccugugaccaucacauugucagaaccgaggaacauacaacaaaagcucccuccugaaauaaucacauugcauccuaggauugaagaagguuuuuuugaucuaaugcaugugcaaaaagugcugucagcaagcacaguguguaaauugcagaguugcacacauggugugccaggagaucuacaggucuaccacaucggaaacuuauuaaaaggagauaaagagaacggacaccuaauucauaaaauugagccgcacuucaauacuuccuggauguccugggauggcugugaccuagacuacuacugcaacaugggagacuggccuucuugcacauauaccggaguuacccagcacaaucaugcuucauuuguaaaccugcucaacauugaaacugacuauacaaaaagcuuccacuuucacucuaaaaggguuacugcacacggagacacaccacaauuggaucugaaggcaagaccaacuuacggcgcaggagaaaucacuguacugguagaaguugcugauauggaguuacacacgaagaagauugaaauaacaggccucaaauuugcaagccugacuugcacagguuguuaugcuuguaguucaggcauuuccugcaaaguuaggauucauguggacgagccagaugaacuuacaguacauguuaaaagugaugauccagauguaguugcagcuagcucaagucucauggcaaggaagcuugaguucgggacagacaguacauucaaagcuuucucagccaugccuaaaacuuccuuaugcuucuacauugucgaaagggaguaccguaagagcuguaguaaagaggacacacagaaauguguuaacacaaaacuugagcaaccacagagcauuuugaucgaacacaagggaacuauaaucggaaagcaaaauaauacuugcacagccaaagcaaguugcugguuagagucagucaaaaguuucuuuuauggucuaaagaacaugcuuaguggcauuuuuggcaauguuuuugugggcauuuucuuguuucuugccccuuuuaucuuguuaauacuuuucuuuauguuuggauggaggauccugucuugcuuuaaguguugcagaagaaccaggggccugcuuaagcauagacaucucaaagacgaugaagaaacugguuacagaaggaucauugaaagacugaacaacaagaaggggaaaaacaagcugcuugauggugaaagacuugccgauagacggauugccgaacuauucuccacaaaaacacacauuggc

SEQ ID NO: 3824 - RNA, 2916 nt, Artificial Sequence
  derived and/or modified CDS sequence (wt) from CCHFV(Hodzha, Artificial)__AY223476.1__Gn-4aa-Gc
ucugaagaaucuggugacgacugcauaucaagaacucagcuacugaggacagagacugcagagauccauggugaugauuauggugguccgggcgacaagauuaccauuugcaaugguucaacuauuguagaucaaagacuagguagugaacugggguguuacacuaucaauagagugaagucauucaagcugugcaaaaacagugcaacagggaagagcugugaaauagacagcaccccaguuaaaugcaggcaggguuauugccuaaaaaucacucaggaaggaaggggccaugugaaauuauccaggggcucggagguugucuuggaugcaugcgauucaagcugugaaguaaugauaccuaagggcacaggugacauccuaguagacuguucaggugggcagcaacauuuuuugaaagacaacuuaauugaucuaggaugucccagaauuccauuauuagguaaaauggcuauuuauauuugcagaaugucgaaucacccuaagacaaccauggcuuuccucuuuugguucaguuuuggcuaugugauaaccuguauacucugcaaggccauuuucuacuuauuaauaauuguuggaacacuagggaagagguucaagcaguauagagaguuaaaaccccagaccuguaccauaugugagacaacuccugcaaaugcaauagaugcugaaaugcaugaccuuaacugcaguuacaacauaugucccuauugugcaucuagacuaaccucagaugggcuugcuaggcaugugacacaaugcccuaagcggaaggagaagguagaagaaacugaauuguacuugaacuuagagagaauucccuggauuguaagaaagcuguugcaggugucggaguccacugguguugcauuaaaaagaagcagcuggcugauugugcugcuugugcuguucgcaguuucauuaucaccuguucaaucagcacccauugguagaaggccccuguuccuggauaguauaguuaaaggcacgaaaaaucuguuaaacuccacaaguuuagaaacaagcuugucgauugaggcaccauggggggcaauaaauguucagucaaccuacaaaccaacuguaucaacugcaaacauagcacuuaguuggaguucaguugaacacagagguaauaagauuuugguuucaggcagaucagaaucaauuaugaagcuggaagaaagaacaggaaucagcugggaucuuggcguugaagaugccucugaaucuaagcuacuuacugucucugucauggacuugucucagauguacuccccugucuucgaguacuuaucgggugacagacaaguagaagaguggcccaaagcaaccugcacaggugacugcccagaaagauguggcugcacaucaucaaccugcuuacauaaagaauggccccauucacgaaacuggagaugcaaucccacuuggugcugggggguggggacuggcugcaccuguuguggauuagaugugaaagaccuauuuacagauuauauguucgucaaguggaaaguugauuacauuaaaacagaggccauaguguguguagaacucaccagucaggaaaggcaguguagcuugguugaggcgggcacaagguucaauuuagguccuguaaccaucacauugucagaaccgaggaacauacaacaaaagcucccuccugaaauaaucacauugcauccuaggauugaagaagguuuuuuugaccugaugcauguacaaaaagugcugucagcaagcacaguguguaaauugcagaguugcacacauggugugccaggagaucuacaggucuaccacaucggaaauuuauuaaaaggggauaaagugaacggacaccuaauucauaaaauugagccgcacuucaauacuuccuggauguccugggauggcugugaccuagacuacuacugcaacaugggagacuggccuucuugcacauauaccggaguuacccaacacaaucaugcuucauuuguaaaccugcucaacauugaaacugacuauacaaaaagcuuccacuuucacucuaaaaggguuacugcacauggagacacaccacaauuggaucugaaggcaagaccaaccuacggcgcaggagaaaucacuguacugguagaaguugcugauauggaguuacacacaaagaagaucgaaauaacaggccuuaaauuugcaagccugacuugcacagguuguuaugcuuguaguucaggcaucuccugcaaaguuaggauucacguggaugaaccagaugagcuaacaguacauguuaaaagugaugacccagauguaguugcagccagcucaagucucauggcaaggaaacuugaguuuggaacagacaguacauucaaagcuuucucagccaugccuaaaacuuccuuaugcuucuacauugucgaaagggaguacuguaagagcugcaguaaagaagacacacagaaauguguuaacacaaaacuugagcaaccacagagcauuuugaucgaacgcaagggaacuauaaucggaaagcaaaacaauacuugcacagccaaggcaaguugcugguuagagucaguuaaaaguuucuuuuauggucuaaagaacaugcuuaguggcauuuuuggcaauguuuuuguaggcauuuucuuauuucuugcccccuuuaucuuguuaauacuuuucuucauguuuggauggaggauccuguuuugcuucaaguguugcagaagaaccaggggccuguuuaaguauaaacaucucaaagacgaugaagaaacugguuacagaaggaucauugaaagacugaacaacaagaaggggaaaaacaagcugcuugacggugaaagacuugccgauagaaggauugccgaacuauucuccacaaaaacacacauuggc

SEQ ID NO: 3825 - RNA, 2916 nt, Artificial Sequence
  derived and/or modified CDS sequence (wt) from CCHFV(Kosovo/9553/2001, Artificial)__AY675511.1__Gn-4aa-Gc
uccgaagagccaggugaugacugcauaucaaggacucagcuauugaggacagaaacagcagagauccaugacgauaacuauggugguccaggugacaaaauaacuaucugcaaugguucgaccauuguagaucagagacugggcagugaacuaggguguuauaccaucaacagggugaagucauucaagcuaugcgaaaacagcgccacagggaaaaccugugagauagacagcacuccaguuaagugcaggcaagguuuuuguuuaaaaaucacccaagagggaaggggccacguaaaauuaucuagaggcucagagguugucuuggacgcuugcgacucaagcugugaaguaaugauacccaaaggcacuggagauauccuaguagacugcucugguggacagcagcauuucuuaaaagacaacuugauugaccuagggugcccucauaucccacuauuggguaagauggccauuuacauugccagaaugucaaaucauccuaaaacaaccauggcuuuucucuucugguucaguuugggcuaugugaucaccuguauacuuugcaaggcucuuuuuuauucauugauaauuauugggacacuagggaaaaaaaucaagcaauauagggaacugaaaccucaaacuugcaccauaugugagacagcuccugucaaugcaauagaugcugaaaugcaugaccucaacuguaguuacaauauaugccccuauugugcaucaagauugaccucugaugggcuagcuaggcauguaaagcagugcccuaagcgaaaggagaaagucgaggagacugagcuguaccugaaccuggaaagaauuccuugggucgucagaaagcuauugcaagugucagaguccacugguguggcauugaaacgaagcaguuggcugauugugcugcuuguguuacucacaguuucauugucaccgguucaaucagcacccguugguaggaaaccucuuuucuuagacaguauagucaaagguaugaaaaauuugcuaaacucaacaagcuuggaaacaagcuuaucaauugaggcaccauggggagcaauaaauguccagucaaccuuuaaaccaacaguaucgacugcgaacauagcacucaguuggagcucaguggagcacagaggcaacaagaucuuagucacaggcaggucugaaucaauuaugaaacuagaggaaaggacaggagucagcugggaucuagggguagaagaugccucugaauccaaauuacuuaccgucucuaucauggauuugucacagauguauuccccaguuuuugaguacuugucuggagacagacagguugaagaauggcccaaagcaacuuguacaggugacugcccagaaagguguggcugcacaucaucaaccugcuugcauaaagaauggccucauucaagaaacuggagauguaaucccacuuggugcuggggagugggaaccggcugcaccugcugcgggguggauguaaaagaccuuuuuacagaucacauguuugucaaauggaagguugaauauauaaaaacugaagccauaguguguguugagcucaccagccaagaaagacagugcagucugauugaggcagguacuagauucaacuugggcccugugacuauuacccugucugagccaagaaacauucagcagaagcuucccccugagaucauuacguugcaucccaaaauugaggaaggcuucuuugacuugaugcauguacaaaaaguguuguccgcaaguacaguguguaaacugcagaguugcacacaugguauaccaggagaucuacaaguuuaccacauuggcaacuuguugaaaggggauagaguaaacgggcaucuaauucacaaaauugaaccacauuucaacaccucuuggauguccugggaugguugugacuuagacuacuacugcaacaugggggacuggccuucuuguacauacacaggagugacccagcauaaucaugcugcauuuguaaacuugcuuaacauugaaacugauuacacgaaaaccuuccacuuccacucuaaaagagucacagcacauggugacacaccacaauuggacuuaaaagcaaggccgaccuacggugcaggagagaucacugugcugguugagguugcugacauggaguugcauaccaagaaaguugagauaucgggcuugaaauuugcaagucuggcuugcacagguugcuaugccuguagcucuggcaucuccuguaaagucaggauucauguagaugaaccagaugagcucacagugcauguaaagagcagugacccagauguuguugcagcuagcacaagccucauggcaaggaagcuugaauuugggacagacagcacauucaaggccuuuucagcuaugcccaaaaccucuuuauguuuuuacauuguggagaaagaauacugcaagagcugcagugaagaugauacaaaaaaauguguugacacaaaacuugagcagccacagagcauacuaauugagcacagagggacgauaauuggaaagccgaaugauacuugcccagccaagacaagcuguuggcuagaguccgucaagagcuuuuuuuauggauugaagaauaugcuuggcagugucuuugguaauuuuuucauaggcauuuuguuauuccuugccccuuuuuuccuguggaugcuuuccuuuauguuuggauggaaaaucuuguucugcuuuaaauguugcaggaggaccagaggccuguuuaaguauagacaccucaaagacgaugaggaaacaggcuacagaaggauuauugaaaggcugaacaacaaaaaagggaaaaauagacugcuugauggugaaagguuggcugauaggaaaauugccgagcuguuuucuacaaaaacacacauuggc

SEQ ID NO: 3826 - RNA, 2916 nt, Artificial Sequence
  derived and/or modified CDS sequence (wt) from CCHFV(SPU41/84, Artificial)__AY900142.1__Gn-4aa-Gc
uccgaggagucuagcgacgacugcauaucaagaacucaacuauugaggacagagacugcagagauccacggcgauaacuaugguggcccaggugacaagauaaccaucugcaauggcucaacuguuguagaccagagacuggguagugagcugggguguuacacuaucaauagaguaaagacauucaaacuaugcgaaaacagugcuacagggaagaguugugagauagauagugucccaguuaaaugcaggcaggguuauugccuaaaaaucacucaggaaggaaggggccauguaaaauuaucuagaggcucagagguugucuuggaugcaugugauacaagcugugaaguaaugauacccaaaggcacuggugacauccuaguugacuguucaggugggcagcaacauuuucuaaaagacaaucuaauagaccuaggaugccccaaaauuccauuacuggguaaaauggcuauuuacauuugcagaaugucgaaucaccccaaaacaacuauggcuuuccucuucugguucagcuuuggcuaugugauaacuuguauaauuuguaaggucauuuuuuacuuguuaauaauuguuggaacacuaggaaaaagguucaagcaguacagagaguuaaaaccucagaccugcaccauaugugagacaacuccugugaaugcaauagaugcugagaugcaugaccucaauugcaguuacaacauaugucccuauugugcaucuagacuaaccucagacgggcuugcuaggcaugugacacagugcccuaagcggaaggaaaaaguggaggaaacugaauuguacuugaacuuggagagaauucccuggguugugagaaagcuguugcagguaucagaguccacugguguggcauugaaaaggagcagcuggcugguugugcugcuggugcuguugacgguuucauugucaccgguucagucagcgcccauuaguagaagaccucuauucuuagauaguauaguuaagggcaugaaaaauuugcuaaacucaacaaguuuagagacaaguuuaucaauugaggcaccauggggagcaauaaauguucagucaaccuacaaaccaacuguaucaacugcaaacauagcgcuuaguuggagcucaguggaacacagaggcaauaagauacugguuucaggcagaucagaaucaauuaugaagcuggaagaaaggacaggaauaagcugggaucucgguguggaagacgccucugagucuaaacugcuuacagucucugucauggacuugucucagauguacucaccugucuucgaguacuuaucaggagacagacagguggaggaguggcccaaagcaacuuguacgggugacugcccagaaagauguggcugcacaucaucaaccugcuugcacaaagaauggccccacucaagaaauuggagauguaaucccacuuggugcugggguguaggaacuggcugcaccuguuguggauuagacgugaaagaccucuuuacagauuauauguuugucaaguggaaaguugaauacauuaagacagaagcaauaguguguguagaacuuacuagucaggaaagacaguguagcuugauugaagcgggcacaagguucaacuuggguccugugaccaucacauugucagaaccaagaaacauccagcaaaagcucccaccugaaauaaucacacugcaucccaggauugaggaggguuuuuuugaccugaugcauguacaaaaaguguugucggcaagcacaguguguaaguugcagaguugcacacauggugugccaggagaucuacaggucuaccacaucggaaauuuacuaaaaggggauaagguaaaugggcaccuaguucauaaaauugagccacacuucaauacuucuuggauguccugggaugguugugaucuagacuauuauugcaacaugggagauuggccuucuugcacauacacaggaguuacccagcacaaucaugccucauuuguaaacaugcucaacauugaaacugauuacacaaaaaacuuccacuuucacucuaaaagggucacugcacacggagacacaccacaacuagaucuuaaagcaagaccaaccuauggugcaggugagaucacuguauugguggagguugcugacauggaguuacacacaaagaagauugaaauaucaggcuuaaaauuuacuagcuugacuuguacagguuguuaugcuuguaguucuggcaucucaugcaaaguuagaauucauguggaugaaccagaugagcuuacagugcauguuaaaagugaagauccagauguuguugcagcuagcucaagucucauggcaagaaagcuugaauuuggaacagacaguacauuuaaagcuuuuucagccaugccuaaaacuucucuauguuucuacauuguggaaagagaauacuguaagagcugcagugaagaagacacacaaaaauguguuaacacaaaacuugagcagccacagagcauuuugaucgaacguaagggaacuauaaucgggaagcaaaacaacacuugcaaggcuaaggcggguugcugguuagagucaguuaagaguuuuuuuuacggccuaaagaacaugcucaguggcauuuuuggcaauguauuuauaggcauuuucuuauuccuugcccccuucauccuguuaauacuauucuuuauguuuggguggaggaucuuguuuuguuuuaaguguuguagaagaaccagaggccuguucaaguacagacaccugaaagacgaugaagaaacugguuauagaaagaucauugaaagacuaaacaacaaaaaagggaaaaauaaacugcuugauggugaaagacuugcugauagaagaauugccgaacuguucucuacaaaaacacacauuggc

SEQ ID NO: 3827 - RNA, 2916 nt, Artificial Sequence
  derived and/or modified CDS sequence (wt) from CCHFV(UG3010, Artificial)__AY900143.1__Gn-4aa-Gc
gcagaaggagugagcaaugacuguguuucaaggacccagcuaaucaaaacagaaguugcagagauucaugaagauaguuauggugggccuggagaaaaaauaacaaucugcaacggcuccacaaucguggaccaaagacucgguagcgaacuaggcugcuacacaaucaaccgugugaagacuuauaagcuuugugagaauagugcuacagagaaggguugugagaucgauagugucccagucaaaugcaaacaaggguucugccucaaaguaacccaagagggcaggggccauguaaaacuguccagaggaacggaaauuguccuagauguaugugacaccaguugugaguugaugauacccaagggcacuggggacauauugguggacugcucaggaggacagcagcacuuuuugcaggauaacuugauugacuuagguuguccaaauguaccauuauuaggcaagauggcaauauauaucugcaggaugucaaaucauccuaaaacuaccauggcuuuucuguucugguuuagcuuuggcuaugucaucacaugcauaguauguaaagugcuuuucuaucugcuaauugucaucgggacacuaaguaagaaacuuaaacaguauagggaauuaaaaccucaaacaugcauugucugugaaucaaccccuguuaaugcaauagaugcugaaaugcacgagcucaauuguaauuacaacauaugcccauacugcgcguccagacuaacuucagauggacuagucagacaugugaaucaaugucccaaaaggaaagaaaaggucgaggagacugaacuauacuugaaccuggagaggauaccuuggcuaguaaggaggcuacuacaagugucagagucaacggggauggcucuaaagagaaguugcuggaugaccacacuccucauucugcuaguaguuucauuaucgccaguucaaucugcuccaguugguagaaagccucuuuaccuagacagcauagccaaggggaugaaaagucugcuaaauucuacgaauuuagagacaagccugucgauugaggccccguggggagcaaucaauguucagucaacuuuuaaaccaacaguuucagcugccaauauagcacuuagcuggaguucaguugaacacaggggcaacaaaauccuaguuucgggcaggucagagucaauuaugaagcuggaagaaaggaccgguaucagcuggagccuagguguagaggaugcuucugagucaaagacgcugacuguuucugucauggaccuaucccaaauguauucucccgucuuugaguaucugucaggugauagacagguagaagaguggccaaaagccaccugcacaggcgacugccaagagagauguggcugcacuucuucaaccugcuugcauaaagaauggccacacucgagaaacuggcgaugcaaccccacuugguguuggggaguggggacuggcugcaccugcuguggauuggaugugagagaccuuuucacggacuacaugaugguuaaguggaaaguggaauauguaaaaacagaagcuauaauguguguugagcuaaccagucaggagaggcaauguaguuugauugaagcagguacaagauuuaaccuaggcccugugacaauaacccugucagagccaagaaacauccagcaaaggcucccuuccgaaaucguuacacugcacccuaagauagaagaaggguucuuugacuugaugcaugugcaaaagguacuaucugcaaguacagucugcaaacuacagagcugcacacacggugucccuggcgaucuacaggucuaccauguuggcaaccuacugaaaggagauaaggucaaugggcacucaauccacaagauagagucccauuucaacacuucauggaugucaugggauggaugugaucuagacuacuucugcaacaugggugacuggcccucauguacauacacuggagugacacagcacaaccgugcggcauucaucaauaugcucaauauugagacugauuauacaaagacuuuccacuuccauuccaagagaguaacggcacauggugacaccccucaacuggaucugaaggcaaggccuacauauggugcaggcgaagucacuguucuaguagagguugcagaucuggagcuacacaccaagaaaauugaagugucaggacugaaguuugcaagucugaccugcuccgguuguuacgccugcagcuccgguaucuccugcaaaguuagaauucaugugaaugaaccagaugaauuuacuguacaugugaaaagcagugauccagauguuguggcagcaggaucaaguuugauggcaaggaaaauagaguuuggggcugacagcaccuucaaagcuuucucaucaaugccuaaaaacucuuugugcuucuauauaguggaaagagacuacugcagcagcugcaccaaugaugacacucagaaguguguugacacaaagcucgaacauccacaaagcauauuaauugagcauaagggaacaauaauuggcaaacaaaacgacaccuguucgaccaaaacaagcuguuggcuagaaucagucaagaguuuuuuuuauggacuaaaaaacaugcuggguggcaucuucgguaaugucuucuuaggcaucuuccuguuccuugcuccuuuugcacugcuaauauucuucuucuucuucggguggaggcuucuguucugucugaaguguugcagaagaaccagggggcugcuaaaguauaaacaacuuaaggacgaagaagaagccggguacaagaaaaucaucgagaggcuaaaugacaaaaaaggcaaaagucgacuguuugacggagagaggcuugcagauaggaagauugcagaacucuuuucaaccaaaacucauauaggg

SEQ ID NO: 3828 - RNA, 2916 nt, Artificial Sequence
  derived and/or modified CDS sequence (wt) from CCHFV(Hy13, Artificial)__AY900145.1__Gn-4aa-Gc
uccgaagagucuggugaugacugcauaucaagaacucagcuaucgaggacagagacugcggaaauucacagugauaacuauggugguccaggugacaagauaaccaucugcaaugguucaacuauuguagaucagagauugggcagugaacuaggguguuacacuaucaauagaguaaagucauuuaagcuuugcgagaacagugccacagguaaauccugugaaauagauagcaccccaauuaaaugcaggcaggguuuuuguuuaaaaauuacucaggagggaaggggccacgugaagcuaucaagagguucagaaguugucuuggacgccugugauucaagcugugagauaaugauaccaaagggcacuggagacauccuaguugacuguucagguggacagcaacauuucuuaaaagauaacuugauugaucugggaugcccaaacaucccacuauuagguaagauggcuaucuacauuuguagaaugucaaaucauccuaaaacgacuauggcuuuucuuuuuugguuuagcuuugguuaugugauaaccuguauacucuguaaggucaucuucuaccuauuaauaguuguggggacguugggaaaaaaguucaaacaguauagagaguugaaaccucagaccuguaccauaugcgaaacaacuccuguuaaugcaauagaugcugaaaugcacgaccucaacugcaguuacaauauauguccuuacugugcaucuagguuaaccucagacggucuugccagacauguaaugcagugcccuaagcggaaggaaaaaguagaagaaaccgaauuauacuuaaacuuagaaagaauccccuggguuguuaggaaauuacugcagguaucagaauccaccgguguggcacuaaagaggaguaguuggcugguugugcuacuuguguuacuuacaguuucauugucaccaguacaaucagcaccuaucggcaggaaacccuuguuuucagacaguauugucaaaggcaugaagaacuugcuaaauucaacaagcuuagaaacaagcuuaucaauugaggcaccauggggagcuauaaauguccaaucaaccuucaaaccuacuguguccgcugcgaacauagcucuuaguuggagcucaguggaacacagggguaauaagauuuugguuucagguagaucagagucaauuaugaagcuagaggaaaggacaggaaucagcugggaucuagggguagaagaugccucugagucuaaauugcuuacugucucuauuauggacuugucacagauguauucuccugucuuugaguaccuaucaggugauagacaaguggaggaauggcccaaggcaaccugcacaggagauugcccagaaagauguggcugcacaucaucaaccugccuacacaaagaauggccccauucaagaaacuggagaugcaaccccaccugguguuggggagucggcacuggauguaccugcugugggcuggauguaaaagaccuuuuuacagaucacauguuugucaaguggaaaguugaguacauuaaaacagaagcuauaguguguguugagcuuacuagccaagagagacaauguagcuugauugaggcaggcacaagauucaacuuagguccugugaccaucacauugucagagccaagaaacauucagcaaaagcucccuccagagauaguuacauugcaucccagaauugaagaagguuucuuugauuuaaugcauguaaaaaaagugcuaucagcaaguacaguauguaagcuacagaguugcacacauggugugccaggggaccuacaggucuaccacauaggaaacuuguuaaaaggagacaaggugaaugggcaccugauucacaaaauugaaccacacuucaacacuuccuggaugucuugggacggcugugaccuagacuacuacuguaauaugggagacuggccaucuugcucauauacuggaguaacccagcacaaucaugcugcauuuguaaacaugcucaacaucgaaacugauuauacaaaaaucuuccacuuucacucuaagagaguuacugcacauggagacacaccacaauuagauuugaaagcuagaccaacuuauggugcaggugaaaucacugugcuaguggaaguugcugacauggaguuacacacaaagaaaauugagauaucagguuuaaaguuugcaagcuuaacuugcacaggcuguuaugcuuguagcucugguaucuccuguaagguuagaauccauguagaugagccugaugagcuuacaguacaugugaagagugaagacccagacauaguugcugcuagcucaagucucauggcuagaaaacuugaauuugggacagauagcacauucaaagccuuuucagccaugcccaaaaccuccuugugcuuuuacauuguggagagagaauauuguaaaagcugcaguaaagaagauacacaaaaaugugucaacacaaagcuugagcaaccacagagcauuuuaauugagcacaaaggaacgauaauugguaagcaaaacgacaccugcacaucuaaagcaggcuguuggcuagagucagucaagagcuucuuuuaugggcuaaaaaacaugcuuaguggcauuuuuggcaauguuuucauagggauuuucuuauuccuugcuccuuuuauccuuuuaauacuuuucuuuauguuuggauggagaauccuguucugcuuuaaauguugcagaagaacuagaggcuuauuuaaguacagacaccucaaggacgaugaagaaaccgguuacaggaaaaucauugagaggcugaacaacaaaaaagggaaaaacaaacugcuugauggugaaagauuagcugauaggaagauugcugagcuguucuccacaaagacacacauuggc

SEQ ID NO: 3829 - RNA, 2916 nt, Artificial Sequence
  derived and/or modified CDS sequence (wt) from CCHFV(Semunya, Artificial)__DQ094832.1__Gn-4aa-Gc
gcagaaggagugagcaaugacugcguuucaaggacccagcuaaucaaaacagaaguugcggagauucaugaagauagcuacggugggccuggagaaaaaauaacaaucugcaacggcuccacaaucguggaccaaaggcuugguagcgaacuagguugcuacacaauuaaccgcgugaagacuuauaagcuuugugagaacagugccacagaaaaggguugugagaucgauaguguuccagucaaaugcaaacaaggguucugccucaaaguaacccaagagggcaggggccaugugaaacuaucuagaggaacggaaauuguccuggaugugugugacaccaguugugaguugaugauaccuaaaggcacuggagacauauugguggacugcucaggaggacagcagcacuucuugcaggacaacuugauugacuuagguugcccaaauguaccauuacuaggcaagauggcaauauauaucugcaggaugucgaaccauccaaagaccaccauggcuuuuuuguucugguucaguuuuggcuaugucaucacaugcguaguaugcaaagugcucuucuaucugcuaauugucaucgggacacuaggaaagaaacuuaaacaguauagggaacuaaaaccucagacaugcauugucugugaaucaaucccugucaaugcaauagaugcugaaaugcacgagcucaauugcaauuacaauauaugcccauacugugcguccagacugacuucagauggacuaguuagacaugugacucaaugucccaaaaggaaggaaaaggucgaggagacugagcuguacuugaaccuggagaggauacccugguugguaagaagacuacugcaagugucagagucaacagggauggcucuaaagagaaguugcuggaugaccacacuccucauucugcuaguaguuucauugucuccaguucaaucugcuccaguagguagaaagccccuuuuccuggauagcauagccaaggggaagaaaagucuguuaaauucuacgaacuuagagacaagccugucgauugaggccccauggggagcaaucaauguucagucaacuuuuaaaccaacaguuucagcugccaacauagcacuuagcuggaguucaguugaacacaggggcaacaaaauccuaguuucgggcaggucagagucaauuaugaaacuggaagaacggaccggcaucagcuggagccuagguguagaggaugcuucugagucaaagacgcuuacuguuucugucauggaccugucucaaauguauucuccugucuuugaguaucugucaggugauagacaaguagaagaguggccaaaggccacuugcacaggcgacugcccggagagauguggcugcaccuccucaaccugcuugcauaaagaauggccgcacucgagaaacuggcgaugcaaccccacuugguguuggggaguagggacuggcugcaccugcuguggacuggauguuagagaccuuuucacggacuacaugauggucaaguggaaaguggaauauguaaaaacagaagcuauaauguguguugagcuaacuagucaggaaaggcaguguaguuuaauugaggcagguacaagguuuaaccuaggcccugugacaauaacccugucagagccaagaaauguccagcaaaggcuucccuccgaaaucguuacacugcacccuaagauagaggaaggauucuuugauuugaugcaugugcaaaaaguacuauucugcaaguacaguuugcaagcuacaagcugcacacacggcgucccaggcgauuugcaggucuaccauguuggcaaccuacugaaaggagacaagguuaaugggcacucaauucacaagauagagucucauuucaacaccucauggaugucaugggauggaugugaccuagacuacuuuugcaacaugggugacuggccuucauguacauauacuggagugacacagcacaaucgugcggcauucgucaacaugcucaauauugagacugauuauacaaagacuuuucacuuccauuccaagaggguuacggcacacggugacaccccucaacuggaucugaaggcaagaccaacauauggugcaggcgaggucacuguucuaguggagguugcagaucuggagcuacacacuaagaaaauagaagugucaggguugaaguuugcaagucugaccugcuccgguuguuaugccugcaguuccggcaucuccugcaaaguuagaauucaugugaaugaaccagaugaguucacaguacacgugaaaagcaaugauccagacguuguggcagcaggaucaagucugauggcaaggaaaauagaguuuggggcugacagcaccuuuaaagccuuuucaucaaugccuaaaaacucuuugugcuuuuauauaguggaaagagacuacugcagcagcugcaccgaugaugacacucagaaguguguuaacauaaagcucgaacauccacaaagcauauuaauugagcauaagggaacaauaauugguaagcaaaaugacaccuguccgaccaaaacaagcugcuggcuagaaucagucaagaguuuuuuuuauggacugaaaaacaugcuggguggcaucuucggcaaugucuucuuaggcaucuuccuauuccuugcuccuuuugcacugcugauacucuucuucuucuuuggauggaggcuucuguucugucugaaguguugcagaaggaccaggggucugcuaaaguauaaacaacuuaaggaugaagaagaagccggguacaagaaaaucaucgagaggcugaaugacaaaaagggcaaaagucgacuuuuugauggagagaggcucgcugacaggaagauugcuaaacucuucucaaccaagacucauauaggg

SEQ ID NO: 3830 - RNA, 2916 nt, Artificial Sequence
  derived and/or modified CDS sequence (wt) from CCHFV(SPU128/81/7, Artificial)__DQ157174.1__Gn-4aa-Gc
uccgaagaacccagugaugacugcauaucaagaacucaacuauugaggacagagacugcagagauccacggcgacaacuaugguggcccgggugacaaaauaaccaucugcaacggcucaacuauuguagaccaaagacuaggcagugagcuaggguguuacacuaucaacagagugaagucauucaagcuaugcgaaaauagugccacagggaagagcugugaaauagaaagugucccaguuaaaugcaggcaggguuauugccugagaaucacucaggaagggaggggccauguaaaauuaucuaggggcucagagguugucuuagaugcaugugauacaagcugugaaauaaugauaccuaagggcacuggugacaucuugguugacuguucaggugggcagcaacauuuucuaaaggacaauuugauagaucuaggaugccccaaaauuccauuauugggcaaaauggcuauuuacauuugcagaaugucgaaucaccccaaaacaaccauggcuuuccucuucugguucagcuuuggcuacguaauaacuuguauacuuugcaaggccaucuucuacuuguuaauaauuauuggaacacuagggaaaagguucaagcaguauagagaguuaaaaccucagaccugcaccauaugugagacaacuccuguaaaugcaauagaugcugagaugcacgaccucaauugcaguuacaacauuugucccuacugugcaucuagacuaaccucagaugggcuugcuaggcaugugacacaaugcccuaagcggaaggagaaaguggaagaaacugaacuguacuugaacuuagaaagaauuccuuggguuguaagaaagcuguugcagguaucagaguccacugguguggcauugaaaagaagcagcuggcugauugugcugcuugugcuguucacgguuucauugucaccaguucaaucagcacccauugguagaaagccucuauuccuagauaguauaguuaaaggcaugaaaaaucugcuaaacucaacaaguuuagaaacaaguuuaucaauugaggcaccauggggggcaauaaauguucagucaaccuacaaaccaacugugucaacugcaaacauagcacucaguuggagcucuguggaacacagaggcaauaagaucuugguuucaggcagaucagaaucaauuaugaagcuggaagaaaggacaggaaucagcugggaucucggcguagaagacgccucugagucuaaacugcuuacagucucugucauggacuugucucagauguacucuccugucuucgaguacuuaucaggagacagacagguggaagaguggcccaaagcaacuuguacaggugacugcccagaaagaugcggcugcacaucaucaacguguuugcacaaagaauggccccauucaagaaauuggagaugcaaucccacuuggugcugggguguagggacuggcugcaccuguuguggauuagaugugaaagaccuuuuuacagauuauauguuugucaaguggaaaguugaauauauuaagacagaggccauaguguguguagaacuuaccagucaggaaaggcaguguagcuugauugaagcgggcacaagguucaauuuagguccugugaccaucacacugucagaaccaagaaacauccaacagaagcucccuccugaaauaaucacacugcaucccaggaucgaagaagguuuuuuugacuugaugcauguacagaaaguguuaucggcaagcacaguauguaaguugcagaguugcacacaugguguaccaggagaccuacaggucuaccacaucggaaauuuauugaaaggggauaagguaaauggacaucuaauucauaaaauugagccacacuucaacacuuccuggauguccugggaugguugugaccuggacuacuacugcaacaugggagauuggccuucuugcacauacacaggagucacccaacacaaucaugcuucauuuguaaaccugcucaacauugagacugauuacacaaaaaacuuccacuuucacucuaaaagggucacugcacacggagacacaccacaacuagaucuuaaggcaagaccaaccuauggugcaggugagaucacuguacugguagaaguugcugacauggaguuacacacaaagaagauugaaauaucaggcuuaaaauuugcaagcuugacuugcacagguuguuaugcuuguagcucuggcaucucaugcaaaguuagaauucauguggaugaaccagaugaacuuacaguacauguuaaaagugaugauccagauguaguugcagcuagcucaagucucauggcaagaaagcuugaauuuggaacagacaguacauuuaaagcuuucucagccaugccuaaaacuucucuauguuucuacauuguugaaagagaacacuguaagagcugcagcgaagaagacacaaaaaaaugugucaacacaaaacuugagcaaccacaaagcauuuugaucgaacacaagggaacuauaaucggaaagcaaaacagcacuugcacagccaaggcgaguugcugguuagagucagucaaaaguuuuuuuuauggucuaaagaacaugcuuagugguauuuuuggcaauguuuuuauagguauuuucuuguuccuuggccccuucaucuuguuaauacuauucuuuauguuuggguggaggauccuauuuugcuuuaaauguuguagaagaacuagaggccugcucaaguauagacaccucaaggaagaugaagaaacugguuauagaaggauuauugaaagacuaaacaauaaaaaaggaaaaaacaaacugcuugauggugaaagacuugcugauagaagaauugccgaacuguucucuacaaaaacacacauuggc

SEQ ID NO: 3831 - RNA, 2916 nt, Artificial Sequence
  derived and/or modified CDS sequence (wt) from CCHFV(ROS/HUVLV-100, Artificial)__DQ206448.1__Gn-4aa-Gc
uccgaggagccaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauaccaucaacagggugaagucauucaagcuaugcgaaaacagcgccacagggaaaaccugugagauagacagcacuccgguuaagugcaggcaagguuuuuguuuaaaaaucacccaagagggaaggggccacguaaaauuaucuagaggcucagagguuguuuuggaugcuugcgacucaagcugcgaaguaaugauaccuaaaggcacuggagauauccugguggacuguucagguggacagcaacauuucuuaaaagacaacuuaauugaccuagggugcccccauaucccgcuauuggguaaaauggccauuuacaucugcagaaugucaaaucauccuagaacaacuauggcuuuucucuucugguucagcuuuggcuaugugaucaccuguauauuuugcaaggcucuuuuuuauucauugauaauuauugggacacuagggaaaaagaucaagcaauauagggaauugaaaccucaaacuuguaccauaugugagacagccccugucaaugcaauagacgcugaaaugcaugaccuuaacugcaguuacaauauaugcccuuauugugcaucaagauugaccuccgaugggcuagcuaggcaugugccacaaugccccaagcggaaggaaaaaguugaggagacugagcuguacuugaaccuggaaagaauuccuuggauugucagaaagcuauugcaagugucagaguccacugguguggcauugaaacgaagcagcuggcugauuguacugcuuguguuacucacaguuucauugucaccgguucaaucagcaccuguugguagaaaaccucuguucuuagacaguauaguuaaaggcaugaagaauuugcuaaacucaacaagcuuagaaacaagccuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguagaagaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcuggggaguaggaacuggcugcaccugcugcgggguggauguaaaagaccuuuuuacagaucacauguuugucaaauggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacauugcaucccaaaguugaagagggcuucuuugacuugaugcaugugcaaaaagugcugucugcaaguacaguguguaaacugcagaguugcacacaugguauaccaggagaucuacaaguuuaccauauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacaucgaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcauaccaagaaaguugagauaucaggcuuaaaauuugcaagucuggcuugcacggguugcuaugcuuguagcucuggcaucuccuguaaagucaggauucauguagaugagccagaugagcucacaguacauguaaagagcagugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaaugauacuugcacagccaaggcaagcuguuggcuagagucagucaagaguuuuuuuuauggauugaaaaauaugcuugguaguguauuugguaauuuuuucauaggcauuuuguuauuccuugccccuuuuguccuguuggugcuuuucuuuauguuuggauggaaaaucuuguuuugcuucaaauguugcaggaggaccagaggcuuacuuaaguauagacuccucaaagacgaugaggaaacaggcuacagaaggauuauugaaagacugaacaacaaaaagggaaaaaacagacugcuugauggugaaagguuggcugauaggaaaauugcugagcuguucuccacaaaaacacacauuggu

SEQ ID NO: 3832 - RNA, 2916 nt, Artificial Sequence
  derived and/or modified CDS sequence (wt) from CCHFV(AP92, Artificial)__DQ211625.1__Gn-4aa-Gc
ucagaagggggugauggaggcugcaucucaagaacucaacugauaaaaacagaaacugcggaggugcacggagacgauuacgguggaccuggcgagaaaauuaccaucugcaaugguucaaccaucguugaucagagguuagguagugaacugggguguuacacaauuaacagaauaaaaucuuucaaacuaugcgagaauagugcccagggcaagaacugugagauagacagugcaccaguacaaugcaggcaagguuauugcuugaaaauuagucaagagggaagaggacaugugaaacuuuccagggguucagaaauuguucuagauguuugugacacaagcugugagauaaugauuccuaagggcacaggugacaucuuaguagacugcucaggagggcagcagcauuuucuacagagcaacuuaguugaccuggguuguccgaacauuccgcugcugggcaagauggcuauuuauauuugcagaaugucaaaucacccuaaaacaaccauggcuuuccuuuuuugguucagcuuuggcuacgugaucacuuguauauugugcaagacacuuuuuuacauacuuauaauuauugggacauuagggaaaaaauuaaagcaguacagagagcugaaaccccaaacauguaccauaugugaaucaguaccgguuaaugcaauagaugcugaaaugcaugaccucaacugcagcuacaacauaugcccuuauugugccuccagacucaccucagaggggcucacuagacaugugaaccagugccccaaaaggaaagagaagguagaagagacagaguuauaccugaaccuggaaaggauccccuggauuguuaggaagcuccuacagguaucugagucaacagguguggccuuaaaaagaagcagcuggaugaucgugcuccucauauuacugauagucucuaugucaccgguucaaucugcaccaauaaguaggaaaccacuuuuuuuggauagcauagcuaaagguguuaagaaccucuugaacucaacaagccuggaaacuagcuugucaauugaagcaccauggggggccaucaaugcccaaucaacuuacaaaccaacugcaucaagugcuaauauugcucuaacauggagcucaguggaacacaggggcaacaagaucuuggucucaggcaggucugaaucaauuaugaaacuugaagagaggaccggaauaagcuggaacuugggcguugaagaugcuucugagucaagaacacucaccaucuccgucauggaucuaucacagauguauuccccugucuuugaguaccugucaggagaucgucagguggaggaauggccaaaggcaaccugcacuggcaacugcccggagagaugcggcugcacaucgucaaccugccuuuacaaggaguggccacauucgagaaacuggagaugcaaccccaccugguguugggggguugggacuggcugcacaugcuguggacuagaugucaaagaacuguucacggaucacaugcuaguaaaauggaaaguugaguacaucaagacagaggccauaguguguguugagcuuaccagucaagaaaggcagugcaguuugauugaagcagguacgagauuuagcuuaggaccaguaacaaucaccuugucugagccaaggaacauucagcagaagcuuccuccugaauuaauuacauuacacccaaagauagaagacggcuacuuugacuuaaugcauguucaaaagguuauguccgccaguacagugugcaagcugcaaaguugcacacacggugugcccggggacuugcaaauuuaucauguuggcaaucuguugaagggggacagagugaaugggcaccugauccacaagguugagccacaccugaacacauccuggaugucgugggaugguugugacuuagacuauuucugcaauaugggggacuggcccuccugcacauacaccggggugacacaacacaaucaugccgcauuugcaaaucugcuuaacauugaaaccgacuauacaaagacuuuccauuuccacuccaaaagagugacggcccauggagacacaccacagcuggacuugaaggcaaggccuagguauggugcaggugaaaucacuguucugguugaaguagcugauauggaguuacauacaaagaaggucgagguaacaggcuuaaaauuugcaagccuaacuuguucaggaugcuaugccuguaguucagguaucuccugcaagguuagaauacauguggacgagccagaugagcucacagugcaugugaaaagcagcgacccagacauuguggcagccagcucaagucucauggcaaggaagauugaguuugggguugacaguacuuucaaagcguucuccucuaugccuaaagauucucugugcuuuuauauugucgaaagagacuauugcaacagcugcaaaaaugaggaaacacagaggugugugaacgcaaagcuugaacagccacagagcauccucaucgaacauacagguacaaucauuggcaagcagaacgacaccuguggaucuaggacaagcugcuggcuagacucauuuaaaaguuucuuuuauggacuaaagagcauguugagcggcauuuuugguaaugucuuucuaggcaucuucuuguuucuugcccccuuugcucugcugcuguuuuucuuuuucuuuggauggagaauccuguuuugcuuuaagugcuguagaagaaccagaggccuguuuaaauacagacacaucaaggacgaugaagagguuggcuacaaaaaaaucaucgaaagacugaacaauaaaaaaggcaaacacagacuucuugacggcgagagacuugcagauaggaagaucgcugaacuuuucucaacuaagacacacauugga

SEQ ID NO: 3833 - RNA, 2916 nt, Artificial Sequence
  derived and/or modified CDS sequence (wt) from CCHFV(ArD8194, Artificial)__DQ211626.1__Gn-4aa-Gc
gcagagggggggagcaaugauuguguuucaagaacccagcuagucaaaacagagguugcagaaauucaugaagacaguuacggugguccuggcgaaaaaaucacaauuugcaacggcuccacaauaguggaucaaaggcuuggcagcgaauuagguugcuauacaauaaacagagugagaaccuauaagcucugugagaacagugccacagaaaagagcugugaaauagacaguguuccaguuaaaugcaaacagggguucugccucaaaauaacucaggaagguaggggccaugugaaauugucuagagggacagaaaucguuuuggaugucugugauacuagcugugaacugaugauacccaaaggcacuggggauauauugguggacugcucaggagggcagcaacacuuuuuacaggacaaucuaauugacuugggaugcccaaauauuccauugcuaggucgaacagcuauauauguuuguagaaugucaaaccaucccaagacaaccauggcuuuucuguuuugguucaguuuuggcuaugucaucacauguguagugugcaaggugcucuucuauuugcuaauugucaucgggacacuaggaaaaaggcugaaacaguacagagagcuaaagccucaaacauguauugucugugaaucuaucccugucaaugcaauagaugcugaaaugcacgaucuuaacugcaacuacaacauaugcccuuacugugcauccagacugaccucagauggucucgucaggcacguaacucaaugucccaaacggaaagagaaggucgaagaaacugaacuauacuuaaaccuggagagaauaccuugguuggugagaaaacuccuacaagugucggagucaacaggaguggcucuaaagagaagcugcuggaugaucacacuccuuauucugcugacuguuucaaugucaccaguucaguccgcaccaguaggcagaaaaccacuuuucuuagauagaauagccaagggaaugaaaagcuuguugaacuccacaaguuuagaaacgagcuugucaauugaagcuccauggggggcaaucaauguucaaucaacuuucaaaccaacaguuucagccgccaauauagcacuuagcuggaguucaguugaacacaagggcaacaagaucuuaguuucaggcagaucagagucaauuaugaaauuagaagaaagaacuggaaucagcuggugucuagguguggaagaugccucugagucaaaaacacucaccguuucuguuauggaucugucucaaauguauucuccuguuuucgaguaccugucaggugaccgacagguggaggaguggccaaaagcaaccugcacaggugacuguccagaaagauguggcugcacuucaucaaccugccugcauaaggaguggccgcacucgaggaacuggcgcuguaaccccacuugguguuggggggugggaacuggcugcaccugcugugggcuagauguaaaggaucucuucacagacuacauguugguuaaauggaaaguggaauauauaaaaacagaagccauaauauguguugagcuuacuagucaagagaggcaguguaguuuaauugaagcaggcacaagguuuaaccuaggcccugugacaauaacucuaucagaaccaaggaacguacagcagaggcuuccucccgagaucaucacacugcacccuaaaauagaagaaggguuuuuugauuugaugcauguacagaagguaaugucugcaagcacgguuuguaagcugcaaagcuguacucauggugugccuggagacuuacaagucuaccauguuggcaacuuguuaaagggggacaaagucaaugggcacucaauccacaagauagaaucacaccucaacaccucauggaugucaugggaugggugugauuuagacuauuuuugcaacaugggggacuggcccucaugcacauacacaggggugacacaacacaaccaugcugcauucaucaacaugcuuaacauugagacugauuacacaaaaaccuuucacuuucauucaaaaagggucacagcacacggagacaccccucaguuggaccuaaaagcgagaccagcauauggugcaggcgaaaucacuguucuaguagaaguugcagauuuagaacugcacacgaagaaaauugaagugucgggucugaaauucgcaaguuugucaugcuccggauguuaugcuugcagcucuggcaucuccugcaaaguuaggauucauguaaaugaaccggaugaauucacaguacauguaaaaaguaaugacccagauguuguagcagcaggaucaagucucauggcuagaaagauagagucuggggccgacagcacguuuaaggcuuuuucaucaaugccaaaaaacucucuauguuuuuacauaguagaaagagauuauuguagcagcuguacagaugaugacacucagaaauguguugacauuaaacuugaacauccacagagcauacucauugaacacaaaggaacgauuauuggcaagcagaaugacaccuguccaacuaaaacaagcugcugguuggaaucuauuaagaguuuuuuuuaugggcuuaaaaacaugcugagugggaucuucgguaauguuuucuuaggcaugcuccuguuucuugcuccuuuuauauugcuaauauuguuuuucuucuucggguggagacuucucuuuugccuuaagugcuguagaaggaccagaaagcugcuaaaguauaagcaccuuagggacgaagaagagagugguuacaaaaaaaucauugaaaggcuaaaugacaaaaaaggcaaaagucgauuguuugauggagaaaggcuugcagacagaaagauugccgaacucuuuucaacuaaaacucauauaggu

SEQ ID NO: 3834 - RNA, 2916 nt, Artificial Sequence
  derived and/or modified CDS sequence (wt) from CCHFV(ArD15786, Artificial)__DQ211627.1__Gn-4aa-Gc
gcagagggggggagcaaugacuguguuucaagaacccagcuagucaaaacagagguuacagaaauucaugaagacaguuacggugguccuggcgaaaaaaucacaauuugcaacggcuccacaauaguggaucaaaggcuuggcagcgaauuagguugcuauacaauaaacagagugagaaccuauaagcucugugagaacagugccacagaaaagagcugugaaauagacaguguuccaguuaaaugcaaacagggguucugccucaaaauaacucaggaagguaggggucaugugaaauugucuagagggacagaaaucguucuggaugucugugauacuagcugugaacugaugauacccaaaggcacuggggauauauugguggacugcucaggagggcagcaacacuuuuuacaggacaaucuaauugacuugggaugcccaaauauuccauugcuaggucaaacggcuauauaugucuguagaaugucaaaccaucccaagacaaccauggcuuuucuguuuugguucaguuuuggcuaugucaucacauguguagugugcaaggugcucuucuauuugcuaauugucaucgggacacuaggaaaaaggcugaaacaguacagagagcuaaagccucaaacauguauugucugugaaucuaucccugucaaugcaauagaugcugaaaugcaugaucuuaacugcaacuacaacauaugcccuuacugugcauccagacugaccucagauggccucgucaggcacguaacucaaugucccaaacggaaagagaaggucgaagaaacugaacuauacuuaaacuuggagagaauaccuugguugguaagaaagcuccuacaagugucggagucaacaggaguggcucugaagagaagcugcuggauaaucacacuccuuauucugcugacuguuucaaugucaccaguucaguccgcaccgguaggcagaaagccacuuuccuuagauaguauagccaagggaaugaaaagcuuguugaacuccacaaguuuagaaacgagcuugucaauugaagcuccauggggggcaaucaauguucaaucaaccuucaaaccaacaauuucagccgccaacauagcacuuagcuggaguucaguugaacacaagggcaacaagaucuuaguuucaggcagaucagagucaauuaugaaauuagaagaaagaacuggaaucagcuggugucuagguguggaagaugcuucugaaucaaaaacacucacuguuucuguuauggaucugucucaaauguauucuccuguuuucgaguaccugucaggugaccgacagguggaggaguggccaaaagcaaccugcacaggugacuguccagaaagauguggcugcacuucaucaaccugccuacauaaggaguggccgcacucgaggaacuggcgcuguaaccccacuugguguuggggggugggaaccggcugcaccugcugugggcuagauguaaaggaucucuucacagacuacauguugguuaaauggaaaguggaauauauaaaaacagaagccauaauauguguugagcuuacuagucaagagaggcaguguaguuuaauugaagcaggcacaagguuuaaccuaggcccugugacaauaacucuaucagaaccaaggaacguacagcagaggcuuccccccgagaucauuacacugcacccuaaaauagaagaaggguuuuuugauuugaugcaugugcagaagguaaugucugcaagcacgguuuguaagcugcaaagcuguacucacggugugccuggagacuuacaagucuaccauguuggcaacuuguuaaagggggacaaagucaaugggcacucaauccacaagauagaaucgcaccucaacaccucauggaugucaugggaugggugugauuuagauuauuuuugcaacaugggggacuggcccucaugcacauacacaggggugacacaacacaaccgugcugcauucaucaacaugcuuaacauugagacugauuacacaaaaacuuuucacuuucauucaaaaagggucacagcacacggagacaccccucaguuggaccuaaaagcgaggccaacauauggugcaggcgaaaucacuguucuaguggaaguugcagauuuagaacuacacacgaagaaaauugaagugucgggucugaaauucgcaaguuugacaugcucuggauguuaugcuugcagcucuggcaucuccugcaaaguuaggauucauguaaaugaaccggaugaauucacaguacauguaaaaagcaaugacccagauguuguagcagcaggaucaagucucauggcuagaaagauagagucuggggccgacagcacguuuaaggcuuuuucaucaaugccaaaaaacucucuauguuuuuacauaguagaaagagauuauuguagcagcuguacagaugaugacacucaaaaaugcguugacauaaaacuugaacauccacaaagcauacuuauugaacacaaaggaacgauuauuggcaagcaaaaugacaccuguccaacuaaaacaagcugcugguuggaaucuaucaagaguuucuuuuaugggcuuaaaaauaugcugagugggaucuucgguaauauuuucuuaggcaugcuccuguuucuugcuccuuuuguauugcuaauauuguuuuucuucuucggguggagacuucucuuuugccuuaagugcuguagaaggacuagaaagcugcuaaaguauaagcaccuuagggacgaagaagagagugguuacaaaaaaaucauugaaaggcuaaaugacaagaagggcaaaagucgauuguuugauggagaaaggcuugcagacagaaagauugccgaacucuuuucaacuaaaacucauguaggu

SEQ ID NO: 3835 - RNA, 2916 nt, Artificial Sequence
  derived and/or modified CDS sequence (wt) from CCHFV(ArD39554, Artificial)__DQ211628.1__Gn-4aa-Gc
ucagaaagcaacaacaaugauugcguaucaaggacucagcugaucaagacagaaaaugcugaaauacauggugaugacuauggcgggcccggagagaaaauaaccaucugcaacggcucuacuauuguagaacaaagauuaggcagcgaauuaggaugcuacacuaucaacagaauaaaguccuucaaacuaugcgaaaauagugcuucaggaaaggguugugaaauugacaguacuccaguaaaauguaagcaaggcuucuguuugaaaauaacccaagaaggaaggggucauguuaaacuuuccagaggcucagagauaauucuagacguuugcgacucaagcugugaaaugaugauaccaaaagggucuggugauauccugguagauugcucuggaggacagcagcacuuccuacaggacaacuuggucgacuuaggaugcccaaacguuccccuacugggcaaaauggccauauacaucugcagaaugucaaaccaccccaagacaaccauggccuuccucuuuugguucagcuuuggcuaugucauaaccugcaucuuuugcaagguuaucuuuuaugugcuaauaauaauuggaacauuaggaaaaaggaucaaacaguacagagagcuuaagccucagaccugcacuauaugugaagcaacuccuguuaaugcaauagaugcugaaaugcaugaucuuaacuguagcuacaacauaugcccuuauugcgcaucuagauuaacuucagaaggucugguuaggcaugugacucaguguccuaagaggaaggaaaagauagaggaaacagagcuguacuuaaauuuggaaaggauacccugguuugucagaaagcucuugcagguaucagaaucaacagggguagcgcucaagagaagcagcuggcuggugacacuucuuguguugcuaacaguaucuuugucgccugugcaaucagcacccauugguagaaagccacuuuuuuuggacaguacugccaagagcaugaaaagccuguuaaauucaacaaguuuggaaacaagccugucaauugaagcacccuggggggcaauuaauguacagucaacuuucaaacccaccgcuucgacugcaaauauagcgcucaguuggagcucaguagaacacagaggcaauaagauucuuguuacagguagaucagagucgauuaugaaacuggaagaaagaacaggaaucaguuggaaucucgguguggaagaugcuucugaaucaaagacacucacuguaucagucauggacuuaucucagauguauuccacugucuucgaguacuuaucaggcgaccggcaaguagaggaguggccuaaagcaaccugcacaggugauuguccagaaagauguggcuguacaucaucuacuugccuccacaaggcguggccccauucaaggaacuggaggugcaaccccacgugguguuggggaguuggaacugguugcacuugcuguggauuggaugugaaaaaccucuuuacugacuauaugcuuaucaaauggaaaguugaauuuauaaaaacugaagccauaguguguguugaacucacaagccaggaaaggcaaugcagucuuauagaagcaggcacaagauuuaacuugggcccuguuaccaucacuuuaucagaaccaagaaacauucagcagaagcucccuccugaacugguuacgcugcauccaagaguagaagaaggcuucuucgaccuuaugcaugugcagaaagugcuuucugcaagcacuguguguaaauugcagagcugcacgcaugguguaccaggugacuugcaaguguaucauguaggcaacuugcugaaaggggauaaaauaaauggcaacucauuucacaaaauugagccgaaccuaaauacaucauggaugucuugggacggcugugaucuugauuacuacugcaacaugggagacuggcccuccuguacuuacacaggugugacgcagcacaaccaugcugcuuuugugaaccugcucaacauugaaacugacuauacaaagaacuuccacuuucacucaaagagagucacagcacauggagagacgccccagcuagaccuuaaagccagaccaaaguauggagcaggugaggucacaguccugguggaaguugcugacauggagcugcacacuaaaaagauugagauaucagguuugaaauuugcuagccugaccugcacgggcugcuaugcuuguagcucagguaucuccugcaagguuaggcuucauguagaugagccagaugagcucacgguacacgugaagagugaugauccggauguaguugcagccagcucaagccugauggccagaaaaauugaauuuggaacugauagcacauuuaaagcuuucucguccaugccuaaggauaaacucugcuuuuacauuguggaaagagacuacugcagcaguugcagcaaagaggacacacaaaaguguguaaaugcaaaacuugagcagccucagaguauacuuauugaacauaaaggcaccauaauugggaagcaaaaugacacuuguacagucaaggcgagcuguugguuggaaucgguaaaaaguuuuuuuuauggacuaaaaaacauguugggugguaucuucggcaacguuaucuugggcaucaucauguuccuugcuccuuuugccuuguuacugcucuucuuccuuuucggauggagaauucuguucugccuuagaugcugcagaaggacuagggggcuauuuaaguacaaacacaucaaagaugaugaagaaucaggcuacaaaaggauuauugaaagguuaaauaacaagaaagguaagaacaaguuauuugacggcgagagauuggcagacaagaaaauugcugaacuauucucaacgaagacacacauuggc

SEQ ID NO: 3836 - RNA, 2916 nt, Artificial Sequence
  derived and/or modified CDS sequence (wt) from CCHFV(C-68031, Artificial)__DQ211629.1__Gn-4aa-Gc
uccgaagagucuggugaugacugcauaucaagaacucagcuaucgaggacagagacugcggaaauucacagugauaacuauggugguccaggugacaagauaaccaucugcaaugguucaacuauuguagaucagagauugggcagugaacuaggguguuacacuaucaauagaguaaagucauuuaagcuuugcgagaacagugccacagguaaauccugugaaauagauagcaccccaauuaaaugcaggcaggguuuuuguuuaaaaauuacucaggagggaaggggccacgugaagcuaucaagagguucagaaguugucuuggacgccugugauucaagcugugagauaaugauaccaaagggcacuggagacauccuaguugacuguucagguggacagcaacauuucuuaaaagauaacuugauugaucugggaugcccaaacaucccacuauuagguaagauggcuaucuacauuuguagaaugucaaaucauccuaaaacgacuauggcuuuucuuuuuugguuuagcuuugguuaugugauaaccuguauacucuguaaggucaucuucuaccuauuaauaguuguggggacguugggaaaaaaguucaaacaguauagagaguugaaaccucagaccuguaccauaugcgaaacaacuccuguuaaugcaauagaugcugaaaugcacgaccucaacugcaguuacaauauauguccuuacugugcaucuagguuaaccucagacggucuugccagacauguaaugcagugcccuaagcggaaggaaaaaguagaagaaaccgaauuauacuuaaacuuagaaagaauccccuggguuguuaggaaauuacugcaggugucagaauccaccgguguggcacuaaagaggaguaguuggcugguugugcuacuuguguuacuuacaguuucauugucaccaguacaaucagcaccuaucggcaggaaacccuuguuuucagacaguauugucaaaggcaugaagaacuugcuaaauucaacaagcuuagaaacaagcuuaucaauugaggcaccauggggagcuauaaauguccaaucaaccuucaaaccuacuguguccgcugcgaacauagcucuuaguuggagcucaguggaacacagggguaauaagauuuugguuucagguagaucagagucaauuaugaagcuagaggaaaggacaggaaucagcugggaucuagggguagaagaugccucugagucuaaauugcuuacugucucuauuauggacuugucacagauguauucuccugucuuugaguaccuaucaggugauagacaaguggaggaauggcccaaggcaaccugcacaggagauugcccagaaagauguggcugcacaucaucaaccugccuacacaaagaauggccccauucaagaaacuggagaugcaaccccaccugguguuggggagucggcacuggauguaccugcugugggcuggauguaaaagaccuuuuuacagauuacauguuugucaaguggaaaguugaguacauuaaaacagaagcuauaguguguguugagcuuacuagccaagagagacaauguagcuugauugaggcaggcacaagauucaacuuagguccugugaccaucacauugucagagccaagaaacauucagcaaaagcucccuccagagauaguuacauugcaucccagaauugaagaagguuucuuugauuuaaugcauguaaaaaaagugcuaucagcaaguacaguauguaagcuacagaguugcacacauggugugccaggggaccuacaggucuaccacauaggaaacuuguuaaaaggagacaaggugaaugggcaccugauucacaaaauugaaccacacuucaacacuuccuggaugucuugggacggcugugaccuagacuacuacuguaauaugggggacuggccaucuugcucauauacuggaguaacccagcacaaucaugcugcauuuguaaacaugcucaacaucgaaacugauuauacaaaaaucuuccacuuucacucuaagagaguuacugcacauggagacacaccacaauuagauuugaaagcuagaccaacuuauggugcaggugaaaucacugugcuaguggaaguugcugacauggaguuacacacaaagaaaauugagauaucagguuuaaaguuugcaagcuuaacuugcacaggcuguuaugcuuguagcucugguaucuccuguaagguuagaauccauguagaugagccugaugagcuuacaguacaugugaagagugaagacccagacauaguugcugcuagcucaagucucauggcuagaaaacuugaauuugggacagauagcacauucaaagccuuuucagccaugcccaaaaccuccuugugcuuuuacauuguggagagagaauauuguaaaagcugcaguaaagaagauacacaaaaaugugucaacacaaagcuugagcaaccacagagcauuuuaauugagcacaaaggaacgauaauugguaagcaaaacgacaccugcacaucuaaagcaggcuguuggcuagagucagucaagagcuucuuuuaugggcuaaaaaacaugcuuaguggcauuuuuggcaauguuuucauagggauuuucuuauuccuugcuccuuuuauccuuuuaauacuuuucuuuauguuuggauggagaauccuguucugcuuuaaauguugcagaagaacuagaggccuauuuaaguacagacaccucaaggacgaugaagaaaccgguuacaggaaaaucauugagaggcugaacaacaaaaaagggaaaaacaaacugcuugauggugaaagauuagcugauaggaagauugcugagcuguucuccacaaagacacacauuggc

SEQ ID NO: 3837 - RNA, 2916 nt, Artificial Sequence
  derived and/or modified CDS sequence (wt) from CCHFV(Drosdov, Artificial)__DQ211630.1__Gn-4aa-Gc
ucugaagagccaggugacgacugcauaucaagaacucagcuauugaagacagaaacagcagagauccaugacgacaacuauggugguccaggugacaaaauaacuaucugcaaugguucaaccauuguggaucagagacugggcagugaacuaggguguuauaccaucaacagggugaagucauucaagcuaugcgaaaacagugccacagggaaaaccugugagauagacagcacuccggucaagugcaggcaagguuuuuguuugaaaaucacccaagagggaaggggccacguaaaauuauccaggggcucagagguuguuuuggaugcuugcgacucgagcugugaaguaaugauaccuaaaggcacuggagauauccuaguagacuguucagguggacagcagcauuucuuaaaagacaacuugauugaccuagggugcccucauaucccgcuauuggguaagauggccauuuacauuugcagaaugucaaaucaucccaggacaaccauggcuuuccucuucugguucaguuuuggcuauguaaucaccuguauauuuugcaaggcucuuuuuuacucauugauaauuauugggacacuagggaaaaaaaucaagcaauauagggagcugaaaccucaaacuugcaccauaugugagacagcuccugucaaugcaauagaugcugaaaugcaugaccucaaauguaguuacaauauaugcccuuauugugcaucaagauugaccucugaugggcuagcuaggcaugugacacaaugcccuaagcgaaaggagaaaguugaggagacugaacuguacuugaaccuggaaagaauuccuuggauagucagaaagcuauugcaagugucagaguccacugguguagcauugaaacgaagcaguuggcugauugugcugcuuguguuacucacagucucauugucaccgguucaaucagcaccuguugguaggaaaccucuuuucuuagacaguacaguuaaagguaugaaaaauuugcuaaacucaacaagcuuggaaacaagcuuaucaauugaggcaccauggggagcaauaaauguccagucaaccuuuaaaccaacaguaucgacugcaaacauagcacucaguuggagcucaguggagcacagaggcaacaagaucuuggucacaggcaggucugaaucaauuaugaaacuagaggaaaggacaggagucagcugggaucuaggcguagaagaugccucugaauccaaauuacuuaccgucuccaucauggauuugucacaaauguauuccccuguuuuugaguacuuaucaggagauagacagguugaagaauggcccaaggcaaccuguacaggugauugcccagaaagguguggcugcacaucaucaaccugcuugcauaaagaauggccucacucaagaaacuggagauguaaccccacuuggugcuggggaguaggaaccggcugcacaugcugcggaguggauguaaaagaccuuuuuacagaucacauguuugucaaauggaagguugaauauaugaaaaccgaagccauaguauguguugagcucaccagccaagaaagacagugcagucugauugaggcagguacuagauucaacuuggguccugugacuaucacccugucugagccaagaaacauucagcagaagcuucccccugagaucauuacgcugcaucccaaaauugaagaaggcuucuuugacuugaugcauguacaaaaaguguuaucugcaaguacaguguguaaacugcagaguugcacacaugguauaccaggagaucuacaaauuuaccacauuggcaacuuguugaaaggggauagaguaaacgggcaucuaauucacaaaauugaaccacauuuuaacaccucuuggauguccugggaugguugugaccuagacuacuauugcaacauggggaauuggccuucuugcacauacacaggagugacccaacauaaucaugcugcauuuguaaauuugcuuaacauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaagaaaguugagauaucaggcuugaaauuugcaagucugguuugcacggguugcuaugcuuguagcucuggcauuuccuguaaagucagaauucauguagaugaaccagaugagcucacagugcauguaaagagcagugauccagaugugguugcagcuagcacaagccuuauggcaaggaagcuugaauuugggacagauagcauauucaaggcauuuucagcuaugcccaaaaccucuuuaugcuuuuacauuguggagagggaauacugcaagagcugcagugaagaugauacaaaaaaauguguugacacaaaacuugagcagccacagagcauacuaauugagcacaaagggacgauaauuggaaagcagaaugauacuugcacagccaaggcaaguuguuggcuagagucagucaagaguuuuuuuuauggauugaagaauaugcuuggcaguguuuuugguaauuuuuucguaggcauuuuguuauuccuugccccuuuugucuuguuggugcuuuucuuuauguuuggauggaaaaucuuguuuugcuuuaaguguugcaggaggaccagaggcuuguuuaaguauagacaccucaaagacgaugaggaaacaggcuacagaaggauuauugaaagacugaauaguaaaaaaggaaaaaacagacugcuugauggugagagguuggcugauaggaaaauugcugagcuguucuccacaaaaacacacauuggc

SEQ ID NO: 3838 - RNA, 2916 nt, Artificial Sequence
  derived and/or modified CDS sequence (wt) from CCHFV(Kashmanov, Artificial)__DQ211631.1__Gn-4aa-Gc
uccgaggagccaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauaccaucaacagggugaagucauucaagcuaugcgaaaacagcgccacagggaaaaccugugagauagacagcacuccgguuaagugcaggcaagguuuuuguuuaaaaaucacccaagagggaaggggccacguaaaauuaucuagaggcucagagguuguuuuggaugcuugcgacucaagcugcgaaguaaugauaccuaaaggcacuggagauauccugguggacuguucagguggacagcaacauuucuuaaaagacaacuuaauugaccuagggugcccccauaucccgcuauuggguaaaauggccauuuacaucugcagaaugucaaaucauccuagaacaacuauggcuuuucucuucugguucagcuuuggcuaugugaucaccuguauauuuugcaaggcucuuuuuuauucauugauaauuauugggacacuagggaaaaagaucaagcaauauagggaauugaaaccucaaacuuguacuauaugugagacagcuccugucaaugcaauagacgcugaaaugcaugaccuuaacugcaguuacaauauaugcccuuauugugcaucaagauugaccuccgaugggcuagcuaggcaugugccacaaugccccaagcggaaggaaaaaguugaggagacugagcuguacuugaaccuggaaagaauuccuuggauugucagaaagcuauugcaagugucagaguccacugguguggcauugaaacgaagcagcuggcugauuguacugcuuguguuacucacaguuucauugucaccgguucaaucagcaccuguugguagaaaaccucuguucuuagacaguauaguuaaaggcaugaagaauucgcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguagaagaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcuggggaguaggaacuggcugcaccugcugcgggguggauguaaaagaccuuuuuacagaucacauguuugucaaauggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcaugugcaaaaaguguugucugcaaguacaguguguaaacugcagaguugcacacaugguauaccaggagaucuacaaguuuaccacauuggcaacuugcugaaaggggauaggauaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacauugaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcauaccaagaaaguugagauaucaggcuugaaauuugcaagucuggcuugcacggguugcuaugcuuguagcucuggcaucuccuguaaagucaggauucauguagaugagccagaugagcucacaguacauguaaagagcagugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaaugauacuugcacagccaaggcaagcuguuggcuagagucagucaagaguuuuuuuuauggauugaaaaauaugcuugguaguguauuugguaacuuuuucauaggcauuuuguuauuccuugccccuuuuguccuguuggugcuuuucuuuauguuuggauggaaaaucuuguuuugcuucaaauguugcaggaggaccagaggcuuacuuaaguauagacaccucaaagacgaugaggaaacaggcuacagaaggauuauugaaagacugaacaacaaaaaaggaaaaaacagacugcuugauggugaaagguuggcugauaggaaaauugcugagcuguucuccacaaaaacacacauuggu

SEQ ID NO: 3839 - RNA, 2916 nt, Artificial Sequence
  derived and/or modified CDS sequence (wt) from CCHFV(Oman, Artificial)__DQ211632.1__Gn-4aa-Gc
uccgaagagucuggugaagacuguauaucaaggacucagcuauugaggacagaaacugcagaaauccauggugauaacuauggugguccaggugacaaaauaaccaucugcaaugguucaaccauuguagaucaaaggcuggguagugaacugggguguuacacuaucaauagggugaagucauuuaagcuaugcgaaaacagugccacagguaaguccugugaaauagauaacacuccaguaaaaugcaagcaagguuuuugcuugaaaauaacccaagaaggaaggggccacgugaagcuuucaagagacucagaaguuguccuggacgccugcgauucaagcugugaaauaaugauaccaaagggcacuggagacauccugguugacugcucaggugggcagcagcacuucuuaaaagacaaccugauugaucugggaugccccaacaucccauuauuaggcaaaauggcaaucuacauuuguagaaugucaaaucauccuaaaacaacuauggcuuuucuuuuuugguuuagcuuugguuaugugauaaccugcauacuuuguaaagucauuuuuuaucuauugauaguuguuggaacuuuagggaaaaaguuuaaacaguauagagaguuaaaaccucagaccugcacaauaugugaaacaacuccugucaaugcaauagaugcugagaugcacgaucucaauuguaguuacaauauauguccuuauugugcaucuagguuaacuucagauggucuugccagacauguaaugcaguguccuaagcggaaggaaaaaauagaagaaaccgaauuauaccugaacuuagaaagaaucccuuggguugucagaaaacuacugcaggugucagaauccacugguguagcacuaaagaggagcaguuggcugauugugcuacuugugcuucucacaguuucauugucaccaguacaaucagcaccuaucgguagaaagcccuuauuuuuagacaguauugcuaagggcaugaagaaccugcugaauucaacaagcuuagaaacaagcuuaucaauugaggcaccauggggagcaauaaacguucaaucuacuuucaaaccuacugugucaacugcaaacauagcacuuaguuggagcucaguggaacacagagguaauaagaucuugguuucaggcagaucagagucaaucaugaagcuagaagaaagaacaggaaucagcugggauuugggaguagaagaugccucugaguccaaauuacuuacuguuuccgucauggacuuaucacagauguacucuccugucuuugaguaccuaucaggugacagacaaguagaggaauggccaaaggcaaccuguacaggcgauugcccggaaagauguggcugcacaucaucaaccugccuacacaaggaauggccucacucaagaaacuggagaugcaaccccacuugguguuggggagucggcaccggaugcaccuguuguggacuagauguaaaggaccuuuuuacagauuacauguuuguuaaauggaaggucgaauauauaaaaacagaggcuauaguguguguugagcuuacuagccaagaaagacaauguagcuugauugaggcaggcacaagauucaacuuagguccugugacuaucacauuaucagagccaagaaacauucagcaaaagcucccuccagaaauugucacauuacauccuagaauugaagaagguuuuuuugacuuaaugcauguacagaagguacuaucagcaagcacagugugcaagcuacagaguugcacacauggcguaccaggagacuuacaggucuaccacaucggaaacuuacuaaaaggagacaaagugaacgggcaucugauacauaaaguugaaccacauuucaacaccuccuggaugucuugggacggcugugaccuagauuacuacugcaauaugggggauuggcccucuugcacguauacuggaguuacccaacauaaucaugcugcauuuguaaaccuacuuaacauugaaacugauuacacaaagaacuuccacuuucacucuaagagagucacugcacauggggacacuccacaauuagauuuaaaagccagaccaaauuauggugcaggugaggucacugugcugguggaaguugcugacauggaguuacacacaaagaaaauugagauaucagguuugaaguuugcaagccuaacuugcacagguuguuaugcuuguagcucuggcaucucauguaagguuaggauccauguagaugaaccagaugagcuuacaguacaugugaagagugaagacccagacauaguugcugcuagcucaagucucauggcaagaaagcuugaauucgggacggauaguacauucaaagccuucucagccaugccuaaaaccuccuugugcuuuuacauuguugagagagaauacuguaaaagcugcaguaaagaagacacacaaaaguguguuaacgcaaagcuugagcgaccacagagcauuuuaauugagcacaaaggaacgauaauuggaaagcagaacgacacuugcacagcuaaagcaagcugcuggcuagagucagucaagaguuucuuuuauggacuaaagaacaugcuuaguggcauuuuuggcaauguuuucauagggauuuucuuauuccuugcuccuuuuauccuguuaauacuuuucuuuauguuuggguggagaauccuauucugcuuuaagugcugcaggagaacuagaggccuauuuaaguacagacaccucaaagaugaugaagaaaccgguuauaggaaaaucauugagagacuaaacaacaaaaaagguaaaaacaagcugcuugacggugaaagauuagcugauagaaagaucgcugagcuguucucuacaaaaacacacauuggc

SEQ ID NO: 3840 - RNA, 2916 nt, Artificial Sequence
  derived and/or modified CDS sequence (wt) from CCHFV(SPU97/85, Artificial)__DQ211633.1__Gn-4aa-Gc
uccgaggagucugauggugacuguauaucaagaacucaacuauugaggacagagacugcagaaauccacagugacaacuaugguggcccaggugacaaaauaacuaucugcaaugguucaacuauuguagaucaaagacuaggcagugaacugggguguuauacuaucaauaggguaaagucauuuaagcuuugcgaaaacagugccacaggaaaaucuugugaaauagauagcaccccaguuaagugcagacaagguuuuugcuugaaaaucacucaagaagggaggggccacgugaagcugucgagaggcucagaaauugucuuggacgccugcgauucaagcugugaaauaaugauaccaaagggcaccggagacaucuuaguugacuguucagguggacaacaacauuucuuaaaagauaauuugauugaucuuggaugucccaauaucccauuauuaggcagaauggccaucuacauuugcagaauguccaaucauccuaaaacaaccauggccuuucucuuuugguuuagcuuugguuaugugauaaccuguauccuuuguaaggugaucuuuuaccuauugauaguugcagggacaguagggaaaaaguucaaacaguauagagaguugagaccucagaccugcaccauaugugaaacaacuccugucaaugcaauagaugcugaaaugcaugaccucaacugcaguuacaauauauguccuuauugcgcaucuagauuaaccucagauggucuugccagacauguaaugcaaugccccaagcggaaggaaaaaauagaggaaacugaauuauacuuaaaccuagaaaggauucccuggguuguuaggaaauuauugcaaguuucagagucuaccgguguggcauugaagaggagcaguuggcugacagugcugcuuguguugcuuauaguuucauugucaccggugcagucagcaccuauugguagaaaacccuuauuuuuagacaguauuguuaaaggcaagaagaacuugcuaaacucaacaagcuuggaaacaagcuuaucaauugaagcaccauggggugcaauaaauguccaaucaaccuucaaaccuacugugucagcugcaaacauagcacuuagcuggagcucaguggaacacagaggcaacaagauuuugguuucaggcaggucagaaucaaucaugaagcuggaggaaaggacaggaaucagcugggaucugggaguagaagacgccucugaguccaaauugcucaccgucucugucauggacuugucacagauguauucccccgucuuugaguaccugucaggugauagacagguagaagaguggcccaaggcgaccuguacaggcgauugcccagaaagauguggcugcacaucaucaaccuguuugcacaaggaauggccccauucaaggaacuggagaugcaaccccacuugguguuggggggucggcacuggaugcaccuguuguggacuagauguaaaagaccucuuuacagauuacauguuugucaaguggaaaguugaauacauaaaaacagaggccauagugugcgucgaacuuacuagccaagaaagacaauguagcuugauugaagcaggcacaagauucaauuuagguccugugacuaucacauugucagagccaagaaacauucagcaaaagcucccuccagagauaaucacauugcauccuagaauugaagaaggcuuuuuugacuuaaugcaugugcaaaaagugcugucagcaagcacagugugcaagcuacagaguugcacacaugguguuccaggagaccuacaggucuaccacaucggaaacuuguuaaaaggagacaagguaaacgggcaucugauucacaagauugaaccacauuucaacacuuccuggaugucuugggauggcugugaccuagacuacuacugcaauaugggggacuggccuucuugcacauacacuggaguaacccaacauaaccaugcugcauuuguaaauuugcucaauaucgaaaccgauuauacaaaaaacuuucauuuucacuccaagagaguuacugcacauggagacacaccacaguuagacuugaaggccagaccaacuuauggugcaggggaggucacuguacuaguggagguugcugacauggaguugcacacaaagaaaauugagauaucaggcuugaaguuugcaagccuaucuugcacaggcugcuaugcuuguagcucugguaucuccuguaaggucaggauccauguagaugaaccagaugagcuuacaguacaugugaagagugaagacccagacauaguugcugcaggcucaagucucauggcaaggaagcuugaauuuggggcagauaguacauucaaagccuuuucagccaugcccaaaaccuccuugugcuuuuacauuguggagagagaauacuguaagagcugcaguagagaagacacacaaaaauguguuaacacuaaacuugagcgaccacagagcauuuugaucgaacauaaaggaacgauuauuggaaagcaaaacgacacuugcacagcuaaagcaagcugcuggcuagagucagucaaaaguuuuuucuacggauuaaagaguaugcuuaguggcauuuuuggcaacguuuucauagggauuuucuuauucauugcuccuuuuguccuguuaauacuuuucuuuauguuuggguggaggauucuguucugcuuuaagugcugcagaagaaccaggggccuauuuaaguacagacaccucaaggacgaugaagaaaccgguuacaggaaaaucauugagaggcuaaauaacaaaaagggaaaaaacaaacuacuugauggggaaaggcuagcugacaggaaaaucgccgaguuauucuccacaaaaucacauaucggc

SEQ ID NO: 3841 - RNA, 2916 nt, Artificial Sequence
  derived and/or modified CDS sequence (wt) from CCHFV(SPU103/87, Artificial)__DQ211634.1__Gn-4aa-Gc
uccgaggagucuagcgacgacuguauaucaagaacucaacuauugaggacagagacugcagagauccacggcgauaacuaugguggcccaggugacaagauaaccaucugcaauggcucaacuauuguagaccagagacuggguagugagcugggguguuacacuaucaauagaguaaagacauucaaacuaugcgaaaacagugcuacagggaagaguugugaaauagauagugucccaguuaaaugcaggcaggguuauugccuaaaaaucacucaggaaggaaggggucauguaaaauuaucuagaggcucagagguugucuuagaugcaugugacacaagcugugaaguaaugauacccaaaggcacuggugacauccuaguugacuguucaggugggcagcaacauuuucugaaagacaaucugauagaucuaggaugccccaaaauuccauugcuggguaaaauggcuauuuauauuugcagaaugucgaaucaccccaaaacaacuauggcuuuccucuucugguucagcuuuggcuaugugauaacuuguguacuuugcaaggccauuuuuuacuuguuaauaauuguuggaacacuaggaaaaaggcucaagcaguacagagaguuaaaaccucagaccugcaccauaugugagacaacuccugugaaugcaauagaugcugagaugcaugaccucaauugcaguuacaacauaugucccuauugugcaucuagacuaaccucagacgggcuugcuaggcaugugacacagugcccuaagcggaaggaaaaaguggaggaaacugaauuguacuugaacuuggaaagaauuccuuggguugugagaaggcuguugcagguaucagaguccacugguguggcauugaaaagaagcagcuggcugauugugcuacuggugcuguucacgguuucauugucaccgguucagucagcgcccauuaguagaagaccccuauucuuagauaauauaguuaaaggcaugaaaaauuugcuaaacucaacaaguuuggagacaaguuuaucaauugaggcaccauggggagcaauaaauguucagucaaccuacaaaccaacuguaucaacugcaaacauagcgcuuaguuggagcucaguagaacacagaggcaauaagauacugguuucgggcagaucagaaucaauuaugaagcuggaagaaaggacaggaauaagcugggaucucgguguagaagacgccucugagucuaaacugcuuacagucucugucauggacuugucacagauguacucaccugucuucgaguacuuaucaggagacagacagguggaagaguggcccaaagcaacuuguacgggugauugcccagaaagauguggcugcacaucaucaaccugcuuacauaaagaauggccccauucaaggaauuggagauguaaccccacuuggugcugggguguagggacuggcugcaccuguuguggauuagacgugaaagaccucuuuacagauuauauguuugucaaguggaaaauugaauacauuaaaacagaagcaauaguguguguagaacuuacuagucaggaaagacaguguagcuugauugaagcgggcacaagguucaauuugggucccgugaccaucacauugucagaaccaagaaacauccagcaaaagcucccuucugaaauaaucacacugcaucccaggauugaggaggguuuuuuugaccugaugcauguacaaaaaguguugucggcaagcacaguguguaaguugcagaguugcacacauggugugccaggagaucuacaggucuaccacaucggaaauuuauuaaaaggggauaagguaaauggacaccuaguucauaaaauugagccacacuucaauacuucuuggauguccugggaugguugugaucuagacuauuauugcaacaugggagauuggccuucuugcacauacacaggaguuacccagcacaaucaugcuucauuuguaaaccugcucaacauugaaacugauuacacaaaaaacuuccacuuucacucuaaaagggucacugcacacggagacacaccacaacuggaucuuaaggcaagaccaaccuauggugcaggugagaucacuguauugguggaaguugcugacauggaguuacacacaaagaagauugaaauaucaggcuuaaaauuuacaagccugacuuguacaggcuguuaugcuuguaguucuggcaucucaugcaaaguuagaauucauguggaugaaccagaugaacuuacagugcauguuaaaagugaugauccagauguuguugcagcuagcucaagucucauggcaagaaagcuugaauuuggaacagacaguacauuuaaggcuuuuucagccaugccuaaaacuucucuauguuucuacauuguggaaagagaauacuguaagagcugcagugaagaagacacacaaaaauguguuaacacaaaacuugagcagccacagagcauuuugaucgaacauaaggguacuauaaucgggaagcaaaacaacacuugcaaggcuagggcggguugcugguuagagucaguuaagaguuuuuuuuacggccuaaagaacaugcucaguggcauuuuuggcaauguauuuauaggcauuuucuuauuucuugcccccuucauccuauuaauacuauucuuuauguuuggguggaggaucuuguuuuguuuuaaguguuguagaagaacuagaggccuguucaaguauagacaccugaaagacgaugaagaaacugguuauagaaagaucauugaaagacuaaacaacaaaaaagggaaaaauaaacugcuugauggugaaagacuugcugauagaagaauugccgaacuguucucuacaaaaacacacauuggc

SEQ ID NO: 3842 - RNA, 2916 nt, Artificial Sequence
  derived and/or modified CDS sequence (wt) from CCHFV(SPU415/85, Artificial)__DQ211635.1__Gn-4aa-Gc
uccgaggagucugauggugacuguauaucaagaacucaacuauugaggacagagacuacagaaauccacagugacaacuaugguggcccaggugacaaaauaacuaucugcaaugguucaacuauuguagaucaaagacuaggcagugaacugggguguuauacuaucaauagggugaagucauuuaagcuuugcgaaaacagugccacaggaaaaucuugugaaauagauagcaccccaguuaagugcagacaagguuuuugcuugaaaaucacucaagaagggaggggccacgugaagcugucgagaggcucggaaauugucuuggacgcuugcgauucaaacugugaaauaaugauaccaaagggcaccggagacaucuuaguugacuguucagguggacaacaacauuucuuaaaagauaauuugauugaucuuggaugucccaauaucccauuauuaggcaaaauggccaucuacauuugcagaauguccaaucauccuaaaacaaccauggccuuucucuuuugguuuagcuuugguuaugugauaaccuguauacuuuguaaggugaucuuuuaccuauugauaguugcagggacaguaggaaaaaaguucaaacaguauagagaguugagaccucagaccugcaccauaugugaaacaauuccugucaaugcaauagaugcugaaaugcaugaccucaacugcaguuacaauauauguccguauugcgcaucuagauuaaccucagauggucuugccagacauguaaugcaaugcccuaagcggaaggaaaaaguagaggaaacugaauuauacuuaaaccuagaaaggauucccuggguuguuaggaaauuauugcaaguuucagagucuaccgguguggcauugaagaggagcaguuggcugacagugcugcuuguguugcuuauagucucauugucaccggugcagucagcaccuauugguagaaaacccuuauuuuuagacaguauuguuaaaggcaugaagaacuugcuaaacucaacaagcuuggaaacaagcuuaucaauugaggcaccauggggugcaauaaauguccaaucaaccuucaaacccacugugucagcugcaaacauagcacuuagcuggagcucaguggaacacagaggcaacaagauuuugguuucaggcaggucagaaucaaucaugaagcuggaggaaaggacaggaaucagcugggaucugggaguagaagacgccucugaguccaaauugcucaccgucucugucauggacuugucacaaauguauucccccgucuuugaguaccugucaggugauagacagguagaagaguggcccaaggcgaccuguacaggcgauugcccagaaagauguggcugcacaucaucaaccuguuugcacaaggaauggccccauucaaggaacuggagaugcaaccccacuugguguuggggggucggcacuggaugcaccuguugugggcuagauguaaaagaccucuuuacagauuacauguuugucaaguggaaaguugaauacauaaaaacagaggccauagugugugucgaacuuacuagccaagaaaggcaauguagcuugauugaagcaggcacaagauucaauuuagguccugugacuaucacauuaucggagccaagaaacauucagcaaaagcucccuccagaaauaauuacauugcauccuagaauugaagaaggcuuuuuugacuuaaugcaugugcaaagagugcugucagcaagcacagugugcaagcuacagaguugcacacauggugugccaggagaccuacaggucuaccacaucggaaacuuguuaaaaggagacaagguaaacgggcaucugauucacaagauugaaccacauuucaacacuuccuggaugucuugggauggcugugaccuagauuacuacugcaauaugggggauuggccuucuugcacauacacuggaguaacccaacauaaccaugcugcauuuguaaauuugcucaauaucgaaaccgauuauacaaaaaacuuucauuuucacuccaagagaguuacugcacauggagacacaccacaauuagacuugaaggccagaccaacuuauggugcaggggagguuacuguacuaguggagguugcugacauggagcugcacacaaagaaaauugagauaucaggcuugaaguuugcaagucuaacuugcacaggcugcuaugcuuguagcucugguaucuccuguaaggucaagauccauguagaugaaccagaugagcuuacaguacaugugaagagugaagacccagacauaguugcugcaggcucaagucucauggcaaggaagcuugaauuuggggcagauaguacauucaaagccuuuucagccaugcccaaaaccuccuugugcuuuuauauuguggagagagaauacuguaagagcugcaguagagaggacacacgaaaauguguuaacacuaagcuugaucgaccacagagcauuuugaucgaacauaaaggaacgauuauuggaaagcaaaacaacacaugcacagcuaaagcaagcugcuggcuagagucagucaaaaguuuuuucuacggauugaagaauaugcuuaguggcauuuucgguaauguuuucauagggauuuucuuauucauugcuccuuuuguccuguuaauacuuuucuuuauguuuggguggaggauccuguucugcuuuaagugcugcagaagaaccagaggccuauuuaaguacagacaccucaaggacgaugaagaaaccgguuacaggaaaaucauugagaggcuaaauaacaaaaagggaaaaaacaaacuacuugauggggaaaggcuagcugauaggaaaaucgccgaguuauucuccacaaaaucacauaucggc

SEQ ID NO: 3843 - RNA, 2916 nt, Artificial Sequence
  derived and/or modified CDS sequence (wt) from CCHFV(Turkey200310849, Artificial)__DQ211636.1__Gn-4aa-Gc
uccgaagagccaggugaugacugcauaucaagaacucagcuauugaggacagaaacagcagagauccaugaugacaacuauggugguccaggugauaaaauaacuaucugcaacgguucaaccauuguagaucagagacugggcagugaacuaggguguuauaccaucaacagggugaagucauucaagcuaugcgaaaacagcgccacagggaaaaccugugagguagacagcacuccgguuaagugcaggcaagguuuuuguuuaaaaaucacccaagagggaaggggccacguaaaauuaucuagaggcucagagguuguccuggaugcuugcgacucaagcugugaaguaaugauaccuaaaggcacuggggauauccuaguggacuguucaggugggcagcaacauuucuuaaaagacaacuuaauugaccuagggugcccccauaucccgcuauuggguaagauggcuauuuacauuugcagaaugucaaaucauccuagaacaaccauggcuuuucucuucugguucagcuuuggcuauguuaucaccuguauaucuugcaaggcucuuuuuuauucauugauaauuauuggaacacuaggaaaaaagaucaagcaauauagggaacugaaaccucaaaccugcaccauaugugagacagcuccugucaaugcaauagaugcugaaaugcaugaccucaacuguaguuacaauauaugcccuuauugugcaucaagauugaccuccgaugggcuagccaggcauguaacgcaaugccccaagcggaaagagaagguugaagagacugaacuguaccugaaccuggaaagaauuccuuggauugucagaaagcuauugcaggugucagaguccacugguguggcauuaaaacgaagcagcuggcugauuguacugcuuguguuacuaacaguuucauugucaccgguucaaucagcaccuguugguagaaaaccucuuuucuuggacaguauaguuaaagguaugaaaaauuugcuaaacucaacaagcuuggaaacaagcuuaucaauugaggcaccauggggagcaauaaauguccagucaaccuuuaaaccagcuguaucgacugcaaacauagcacucaguuggagcucaguggagcacagaggcaacaagaucuuagucacaggcaggucugaaucaauuaugaaacuggaggaaaggacaggagucagcugggaucuagguguagaagaugccucugaauccaaauuacuuaccguuucuaucauggauuugucacaaauguauucuccuguuuuugaguacuugucaggagacagacagguugaagaauggcccaaagcaacuuguacaggugauugcccggagaggugugguugcacaucaucaaccugcuuacauaaagaauggccucacucaagaaacuggagauguaaucccacuuggugcuggggaguaggaaccggcugcaccugcugcgggguggauguaaaagaucuuuuuacagaucacauguuugucaaauggaaaguugaauacauaaaaacugaagcuauaguauguguugaacucaccagccaagaaagacagugcagucugauugaggcagguacuagauucaacuugggcccugugacuauuacccugucugagccaagaaacauucagcagaagcuuccuccugagauuaucacguugcaucccaaaauugaagaaggcuucuuugacuugaugcauguacaaaaaguguugucugcaaguacaguguguaaacugcagaguugcacacaugguauaccaggagaucuacaaguuuaccacauuggcaacuuguugaaaggggauagaguaaacgggcaucuaauucacaaaauugaaucacauuucaacaccucuuggauguccugggaugguugugacuuagacuacuacugcaacaugggggauuggccaucuugcacauacacaggagugacccagcauaaccaugcugcauuuguaaacuugcuuaacauugaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcauaccaagaaaguugaaauaucaggcuugaaauuugcaagucuggcuugcacggguugcuaugcuuguagcucuggcaucuccuguaaaguuagaauucauguagaugaaccagaugagcucacaguacauguaaagagcagugauccagaugugguugcagcuagcacaagucucauggcgaggaagcuugaauuugggacagacagcacauucaaggccuuuucagcuaugcccaaaaccucuuuauguuuuuacauuguggagagagaauacugcaagagcugcagugaagaugauacacaaaaauguguugacacaagacuugagcagccacagagcauacuaauugagcacaaaggaacgauaauuggaaagcagaaugauacuugcacagccaaggcaagcuguugguuagagucagucaagaguuuuuuuuauggauugaagaauaugcuuggcaguguuuuugguaaucuuuucauaggcauuuuguuauuccuugccccuuuuguccuguuggugcuuuucuuuauguuuggguggaaaaucuuguuuugcuuuaaauguugcaggaggaccagaggcuuauuuaaguauagacaccucaaagacgaugaggaaacaggcuacagaaggauuauugaaagacugaacagcaaaaaagggaaaaacaggcugcuugauggugauagacuggcugauaggaaaauugcugagcuguucuccacaaaaacacacauuggc

SEQ ID NO: 3844 - RNA, 2916 nt, Artificial Sequence
  derived and/or modified CDS sequence (wt) from CCHFV(Iran-52, Artificial)__DQ446215.1__Gn-4aa-Gc
uccgaagaaucuggugaugacugcauaucaagaacucagcuauugaggacagagacugcagagguccauggcgauaacuauggugguccaggugauaagauaaccaucuguaaugguucaacuguuguagaucaaagacuggguagugaacugggguguuacacuaucaauagagugaggucauucaagcuaugcgaaaacagugccacagggaagagcugugaaauagacaguaucccagucaaguguaagcaggguuauugccuaaaaaucacucaggaaggaaggggccaugugaaguuaucuagaggcucagaaguugucuuggauguaugugauucaagcugugaagugaugauaccuaagggcacuggugacauucuaguagauuguucaggugggcagcaacauuuuuuaaaagacaaccugguugaccuagggugucccaaaauuccguuacugggcaaaauggcuauuuauaucugcaggaugucgaaucaccccaagacaaccauggccuuccucuuuugguucagcuuuggcuaugugauaacuuguauacuuugcaaggccauuuuuuucuuauuaauaauuuuuggaacacuagggaaaagguucaagcaguacagagaguugaaaccccagaccugcaccauaugugagacaacaccuguaaaugcaauagaugcugaaaugcaugaucucaacugcaguuacaauauaugucccuauugugcgucuagacugacuucagaugggcuugcuaggcaugugacacaauguccuagacggaaggagaaaguggaggaaaccgaauuauaccugaauuuagagagaauucccuggguuguaagaaagcuauugcaggugucagaguccacugguacaguauuaaaaaggagcagcuggcuaauuguauuacuugugcuguucacaguuucauugucaccaguucaaucagcacccauugguagaaggccccuauuucuagauaguauagucaaagguaugaaaaaucugcuaaacucaacaagucuagaaacaagcuuaucaauugaggcaccauggggagcaauuaauguucagucaaccuacaaaccaacuguaucaacugcaaacauagcacuuaguuggagcucaguggaacacagaggcaauaagguuuuggucucaggcagaucagaaucaauuaugaagcuggaagaaaggacaggaaucagcugggaucuuggcguggaagaugccucugagucuaagcuacuuacaguuucagucauggacuugucucagauguacucuccugucuucgaguacuuaucaggugacagacaaguggaagaguggccuaaagcaaccugcacaggugacugcccagaaagauguggcugcacaucaucaaccugcuuacacaaagaguggccccacucaaggaauuggagauguaauccuacuuggugcugggguguagggacuggcugcaccuguugugguuuagaugugaaagaccuuuucacagauuacauguucgucaaguggaaaguugaguacauuaagacagaggccauaguauguguagaacuaaccagucaggaaagacaguguagcuugauugaggcgggcacaagauucaauuuagguucugugacuauuacauugucagaaccaaggaacauucaacaaaagcucccuccugaaauaaucacacugcaccccaagauugaggaagguuuuuuugaccuaaugcauguacaaaaagugcuaucggcaagcacaguguguaaguugcagaguugcacacauggugugccaggagaucugcaggucuaccacaucggaaaccuauuaaaaggggacagaguaaacggacaccugauucauaaaauugagcaacacuucaacacauccuggaugucuugggaugguugugaccuagacuacuacuguaacaugggagacuggccuuccugcacauauaccggagucacucagcauaaccaugcuucauuuguaaaccugcucaacauugaaacugauuauacaaaaaccuuucacuuucacucuaaaaggguuacugcacauggagacacaccacagcuagaucugaaggcaaggccaaccuauggugcaggugagaucaccgugcugguggaaguugcugacauggaguuacacacaaagaagauugaaauaucaggcuuaaaauuugcaggccuaacuugcacagguuguuaugcuuguaguucuggcaucucuuguaaaguuagaauucauguagaggaaccagaugaacuuacaguacauguuaaaagugaugacccagauguaguugcagcuagcucaagucucauggcgaggaagcuugaguuuggaacagacaguacauuuaaagcuuucucagccaugccuaaaaccucccuauguuucuacauuguggaaagagaauacuguaagagcugcaguaaagaagauacacaaaaauguguuaacacgaaacucgaacaaccacagagcauuuugaucgaacauaagggaacuauaauuggaaagcaaaacaauacuugcacggcuaaagcgaguugcugguuagagucaguuaagaguuuuuuuuauggucugaagaauaugcucgguggcauauuuggcaauguuuuuauaggcauuuucacauuucuuacccccuuuaucuuguuaauacuuuucuuuauguuuggguggaggauccuguuuugcuucaaguguugcagaagaaccagaggccuauucaaguacagacaccucaaagacgaugaagaaacugguuacagaaagaucauugaaagacugaacaacaaaaagggaaaaaacaggcugcuugauggugaaagacuugcugacagaaagauugcugaacuguucuccacaaaaacacacauuggc

SEQ ID NO: 3845 - RNA, 2916 nt, Artificial Sequence
  derived and/or modified CDS sequence (wt) from CCHFV(Iran-53, Artificial)__DQ446216.1__Gn-4aa-Gc
uccgaagaaucuggugaugacugcauaucaagaacucagcuauugaggacagagacugcagagguccauggcgauaacuauggugguccaggugauaagauaaccaucuguaaugguucaacuguuguagaucaaagacuggguagugaacugggguguuacacuaucaauagagugaggucauucaagcuaugcgaaaacagugccacagggaagagcugugaaauagacaguaucccagucaaguguaagcaggguuauugccuaaaaaucacucaggaaggaaggggccaugugaaguuaucuagaggcucagaaguugucuuggauguaugugauucaagcugugaagugaugauaccuaagggcacuggugacauucuaguagauuguucaggugggcagcaacauuuuuuaaaagacaaccugguugaccuagggugucccaaaauuccguuacugggcaaaauggcuauuuauaucugcaggaugucgaaucaccccaagacaaccauggccuuccucuuuugguucagcuuuggcuaugugauaacuuguauacuuugcaaggccauuuuuuucuuauuaauaauuuuuggaacacuagggaaaagguucaagcaguacagagaguuaaaaccccagaccugcaccauaugugagacaacaccuguaaaugcaauagaugcugaaaugcaugaucucaacugcaguuacaauauaugucccuauugugcgucuagacugacuucagaugggcuugcuaggcaugugacacaauguccuagacggaaggagaaaguggaggaaaccgaauuauaccugaauuuagagagaauucccuggguuguaagaaagcuauugcaggugucagaguccacugguacaguguuaaaaaggagcagcuggcuaauuguauuacuugugcuguucacaguuucauugucaccaguucaaucagcacccauugguagaaggccccuauuucuagauaguauagucaaagguaugaaaaaucugcuaaacucaacaagucuagaaacaagcuuaucaauugaggcaccauggggagcaauuaauguucagucaaccuacaaaccaacuguaucaacugcaaacauagcacuuaguuggagcucaguggaacacagaggcaauaagguuuuggucucaggcagaucagaaucaauuaugaagcuggaagaaaggacaggaaucagcugggaucuuggcguggaagaugccucugagucuaagcuacuuacaguuucagucauggacuugucucagauguacucuccugucuucgaguacuuaucaggugacagacaaguggaagaguggccuaaagcaaccugcacaggugacugcccagaaagauguggcugcacaucaucaaccugcuuacacaaagaguggccccacucaaggaauuggagauguaauccuacuuggugcugggguguagggacuggcugcaccuguugugguuuagaugugaaagaccuuuucacagauuacauguucgucaaguggaaaguugaguacauuaagacagaggccauaguauguguagaacuaaccagucaggaaagacaguguagcuugauugaggcgggcacaagauucaauuuagguucugugacuauuacauugucagaaccaaggaacauucaacaaaagcucccuccugaaauaaucacacugcaccccaagauugaggaagguuuuuuugaccuaaugcauguacaaaaagugcuaucggcaagcacaguguguaaguugcagaguugcacacauggugugccaggagaucugcaggucuaccacaucggaaaccuauuaaaaggggacagaguaaacggacaccugauucauaaaauugagcaacacuucaacacauccuggaugucuugggaugguugugaccuagacuacuacuguaacaugggagacuggccuuccugcacauauaccggagucacucagcauaaccaugcuucauuuguaaaccugcucaacauugaaacugauuauacaaaaaccuuucacuuucacucuaaaaggguuacugcacauggagacacaccacagcuagaucugaaggcaaggccaaccuauggugcaggugaggucaccgugcugguggaaguugcugacauggaguuacacacaaagaagauugaaauaucaggcuuaaaauuugcaggccuaacuugcacagguuguuaugcuuguaguucuggcaucucuuguaaaguuagaauucauguagaugaaccagaugaacuuacaguacauguuaaaagugaugacccagauguaguugcagcuagcucaagucucauggcgaggaagcuugaguuuggaacagacaguacauuuaaagcuuucucagccaugccuaaaaccucccuauguuucuacauuguggaaagagaauacuguaagagcugcaguaaagaagauacacaaaaauguguuaacacgaaacucgaacaaccacagagcauuuugaucgaacauaagggaacuauaauuggaaagcaaaacaauacuugcacggcuaaagcgaguugcugguuagagucaguuaagaguuuuuuuuauggucugaagaauaugcucgguggcauauuuggcaauguuuuuauaggcauuuucacauuucuuacccccuuuaucuuguuaauacucuucuuuauguuuggguggaggauccuguuuugcuucaaguguugcagaagaaccagaggccuauucaaguacagacaccucaaagacgaugaagaaacugguuacagaaagaucauugaaagacugaacaacaaaaagggaaaaaacaggcugcuugauggugaaagacuugcugacagaaagauugcugaacuguucuccacaaaaacacacauuggc

SEQ ID NO: 3846 - RNA, 2916 nt, Artificial Sequence
  derived and/or modified CDS sequence (wt) from CCHFV(Kosova Hoti, Artificial)__EU037902.1__Gn-4aa-Gc
uccgaagagccaggugaugauugcauaucaaggacucagcuauugaggacagaaacagcagagauccaugacgauaacuauggugguccaggugacaaaauaacuaucugcaaugguucaaccauuguagaucagagacugggcagugaacuaggguguuacaccaucaacagggugaagucauucaagcuaugcgaaaacagcgccacagggaaaaccugugagauagacagcacuccaguuaagugcaggcaagguuuuuguuuaaaaaucacccaaaagggaaggggccacguaaaauuaucuagaggcucagagguugucuuggacgcuugcgacucaaacugugaaguaaugauaccuaaaggcacuggagauauccuaguggacuguucagguggacagcagcauuucuuaaaagacaacuugauugaccuggggugcccucauaucccacuauuggguaagauggccauuuacauuugcagaaugucaaaucauccuaaaacaaccauggcuuuucucuucugguucagcuuugguuaugugaucaccuguauauuuugcaaggcucuuuuuuauucauugauaauuauugggacacuaggaaaaaagaucaagcaauauagggaacugaaaccucaaacuugcaccauaugugaaacagcuccugucaaugcaauagaugcugaaaugcaugaccucaacuguaguuacaauauaugcccuuauugugcaucaagauugaccuccgaugggcuagcuaggcauguaaagcaaugcccuaagcgaaaggagaaagucgaggagacugagcuguaccugaaccuggaaagaauuccuugggucgucagaaagcuauugcaagugucagaguccacugguguggcauugaaacgaagcaguuggcugauugugcugcuuguguuacucacaguuucauugucaccgguucaaucagcaccuguugguaggaaaccucuuuucuuagacaguauagucaaagguaugaaaaauuugcuaaacucaacaagcuuagaaacaagcuuaucaauugaggcaccauggggagcaauaaauguccagucaaccuucaaaccaacagugucgacugcgaacauagcacucaguuggagcucaguggaacacagaggcaacaagaucuuagucacaggcaggucugagucaauuaugaaacuagaggaaaggacaggaaucagcugggaucuaggcguagaagaugccucugaauccaaauuacuuaccgucucuaucauggauuugucacagauguauuccccaguuuuugaguacuugucaggggacagacagguugaagaauggcccaaagcaacuugcacaggugacugcccacaaagguguggcugcacaucaucaaccugcuugcauaaagaauggccucauucaagaaacuggagauguaaucccacuuggugcuggggagugggaacuggcugcaccugcugcgggguggauguaaaagaccuuuuuacagaucacauguuugucaaauggaagguugaauauauaaaaacugaagccauaguguguguugagcucaccagccaagaaagacagugcagucugauugaggcagguacuagauucaacuugggcccugugacuauuacccugucugagccaagaaacauucagcagaagcuccccccugagaucauuacguugcaucccaaaauugaggaaggcuucuuugacuugaugcauguacaaaaaguguuguccgcaaguacaguguguaaacugcagaguugcacacaugguauaccaggagaucuacaaguuuaccacauuggcaauuuguugaaaggggauagagugaacgggcaucuaauucacaaaauugaaccacauuucaacaccucuuggauguccugggaugguugugacuuagacuacuacugcaacaugggggacuggccuucuuguacauacacaggagugacccagcauaaucaugcugcauuuguaaacuugcucaacauugaaacugauuacacaaaaaccuuccacuuccacucuaaaagagucacagcacauggugacacaccacaauuggacuuaaaagcaaggccgaccuacggugcaggagagaucacugugcugguugagguugcugacauggaguugcauaccaagaaaguugagauaucgggcuugaaauuugcaagucuggcuugcacagguugcuaugccuguagcucugguaucuccuguaaagucaggauucauguagaugaaccagaugagcucacagugcauguaaagagcagugauccagaugugguugcagcuggcacaagccucauggcaaggaagcuugaauuugggacagacagcacauucaaggccuuuucagcuaugcccaaaaccucuuuauguuuuuacauuguggagaaagaauacugcaagagcugcagugaagaugauacaaaaaaauguguugacacaaaacuugagcagccacagagcauacuaauugagcacagagggacgauaauuggaaagcagaaugauacuugcacagccaaggcaagcuguuggcuagagucagucaagaguuuuuuuuauggauugaagaauaugcuuggcaguguuuuugguaauuuuuucauagguauuuuguuauuccuugccccuuuuguccuguuggugcuuuucuuuauguuuggauggaaaaucuuguuuugcuuuaaauguugcaggaggaccagaggcuuguuuaaguauagacaccucaaagacgaugaggaaacaggcuacagaaggauuauugaaaggcugaacaacaaaaaagggaaaaauagacugcuugauggugaaagguuggcugauaggaaaauugccgagcuguuuuccacaaaaacacacauuggc

SEQ ID NO: 3847 - RNA, 2916 nt, Artificial Sequence
  derived and/or modified CDS sequence (wt) from CCHFV(YL04057, Artificial)__FJ562094.1__Gn-4aa-Gc
gcagaaggaggaagcagugacugcauuucaagaacucagcuaguuaaaacagagguugcagaaauucaugaggacaguuacggugggccuggugagaaaauaacaaucugcaaugguuccacaauuguagaucaaaggcuugguagggaauugggcuguuauacaaucaacagaguaagauccuacaagcuaugcgagaacagugccucagggaaaagcugugaaauagauagcaucccagucaaaugcaaacaaggguuuugccucaaaauaacccaagaaggaagaggucauguaaaacuguccagagggacagaaauuguucuagaugucugugauuccagcugugagcugaugauaccuaagggcacuggagacauuuuaguggauugcucaggagggcagcagcauuuuuuacaaaacaaucugauugacuugggaugccccaaugucccacuacuggguaaaauggccauauaugucugcaggaugucaaaccacccaaaaacuaccauggcauuucuguucugguucagcuuuggcuaugucauuacauguauagcaugcaggguacucuucuacuugcugauugccaucggaacaguagggaaaaagcuaaaacaguauagagagcugaaaccacaaacaugcauuguuugugaaucugucccuguuaaugcaauagaugcugaaaugcaugagcuuaauugcaguuacaauauaugcccauacugugcaucuagacugucuacagacgggcucaucaggcacguaacucagugucccaaacggagggagaagguggaagagacugagcuauucuugaacuuggaaagaauaccuuggcuggugagaaagcuccuucaaguaucagagucaacaggaauggcucuaaagaggagcuguuggaugaucacacuccucauucuacuauugguuucgauaucaccaguccaaucugcaccgguaggcaggaagccacucuuccuggauagcauagccaagggaaagaaaagccuguugaacuccacaagcuuagaaacuagucugucaauugaagcuccguggggagcaaucaauguucagucaacuuucaaaccaacaguuucagcugcuaacauagcacuuagcuggaguucaguugaacacaggggcaacaaaauuuuaguuucagguagaucagagucaaucaugaaauuagaagaaagaacaggagucagcuggaaucuggguguagaagaugcuucugagucaaagacgcucacuguuuccgucauggaccugucacaaauguacucuccuguuuuugaguacuugucaggugacagacaaguggaggaauggccaaaggcaacuugcacaggugacuguccagagagaugcggcugcacuucgucaaccugcuuacauaaagaguggccacauucaagaaacuggcgauguaguccuaccugguguugggggguggggacuggcugcacuugcugugggcuggauguuaaggauuuuuuuacugacuacaugcugguaaaauggaaaguggaauauauaaagacagaagcuauagugugugucgagcugacuagucaagagaggcaguguaguuuaauugaagcaggcacaagauuuaaccuaggcccuguaacaauaacacuaucagagccaagaaauguccagcagaggcuuccucccgaaauuguaacacugcauccuaaaauagaggaagguuuuuuugauuugaugcauguacaaaaaauacugucugcaagcacaguuugcaagcuacagagcugcacacacggugugccgggcgauuuucaggucuaccaugucgguaaccugcugaggggagacaagguuaauggacacucaauucacaagauagaaccacauuuuaauacuucauggaugucaugggaugguugcgaucuggacuauuucugcaauaugggggacuggccuucaugcacauacacuggaguaacacagcauaaccgugcugcauuuaucaacaugcucaacauugagacugacuauacaaaaacuuuccacuuucauucgaagagggucacggcacauggagauacuccccagcuagaccugaaagcgagaccggcauauggugcuggcgaggucacuguucuaguggagguugcagacuuggaguugcacacaaagaaacuugaagugucagguuugaaaauugcaaguuugaccugcucuggguguuaugccugcagcucuggcaucuccugcaaaguuagaauccauguaaaugaaccagaugaauucacaguacauguaagaaguagcgacccagauguuguagcagcaggaucaagucuuauggcaaggaaaauagaguuuggggcugacaguacauucaaggccuuuucaucaaugcccaaggacuccuuaugcuuuuacauaguagaaaaggauuacugcagcagcugcaccgacgaugacacacaaaagugugucaacacgaagcuugaccauccacagagcauacucauugagcacaaaggaacaauaauuggcaagcaaaaugacacuuguucgaccaagacaagcugcuggcuagaaucaguuaaggguuuuuucuaugggcucaaaaacaugcugaguggcaucuuuggaaauguuuuuuuaggcauccucuuauuccuugcuccuuuuguacuacugauauuuuuuuucuuuuuuggguggaggcuucuguuuugucucaaauguugcagaagaacuagaggacuguugaaauauaagcaccuuaaggacgaagaggaggcuggauacaaaaaaaucauugaaaggcuaaauggcaaaaaagguaaaagucaauuguuugauggugaaaggcuugcagacaggaagauugcugagcuuuuuucuacuaaaauucacauaggu

SEQ ID NO: 3848 - RNA, 2916 nt, Artificial Sequence
  derived and/or modified CDS sequence (wt) from CCHFV(V42/81, Artificial)__GU477490.1__Gn-4aa-Gc
uccaaagagccaggugaugacuguauaucaagaacucagcuaaugaggacagaaacagcagagauccaugaugacaacuauggugguccaggugauaaaauaacuaucugcaaugguucaaccauuguggaucagagacugggcagugaacuaggguguuauaccaucaacagggugaagucauucaagcuaugugaaaacagcgccacagggaaagccugugaaguggacagcacuccgguuaagugcaggcaggguuuuuguuuaaaaaucacccaagagggaaggggccauguaaaguuaucuagaggcucagagguugucuuggaugcuugcgacucaagcugugaaguaaugauaccuaaaggcacuggagauauccuaguggacuguucagguggacagcaacauuucuuaaaggacaacuuaauugaccuagagugcccucauaucccgcuauuagguaaguuggccauuuacauuugcagaaugucaaaucauccuagaacaacuauggcuuuucucuucugguucggcuuuggcuaugugaucaccuguauacucugcaaggcucuuuuuuauucauugauaauuauugggacacuagggaaaaagaucaagcaauauagggaacugaaaccucaaacuugcaccauaugugagacagcuccugucaaugcaauagaugcugaaaugcaugaccuuaacuguaguuacaauauaugcccuuauugugcaucaagauugaccuccgaugggcuagcuaggcauguaacgcaaugccccaagcgaaaagagaaaguugaggagacugaacuguacuugaaucuggagagaauuccuuggauugucaggaagcuccugcaagugucggaguccacuggcgugguauugaaacgaagcaguuggcugauugugcugcuuguguuacucacaguuucauugucaccaguucagucagcaccuguugguagaaaaccucuuuucuuagacaguauaguuaaagguaagaaaaauuuguuaaacucaacaaguuuggaaacaagcuuaucaauugaagcaccauggggagcaauaaauauccagucaaccuuuaaaccaacaguaucggcugcaaacauagcacucaguuggagcucaguggagcacagaggcaacaagaucuuagucucaggcaggucugaaucaauuaugaaacuagaggaaagaacaggagucagcuggaaucuagguguagaagaugccucugaauccaaauuacuuaccgucucuaucauggauuugucacaaauguauuccccuguuuuugaguacuugucaggagacagacagguugaagaauggccuaaagcaacuuguacaggugacugcccagaaaggugugguugcacaucaucaaccugcuugcauaaagaauggccucacucaagaaacuggagaugcaauccuacuuggugcugggggguaggaaccggcugcaccugcugcggaguggauguaaaagaccuuuuuauagaucacauguuuguuaaauggaagguugaauauauaaaaacugaagccauaguauguguugagcucaccagccaagaaagacagugcagucugauugaggcagguacuagauucaacuugggcccugugacuauuacccuauccgagccaagaaacauucagcagaagcuucccccugagauuaucacguugcaccccaaaauugaagaaggcuucuuugacuugaugcauguacaaaaaguguugucugccaguacaguguguaaacugcaaaguugcacacaugguauaccaggagaucugcaagucuaccacauuggcaaccuauugaaaggggauagaguaaacgggcaucuaauucacaaaaucgaaccacauuuuaacaccucuuggauguccugggaugguugugaccuagacuacuacugcaacaugggggauuggccuucuugcacauacacaggagugacccagcacaaucaugcugcauuuguaaacuugcuuaacauugaaacugauuacacgaaaacuuuccacuuccacucuaaaagaguuacagcacauggugaaacaccacaauuagacuuaaaagcaaggccggcauacggugcaggugagaucacugugcugguugagguugcugacauggaguugcauaccaagaaaguugagauaucaggcuugaaauuugcaagucuggcuugcacggguugcuaugcuuguagcucuggcaucuccuguaaagucaggauucauguagaugaaccagaugagcucacaguacaugugaagagcaaugauccagaugugguugcagcuagcacaagucucauggcaaggaagcuugaaucugggacagacagcacauuuaaggccuuuucagcuaugcccaaaaccucuuuauguuuuuacauuguggagagagaauacugcaagagcugcagugaagaugauacacagaaauguguugaaacaaaacuugaacagccacaaagcauacuaauugaacacaaaggaacgauaauuggaaagcagaaugauacuugcacagccaaggcaagcuguuggcuggaaucagucaagaguuuuuuuuauggauugaagaacaugcuuggcaguguuuuugguaauuuuuucauaggcauuuuguuauuccuugcccccuuuguccuguuaguacuuuucuuuauguuuggauggaaaaucuuguuuugcuuuaaauguugcaggaggaccagaggcuuguuuaaguauagacaccucaaagaagaugaggaaacaggcuacagaaggauuauugagagacugaacagcaaaaaagggaaaaacagacugcuugauggugaaagguuggcugauaggaaaauugcugagcuguucucuacaaaaacacacauuggc

SEQ ID NO: 3849 - RNA, 2916 nt, Artificial Sequence
  derived and/or modified CDS sequence (wt) from CCHFV(79121M18, Artificial)__GU477493.1__Gn-4aa-Gc
gcagaaggaggaagcagugacugcauuucaagaacucagcuaguuaaaacggagguugcagaaauucaugaggacaguuacggugggccuggugagaaaauaacaaucugcaaugguuccacaauuguagaucaagggcuugguagugaauugggcuguuauacaaucaacagaguaagauccuacaagcuaugcgagaacagugccucagggaaaagcugugaaauagauagcaucccagucaaaugcaaacaaggguuuugccucaaaauaacccaagaaggaagaggucauguaaaacuguccagagggacagaaauuguucuagaugucugugauuccagcugugagcugaugauacccaagggcacuggagacauuuuaguggauugcucaggagggcaacagcauuuuuuacaaaacaaucugauugacuugggaugccccaaugucccauuacuggguaaaauggccauauaugucugcagaaugucaaaccacccaaaaacuaccauggcauuucuguucugguucagcuuuggcuaugucaucacauguauagcaugcaggguacucuucuacuugcugauugccaucggaacaguagggaaaaagcuaaaacaguauagagagcugaaaccacaaacaugcauugucugugaaucugucccuguuaaugcaauagaugcugaaaugcaugagcuuaauugcaguuacaauauaugcccauacugugcaucuagacugucuacagacgggcucaucaggcacguaacucagugucccaaacggagggagaagguggaagagacugagcuauucuugaacuuggaaagaauaccuuggcuggugagaaagcuccuucaaguaucagagucaacaggaauggcucuaaagagaagcuguuggaugaucacacuccucauucuacuauugguuucgauaucaccaguccaaucugcaccgguaggcaggaagccacucuuccuggauagcacagccaagggaaugaaaagccuguugaacuccacgagcuuagaaacaagucugucaauugaagcuccguggggagcaaucaauguccagucaacuuucaaaccaacaguuucagcugcuaacauagcacuuagcuggaguucaguugaacacaggggcaacaaaauuuuaguuucagguagaucagagucaaucaugaaauuagaagaaagaacaggagucagcuggaaucuggguguagaagaugcuucugagucaaagacgcuuacuguuuccgucauggaccugucacaaauguacucuccuguuuuugaguacuugucaggugacagacaaguggaggaauggccaaaggcaacuugcacaggugacuguccagagagaugcggcugcacuucgucaaccugcuuacauaaagaguggccacauucaagaaacuggcgauguaauccuaccugguguugggggguggggacuggcugcacuugcugugggcuggauguaaaggauuuuuuuacugacuacaugcugguaaaauggaaaguggaauauauaaagacagaagcuauagugugugucgagcugacuagucaagagaggcaguguaguuuaauugaagcaggcacaagauuuaaccuaggcccuguaacaauaacccuaucagagccaagaaauguccagcagaggcuuccucccgaaauuguaacacugcauccuaaaauagaggaagguuuuuuugauuugaugcauguacaaaaaauacugucugcaagcacaguuugcaagcuacagagcugcacacacggugugccgggcgauuuucagaucuaccaugucgguaaccugcugaggggagacaagguuaauggacacucaauucacaagauagaaccacauuuuaauacuucauggaugucaugggaugguugcgaucuggacuauuucugcaauaugggggacuggccuucaugcacauacacuggagugacacagcauaaccgugcugcauuuaucaacaugcucaacauugagacugacuauacaaaaacuuuccacuuucauucgaagagggucacggcacauggagauacuccccagcuagaccuaaaagcgagaccggcauauggugcuggcgaggucacuguucuaguggagguugcagacuuggaguugcacacaaagaaacuugaagugucagguuugaaaauugcaaguuugaccugcucuggguguuaugccugcagcucuggcaucuccugcaaaguuagaauccauguaaaugaaccagaugaauuuacaguacauguaagaaguagcgacccagauguuguagcagcaggaucaagucuuauggcaaggaaaauagaguuuggggcugacaguacauucaaggccuuuucaucaaugcccaaggacuccuuaugcuuuuacauaguagaaaaggauuacugcagcagcugcaccgacgaugacacacaaaagugugucaacacgaagcuugaccauccacagagcauacucauugagcacaaaggaacaauaauuggcaagcaaaaugacacuuguucgaccaagacaagcugcuggcuagaaucaguuaaggguuuuuucuaugggcuaaaaaacaugcuaaguggcaucuuuggaaauguuuuuuuaggcaucuucuuauuccuugcuccuuuugugcuacugauauuuuuuuucuuuuuuggguggaggcuucuguuuugucucaaauguugcagaagaacuagaggacuguugaaauacaagcaccuuaaggaugaagaggaggcuggauacaaaaaaaucauugaaaggcuaaauggcaaaaaagguaaaagucaauuguuugauggugaaaggcuugcagacaggaagauugcugagcuuuuuucuacuaaaauucacauaggu

SEQ ID NO: 3850 - RNA, 2916 nt, Artificial Sequence
  derived and/or modified CDS sequence (wt) from CCHFV(Afg09-2990, Artificial)__HM452306.1__Gn-4aa-Gc
uccgaagaaucuggugaugacugcauaucaagaacucagcuauugaggacagagacugcagagguccauggcgauaacuauggugguccaggugauaagauaaccaucuguaaugguucaacuguuguagaucaaagacuggguagugaacugggguguuacacuaucaauagagugaggucauucaagcuaugcgaaaacagugccacagggaagagcugugaaauagacaguaucccagucaaguguaagcaggguuauugccuuaaaaucacucaggaaggaaggggccaugugaaguuaucuagaggcucagaaguugucuuggauguaugugauucaagcugugaagugaugauaccuaagggcacuggugacauucuaguagauuguucaggugggcagcaacauuauuuaaaagacaaccugguugaccuagggugucccaaaauuccguuacugggcaaaauggcuauuuauaucugcaggaugucgaaucaccccaagacaaccauggccuuccucuuuugguucagcuuuggcuaugugauaacuuguauacuuugcaaggccauuuuuuucuuauugauaauuuuuggaacacuagggaaaagguucaagcaguacagagaguugaaaccccagaccugcaccauaugugagacaacaccuguaaaugcaauagaugcugaaaugcaugaucucaacugcaguuacaauauaugucccuauugugcgucuagacugacuucagaugggcuugcuaggcauguaacacaauguccuagacggaaggagaaaguggaggaaaccgaauuauaccugaauuuagagagaauucccuggguuguaagaaagcuauugcaggugucagaguccacugguacaguauuaaaaaggagcagcuggcuaauuguauuacuugugcuguucacaguuucauugucaccaguucaaucagcacccauugguagaaggccccuauuucuagauaguauagucaaagguaugaaaaaucugcuaaacucaacaagucuagaaacaagcuuaucaauagaggcaccguggggagcaauuaauguucagucaaccuacaaaccaacuguaucaacugcaaacauagcacuuaguuggagcucaguggaacacagaggcaauaagguuuuggucucaggcagaucagaaucaauuaugaagcuggaagaaaggacaggaaucagcugggaucuuggcguggaagaugccucugagucuaagcuacuuacaguuucaguuauggacuugucucagauguacucuccugucuucgaguacuuaucaggugacagacaaguggaagaguggccuaaagcaaccuguacaggugacugcccagaaagauguggcugcacaucaucaaccugcuuacacaaagaguggccccacucaaggaauuggagauguaauccuacuuggugcugggguguagggacuggcugcaccuguugugguuuagaugugaaagaccuuuucacagauuacauguucgucaaguggaaaguugaguacauuaagacagaggccauaguauguguagaacuaaccagucaggaaagacaguguagcuugauugaggcgggcacaagauucaauuuagguucugugacuauuacauugucagaaccaaggaacauucaacaaaagcucccuccugaaauaauuacacugcaccccaagauugaggaagguuuuuuugaccuaaugcauguacaaaaagugcuaucggcaagcacaguguguaaguugcagaguugcacacauggugugccaggagaucugcaggucuaccacaucggaaaccuauuaaaaggggacagaguaaacggacaccugauucauaaaauugagcaacacuucaacacauccuggaugucuugggaugguugugaccuagacuacuacuguaacaugggagacuggccuuccugcacauauaccggagucacucagcauaaccaugcuucauuuguaaaccugcucaacauugaaacugauuauacaaaaaccuuucacuuucacucuaaaaggguuacugcacauggagacacaccacaacuagaucugaaagcaaggccaaccuauggugcaggugagaucaccgugcugguggaaguugcugacauggaguuacacacaaagaagauugaaauaucaggcuuaaaauuugcaggccuaacuugcacagguuguuaugcuuguaguucuggcaucucuuguaaaguuagaauucauguagaugaaccagaugaacuuacaguacauguuaaaagugaugacccagauguaguugcagcuagcucaagucucauggcgaggaagcuugaauuuggaacagacaguacauuuaaagcuuucucagccaugccuaaaaccucccuauguuucuacauuguggaaagagaauacuguaagagcugcaguaaagaagauacacaaaaauguguuaacacgaaacucgaacaaccacagagcauuuugaucgaacauaagggaacuauaauuggaaagcaaaacaauacuugcacggcuaaagcgaguugcugguuagagucaguuaagaguuucuuuuauggucugaagaauaugcucgguggcauauuuggcaauguuuuuauaggcauuuucacauuucuuacccccuuuaucuuguuaauacuuuucuuuauguuuggguggaggauccuguuuugcuucaaguguugcagaagaaccagaggccuauucaaguacagacaccucaaagacgaugaagaaacugguuacagaaagaucauugaaagacugaacaacaaaaaaggaaaaaacaggcugcuugauggugaaagacuugcugacagaaagauugcugaacuguucuccacaaaaacacacauuggc

SEQ ID NO: 3851 - RNA, 2916 nt, Artificial Sequence
  derived and/or modified CDS sequence (wt) from CCHFV(Sudan Al-Fulah 3-2008, Artificial)__HQ378184.1__Gn-4aa-Gc
uccgaagaacccagugaugacugcauaucaagaacucaacuauugaggacagagacugcagaaauccacggcgacaacuaugguggcccgggugacaaaauaaccaucugcaacggcucaacuauuguagaccaaagacugggcagugaguuaggguguuacacuaucaauagagugaagucauucaagcuaugugaaaauagugccacugggaagagcugugugauagacagugucccaguuaaaugcaggcaggguuauugccuaaggauuacucaagaaggaaggggccauguaaaauuaucuaggggcucagagguugucuuagaugcaugcgauacaagcugugaaauaaugauaccuaagggcaccggugacauccuaguugacuguucaggugggcagcaacauuuucuaaaggacaauuugguagaucuaggaugccccaaaaucccauuacugggcaaaauggcuaucuacauuugcagaaugucgaaucaccccaaaacaaccauggcuuuccucuucugguucagcuuuggcuauguaauaacuuguauacuuugcaaggccaucuuuuacuuguuaauaauuauuggaacacuagggaaaagguucaggcaguauagagaguuaaagccucagaccugcaccauaugugagacaacuccuguaaaugcaauagaugcugagaugcaugaccucaauugcaguuacaacauuugucccuacugugcaucuagacuaaccucggaugggcuugcuaggcaugugacacagugcccuaagcggaaggagaaaguggaagaaacugaacuguacuugaacuuagaaagaauuccuuggguugugagaaagcuguugcagguaucagaguccaccgguguggcauugaaaagaagcagcuggcugauugugcugcuugugcuguucacgguuucauugucgccaguucaaucagcacccauugguagaaggccucuauuccuagacaguauaguuaaaggcaugaaaaaucugcuaaacucaacaaguuuagaaacaagucugucaauugaggcaccauggggggcaauaaauguucagucaaccuacaagccaacugugucgacugcaaauauagcacucagcuggagcucaguggaacacagaggcaauaagaucuugguuucaggcagaucagaaucaauuaugaagcuggaagaaaggacagggaucagcugggaucucggcguagaagacgccucugagucuaaacugcuuacagucucuguuauggauuugucucagauguacucuccugucuucgaguacuuaucaggagacagacagguggaggaguggcccaaagcaacuugcacaggugacugcccagaaagauguggcugcacaucaucaacaugucugcacaaagaauggccccacucaagaaauuggagaugcaaucccacuuggugcugggguguagggacuggcugcaccugcuguggauuagaugugaaagaccuuuuuacagauuauauguuugucaaguggaaaguugaauacaucaagacagaggccauaguguguguagaacucaccagucaggaaaggcaguguagcuugauugaagcaggcacaagguucaauuuagguccugugaccaucacacugucagaaccaagaaacauccaacagaagcucccuccugaaauaaucacacuacauccuaggauugaagaagguuuuuuugaccugaugcacguucagaaaguguuaucagcaagcacaguguguaaguugcagaguugcacacaugguguaccaggagaccuacaggucuaccacaucggaaauuuauuaaaaggggacaagguaaauggacaucuaauucauaaaauugagccacacuucaacacuuccuggauguccugggaugguugugaccuagacuacuacugcaacaugggagauuggccuucuugcacauacacaggagucacccaacacaaucaugcuucauuuguaaaccugcucaacauugaaacugauuacacaaaaaacuuccacuuucacucuaaaagggucacugcacacggagacacaccacaacuggaucuuaaggcaagaccaaccuauggugcaggugagauuacuguacugguagaaguugcugacauggaguuacacacaaagaagauugaaauaucgggcuuaaaauuugcaagcuugacuugcacagguuguuaugccuguagcucuggcaucucaugcaaaguuagaauucauguagacgaaccagaugaacuuacagugcauguuaaaagugaugauccagauguaguugcagcuagcucaagccucauggcaagaaagcuugaauuuggaacagacaguacauuuaaagcuuuuucagccaugccuaaaacuucgcuauguuucuacauuguugaaaaagaauacugcaagagcugcagugaagaagacacaaaaaaauguguuaacacaaaacuugagcaaccacagagcauuuugaucgaacacaagggaacuauaaucggaaagcaaaacagcacuugcacagccaaggugaguugcugguuagagucagccaagaguuuuuuuuauggucuaaaggacaugcuuaguggcauuuuuggcaaugucuuuauagguauuuucuuauuccuugcccccuucguccuguuagugcuguucuuuauguuuggguggaggauccuacuuugcuuuagauguuguagaagaacuagaggccuguucaaguauagacaccucaaggacgaugaagaaacugguuauagaaggauuauugaaagacuaaacaauaaaaagggaaaaaacaaacugcuugauggugaaagacuugcugauagaaaaauugcugaacuguucuccacaaaaacacacauuggu

SEQ ID NO: 3852 - RNA, 2916 nt, Artificial Sequence
  derived and/or modified CDS sequence (wt) from CCHFV(Sudan AB1-2009, Artificial)__HQ378187.1__Gn-4aa-Gc
ucugaagaacccagugaugacuguauaucaagaacucaacuacugaggacagagacugcagagauccacggcgauaacuaugguggcccgggugacaaaauaaccaucugcaauggcucaacuauuguagaccaaagacugggcagugaacuaggguguuacaccaucaauagaguaaagucauucaagcuaugcgaaaacagugccacagggaagaauugugaaauagacagugucccaguuaaaugcaggcaggguuauugccuaagaaucacucaggaagggaggggccacguaaaauuaucuaggggcucagagguugucuuagaugcaugcgacacaagcugugaaauaaugauaccuaagggcacuggugacauccuaguugacuguucaggcgggcagcaacauuuucuaaaggacaauuugauagaucuaggaugccccaaaauuccauuauugggcaaaauggcuauuuacauuugcagaaugucgaaccaccccaaaacaaccauggcuuuccucuucugguucagcuuuggcuauuuaauaaccugcauacuuugcaaggccauuuuuuacuuguugauaauuauuggaacacuagggaaaaggcucaagcaguauagagaguugaaaccucagaccugcaccauaugugagacaacuccuguaaaugcaauagaugcugagaugcaugaccucaauugcaguuacaacauuugccccuacugugcaucuagacuaaccucagaugggcuugcuaggcaugugauacaaugcccuaagcggaaggagaaaguggaagaaacugaacuguacuugaaccuagaaagaauuccuuggguuguaagaaagcuguugcaggugucagagucaacugguguagcauugaaaagaagcaguuggcugauugugcugcuugugcuauucacuguuucauugucaccaguucaaucagcacccauugguagaaagccuuuauucuuagauaguauagcuaaaggcaugaaaaaucugcuaaauucaacaaguuuagaaacgaguuuaucaauugaggcaccauggggagcaauaaauguucagucaaccuacaaaccaacugugucaacugcaaacauagcacucaguuggagcucaguggaacacagaggcaauaagaucuugguuucaggcagaucagaaucaauuaugaagcuggaagaaaggacaggaaucagcugggaucuuggcguagaagaugccucugagucuaaacugcuuacagucucugucauggacuugucucagauguacucuccugucuucgaguacuuaucaggugacagacagguggaagaguggcccaaagcaaccuguacaggugacugcccagaaagauguggcugcacaucaucaaccuguuugcacaaagaauggccucacucaagaaauuggagaugcaaucccaccuggugcugggguguagggacuggcugcaccuguuguggauuagaugugaaggaccuuuuuacagauuacauguuugucaaguggaaaguugaauacaucaagacagaggccauaguguguguagaacuuacuagucaggaaaggcaguguagcuugauugaagcgggcacaagguucaauuuggguccugugaccaucacacugucagaaccaagaaacauccaacaaaaacucccuccugaaauaaucacacuacauccuaggaucgaagaagguuuuuuugaccugaugcauguacaaaagguguuaucggcaagcacaguguguaaguugcagaguugcacacauggugugccaggagaccuacaggucuaccacaucggaaauuuauuaaaaggggauaagguaaaugggcaucuaauucauaaaauugagccacacuucaacaccuccuggauguccugggaugguugugaccuagacuacuacugcaacaugggagauuggccuuccugcacauacacaggggucacccaacacaaucaugcuucauuuguaaacuuacucaacauugaaacugauuacacaaagaauuuccacuuucacucuaaaagggucacugcacacggagauacaccacaacuagaucuuaaggcaagaccaaccuauggugcaggugagaucacuguucugguagaaguugcugacauggaguuacauacaaagaagauugagauaucaggcuuaaaauuugcaagcuugacuugcacagguuguuaugcuugcagcucugguaucucaugcaaaguuagaauucauguggaugaaccagaugaacuuacaguacauguuaaaagugaugauccagaugugguugcagcuagcucaagucucauggcaagaaagcuugaauuuggaacagacaguacauuuaaagcuuucucggccaugccuaaaacuucuuuauguuucuacauuguugaaagggaacacuguaagagcugcaaugaagaagacacaaaaaaauguguuaacacaaaacuugagcaaccacaaagcauuuugaucgaacacaagggaaccauaaucggaaagcagaacagcacuugcacggcuagggcgaguugcugguuggagucagucaagaguuucuuuuauggccuaaagaacaugcuuaguggcauuuuuggcaaugucuuuaugggcaucuucuuauuccuugcccccuucauccuguuaauacuauucuuuauguuuggguggaggauccuauucugcuuuaaauguuguagaagaaccagaggccuguucaaguauagacaccucaaagacgaugaagaaacugguuauagaaggauuauugaaagacuaaacaauaaaaaaggaaaaaacaaacugcuugauggugaaagacuugcugauagaagaauugccgaacuguucucuacaaaaacacacauuggc

SEQ ID NO: 3853 - RNA, 2916 nt, Artificial Sequence
  derived and/or modified CDS sequence (wt) from CCHFV(NIVA 118595, Artificial)__JN572083.1__Gn-4aa-Gc
uccgaagaaucuggugaugacugcauaucaagaacucagcuauuaaggacagagacugcagagguccauggcgacaacuauggugguccgggugauaagauaaccaucugcaaugguucaacuguuguagaucaaagacuggguagugaacugggguguuacacuaucaauagagugaaguccuuuaagcuaugcgaaaacagugccacagggaagagcugugaaauagacaguaucccaguuaaguguaggcaggguuauugccuaaaaaucacucaggaaggaaggggccauguuaaauuaucuagggguucagaaguugucuuggaugcaugugacucaagcugugaagugaugauaccuaagggcacuggugacauucuaguagauuguucaggugggcagcaacauuuuuuaaaggacaaccugauugaucuaggaugucccaaaauuccauuauugggcaaaauggcuauuuauaucugcagaaugucgaaucaccccaaaacaaccauggccuuucucuuuugguucagcuucggcuaugugauaacuuguauacuuugcaagguaauuuuuuacuuauuaauaauuuuuggaacacuagggaaaagguucaagcaguacagagaguugaaaccccagaccugcaccauaugugagacaacaccugugaaugcaauagaugcugaaaugcaugaucuuaacugcaguuacaauauaugucccuauugugcgucuaggcuaacuucagaugggcucgcuaggcauguaacacaaugcccuaagcggaaggagaagguggaagagaccgaauuguacuugaacuuagagagaauuccuuggguuguaagaaagcuauugcaggugucagaguccacuggcauagcauuaaaaaggagcagcuggcuaauugugcugcuuguguuauucacaguaucaauaacaccgguucaaucagcgcccauugguagaaggccccuauuucuagauaguauagucaaagguaugaaaaaucugcuaaacucaacaagucuagaaacaagcuuaucaauugaggcaccguggggagcaauuaauguucagucaaccuacaaaccaacuguaucagcagcaaacauagcacucaguuggagcucaguggaacacagaggcaauaagauuuuggucucaggcagaucagaaucaauuaugaagcuggaagaaaggacaggaaucagcugggaucucggcguagaagaugccucugagucuaagcuacuuacagucucagucauggacuugucucagauguacucuccugucuucgaguauuuaucaggugacagacaaguggaagaguggccuaaagcgaccuguacaggugacugcccagaaagauguggcugcacaucaucaaccugcuuacacaaagaguggccccacucaaggaauuggagauguaauccuacuuggugcugggguguagggacuggcugcaccugcuguggauuggaugugaaagaccuuuucacagauuacauguucgucaaguggaaaguugaguacauuaagacagaggccauaguauguguagaacuaaccagucaggaaagacaguguagcuugauugaggcgggcacaagauuuaauuuagguucugugaccauuacauugucagaaccaaggaacauucaacaaaagcucccuccugaaauaaucacacugcauccuagaauugaggaagguuuuuuugaccuaaugcaugugcaaaaagugcuaucagcaagcacaguguguaaguuacaaagcugcacacauggugugccaggagaucuacaggucuaccacauuggaaaccuauuaaaaggggacagaguaaacggacaccuaauucacaaaauugaacaacaccucaacacuucuuggauguccugggaugguugugaucuagacuacuacugcaauaugggagacuggccuucuugcacauauacaggagucacccaacauaaucaugcuucauuuguaaaccugcucaacauugaaacugauuacacaaaaaccuuccacuuucacucuaaaaggguuacugcacauggagacacaccacagcuagaucugaaggcaaggccaaccuauggugcaggugagaucacuguacugguggaaguugccgauauggaguuacacacaaagaagauugaaauaucaggcuugaaguuugcaagccuauccugcacagguuguuaugcuuguaguucuggcaucuccugcaaagucagaauucauguagaugaaccagaugaacuuacaguacauguuaaaagugaugauccagauguaguugcagcuagcucaagucucauggcaaggaagcuugaaucuggaacagacaguacauuuaaagcuuuuucagccaugccuaaaacuuccuugugcuucuacauuguagagagagaauacuguaagggcugcaguaaagaagacacacaaaaauguguuaacacgaaacucgagcaaccacagagcauuuugaucgaacacaagggaacuauaauuggaaagcaaaacaauacuugcacagcuaaggcaaguugcugguuagagucaguuaagaguuuuuuuuauggucugaagaauaugcuuaguggcauuuuuggcaauguuuuuuuaggcauuuucucauuucuugcccccuuuguccuauuaauacuuuucuuuauguuuggguggaggauccuguuuugcuucaaguguugcagaagaaccagaggccuauucaaguacagacaccucaaagacgaugaagaaacugguuacagaaagaucauugaaagacugaacaacaaaaaggggaaaaacaaacugcuugauggugaaaggcuugcugacagaaaaauugccgaacuguucuccacaaaaacacacauuggc

SEQ ID NO: 3854 - RNA, 2916 nt, Artificial Sequence
  derived and/or modified CDS sequence (wt) from CCHFV(NIV 112143, Artificial)__JN572085.1__Gn-4aa-Gc
uccgaagaaucuggugaugacugcauaucaagaacucagcuauuaaggacagagacugcagagguccauggcgacaacuauggugguccgggugauaagauaaccaucugcaaugguucaacuguuguagaucaaagacuggguagugaacugggguguuacacuaucaauagagugaaguccuuuaagcuaugcgaaaacagugccacagggaagagcugugaaauagacaguaucccaguuaaguguaggcaggguuauugccuaaaaauuacucaggaaggaaggggccauguuaaauuaucuaggggcucagaaguugucuuggaugcaugugacucaagcugugaagugaugauaccuaagggcacuggugacauucuaguagauuguucaggugggcagcaacauuuuuuaaaggacaaccugauugaucuaggauguccuaaaaucccauuauugggcaaaauggcuauuuauaucugcagaaugucgaaucaccccaaaacaaccauggccuuucucuuuugguucagcuucggcuaugugauaacuuguauacuuugcaagguaauuuuuuacuuauuaauaauuuuugggacacuagggaaaagguucaagcaguacagagaguugaaaccccagaccugcaccauaugugagacaacaccugugaaugcaauagaugcugaaaugcaugaucuuaacugcaguuacaauauaugucccuauugugcgucuaggcuaacuucagaugggcucgcuaggcauguaacacaaugcccuaagcggaaggagaagguggaagagaccgaauuguacuugaacuuagagagaauuccuuggguuguaagaaagcuauugcaggugucagaguccacuggcauagcauuaaaaaggagcagcuggcuaauugugcugcuuguguuauucacaguaucaauaacaccgguucaaucagcgcccauugguagaaggccccuauuucuagauaguauagucaaagguaugaaaaaucugcuaaacucaacaagucuagaaacaagcuuaucaauugaggcaccguggggagcaauuaauguucagucaaccuacaaaccaacuguaucagcagcaaacauagcacucaguuggagcucaguggaacacagaggcaauaagauuuuggucucaggcagaucagaaucaauuaugaagcuggaagaaaggacaggaaucagcugggaucucggcguagaagaugccucugagucuaagcuacuuacagucucagucauggacuugucucagauguacucuccugucuucgaguauuuaucaggugacagacaaguggaagaguggccuaaagcgaccuguacaggugacugcccagaaagauguggcugcacaucaucaaccugcuuacacaaagaguggccccacucaaggaauuggagauguaauccuacuuggugcugggguguagggacuggcugcaccugcuguggauuggaugugaaagaccuuuucacagauuacauguucgucaaguggaaaguugaguacauuaagacagaggccauaguauguguagaacuaaccagucaggaaagacaguguagcuugauugaggcgggcacaagauuuaauuuagguucugugacuauuacauugucagaaccaaggaacauucaacaaaagcucccuccugaaauaaucacacugcauccuagaauugaggaagguuuuuuugaccuaaugcaugugcaaaaagugcuaucagcaagcacaguguguaaguuacaaagcugcacacauggugugccaggagaucuacaggucuaccacauuggaaaccuauuaaaaggggacagaguaaacggacaccuaauucacaaaauugaacaacaccucaacacuucuuggauguccugggaugguugugaucuagacuacuacugcaauaugggagacuggccuucuugcacauauacaggagucacccaacauaaucaugcuucauuuguaaaccugcucaacauugaaacugauuacacaaaaaccuuccacuuucacucuaaaaggguuacugcacauggagacacaccacagcuagaucugaaggcaaggccaaccuauggugcaggugagaucacuguacugguggaaguugccgauauggaguuacacacaaagaagauugaaauaucaggcuugaaguuugcaagccuauccugcacagguuguuaugcuuguaguucuggcaucuccugcaaaguuagaauucauguagaugaaccagaugaacuuacaguacauguuaaaagugaugauccagauguaguugcagcuagcucaagucucauggcaaggaagcuugaauuuggaacagacaguacauuuaaagcuuuuucagccaugccuaaaacuuccuugugcuucuacauuguagagagagaauacuguaagggcugcaguaaagaagacacacaaaaauguguuaacacgaaacucgagcaaccacagagcauuuugaucgaacacaagggaacuauaauuggaaagcaaaauaauacuugcacagcuaaggcaaguugcugguuagagucaguuaagaguuuuuuuuauggucugaagaauaugcuuaguggcauuuuuggcaauguuuuuuuaggcauuuucucauuucuugcccccuuuguccuauuaauacuuuucuuuauguuuggguggaggauccuguuuugcuucaaguguugcagaagaaccagaggccuauucaaguacagacaccucaaagacgaugaagaaacugguuacagaaagaucauugaaagacugaacaacaaaaaggggaaaaacaaacugcuugauggugaaaggcuugcugacagaaaaauugccgaacuguucuccacaaaaacacacauuggc

SEQ ID NO: 3855 - RNA, 2916 nt, Artificial Sequence
  derived and/or modified CDS sequence (wt) from CCHFV(SCT ex Afghanistan, Artificial)__KC344856.1__Gn-4aa-Gc
ucugaagagucuggugacgacuguauaucgaggacucagcuauugaggacagagacugcagagguccauaaugauaacuauggugguccaggugacaaaauuaccaucugcaacgguucaaccauuguagaucagagacuuggcagugaacugggguguuauacuaucaacagagugaagucauucaagcuaugcgaaaauagcgccacgggaaaguccuguaaaauagacagcaccccgguuaagugcaggcaagguuuuugcuuaaaaaucacucaggaaggaaggggccaugugaagcuaucgagaggcucagaaguugucuuagaugccugcgauucaagcugugaaauaaugauaccgaagggcacuggagacauccuaguggacuguucaggugggcagcaacauuucuuaaaagauaauuugauugaucuaggaugcccuaacauuccacuauuagguaaaauggcuaucuauauuuguagaaugucaaaucaucccaaaacaacuauggcuuuucucuuuugguucaguuuugguuauguaauaacauguauauuuugcaaagucauuuuuuauuuauugauaguuguggggacauugggaaaaaaguucaaacaguaucgagagcugaaaccucagacuuguacaauaugugaaacaacuccuaccaaugcaauagaugcugaaaugcacgaucuuaacugcaguuacaauauauguccuuauugugcaucuagauuaaccucggacgggcuugccaggcaugugacacaaugcccuaagcgaaaggaaaaaguagaagagacugaguuguacuugaacuuggaaagaauuccuuggauugucagaaaacuacugcaggugucagagucuacagguguggcacugaagaggagcaguuggcuaauuguguuacuugugcuacuuacaguuucauugucaccgguucaaucggcacccaucgggaggaaaccccuuuucuuaaacaguauagucaagggcaugaaaaaccugcuaaauucaacuaacuuggaaacaagcuuaucaaucgaagcaccauggggagcaauaaauguccagucaaccuuuaaacccacuguaucaacugcaaacauagcacucagcuggaguucaguggaacacagagguaauaaaauucuagucucaggcagaucagagucaauuaugaagcuagaagaaaggacaggaaucagcugggauuugggcguagaagaugccucugagucuaaaucgcuuacuguuucugucauggauuuaucacagauguauucuccugucuucgaguaucugucaggugacagacagguagaggaguggccuaaagcaaccugcacaggcgauugcccggagagauguggcugcacaucaucaaccugcuuacacaaggaauggccccauucaaggaauuggagaugcaaccccacuugguguuggggagucggcacuggaugcaccugcugugggcuagaugugaaagaccuuuucacagauuauauguuugucaaguggaagguugaauacauaaagacagaggccauaguguguguugagcucacuagccaagaaaggcagugcagcuugauugaggcaggaacaagguucaacuuagguccugugaccaucacguugucagagccaagaaacauucagcagaagcuuccuccugaaauaaucacauugcauccuagaauugaggaaggcuuuuucgaucuaaugcauguacaaaaggugcugucugcaaguacagugugcaagcugcaaagcugcacacaugguguuccaggagacuugcaggucuaccacauuggcaacuuguuaaaaggggauaaguuaaacgggcauaugauucacaaaauugagccacacuucaauaccucuuggauguccugggauggcugugaccuagacuauuacuguaauaugggggauuggcccucuugcacauacacuggggugacccaacauaaccaugcugcuuuuguuaacuuacuuaacaucgaaacugauuacacaaagaacuuccacuuucacucuaaaagaguuacugcacauggagacacaccacaauuggacuugaaagcuagaccaacuuacggugcgggugaaaucacuguacuaguggaaguugcugacauggaguuacacacaaaaaagauugauauaucagguuugaaauuugcaagucuaacuugcgcggguugcuaugcuuguagcucuggcaucuccuguaaagucaggauucauguagaugaaccugaugagcuuacaguacaugugaaaagugaagauccggacauuguugcagcuagcacaagccucauugcaaggaagcucgaacuugggacagacagcacauucaaggccuucucagccaugcccaaaaccuccuugugcuucuacauuguggagagagaauacuguaagagcugcagcaaagaggacacacagaaauguguuaacacaaagcuugagcacccacaaggcauuuuaauugagcacaaaggaacaauaaucggaaagcaaaaugacaccugcacagccaaagcaggcugcugguuggagucagucaagaguuuuuuuuauggauugaagaacaugcuuaguggcaucuucggcaacguuuuuauagguauuuucuuauuccuugcuccuuuuguucuauugauacucuucuuuauguuuggguggagacuccuguuuugcuuuaaguguuguagaagaaccagagguuuauucaaguacagacaucucaaggaagaugaagaaucugguuauagaagaaucauugaaagauuaaacaacaaaaaaggaaagaacaagcugcuugauggugaaagacuagcugauagaaggaucgcugagcuguucuccacaaaaacacauauuggu

SEQ ID NO: 3856 - RNA, 2916 nt, Artificial Sequence
  derived and/or modified CDS sequence (wt) from CCHFV(Zahedan 2007, Artificial)__KC867273.1__Gn-4aa-Gc
uccgaagaaucuggugaugacugcauaucaagaacucagcuauugaggacagagacugcagagguccauggcgauaacuauggugguccaggugauaagauaaccaucuguaaugguucaacuguuguagaucaaagacuggguagugaacugggguguuacacuaucaauagagugaggucauucaagcuaugcgaaaacagugccacagggaagagcugugaaauagacaguaucccagucaaguguaagcaggguuuuugccuaaaaaucacucaggaaggaaggggccaugugaaguuaucuagaggcucagaaguugucuuggauguaugugauucaagcugugaagugaugauaccuaagggcacuggugacauucuaguggauuguucaggugggcagcaacauuuuuuaaaagacaaccugguugaccuagggugucccaaaauuccguuacugggcaaaauggcuauuuauaucugcaggaugucgaaucaucccaagacaaccauggccuuccucuuuugguucagcuuuggcuaugugauaacuuguauacuuugcaaggccauuuuuuucuuauuaauaauuuuuggaacacuagggaaaagguucaagcaguacagagaguugaaaccccagaccugcaccauaugugagacaacaccuguaaaugcaauagaugcugaaaugcaugaucucaacugcaguuacaauauaugucccuauugugcgucuagacugacuucagauggacuugcuaggcaugugacacaauguccuagacggaaggagaaaguggaggaaaccgaauuauaccugaauuuagaaagaauucccuggguuguaagaaagcuauugcaggugucagaguccacugguacaguauuaaaaaggagcagcuggcuaauuguauuacuugugcuguucacaguuucauugucaccaguucaaucagcacccauugguagaaggccccuauuucuagauaguauagucaaagauaugaaaaaucugcuaaacucaacaagucuagaaacaagcuuaucaauugaggcaccauggggagcaauuaauguucagucaaccuacaaaccaacuguaucaacugcaaacauagcacuuaguuggagcucaguggaacacagaggcaauaagguuuuggucucaggcagaucagaaucaauuaugaagcuggaagaaaggacaggaaucagcugggaucuuggcguggaagaugccucugagucuaagcuacuuacaguuucagucauggacuugucucagauguacucuccugucuucgaguacuuaucaggugacagacaaguggaagaguggccuaaagcaaccugcacaggugacugcccagaaagauguggcugcacaucaucaaccugcuuacacaaagaguggccccacucaaggaauuggagauguaauccuacuuggugcugggguguagggacuggcugcaccuguugugguuuagacgugaaagaccuuuucacagauuacauguucgucaaguggaaaguugaguacauuaagacagaggccauaguauguguagaacuaaccagucaggaaagacaguguagcuugauugaggcgggcacaagauucaauuuagguucugugacuauuacauugucagagccaaggaacauucaacaaaagcucccuccugaaauaaucacacugcaccccaagauugaggaagguuuuuuugaccuaaugcauguacaaaaagugcuaucggcaagcacaguguguaaguugcagaguugcacacauggugugccaggagaucugcaggucuaccacaucggaaaccuauuaaaaggggacagaguaaacggacacuugauucauaaaauugagcaacacuucaacacauccuggaugucuugggaugguugugaccuagacuacuacuguaacaugggagacuggccuuccugcacauauaccggagucacucagcauaaccaugcuucauuuguaaaccugcucaacauugaaacugauuauacaaaaaccuuucacuuucacucuaaaaggguuacugcacauggagacacaccacaacuagaucugaaggcaaggccaaccuauggugcaggugagaucaccgugcuuguggaaguugcugacauggaguuacacacaaagaagauugaaauaucaggcuuaaaauuugcaggccuaacuugcacagguuguuaugcuuguaguucuggcaucucuuguaaaguuagaauucauguagaugaaccagaugaacuuacaguacauguuaaaagugaugacccagauguaguugcagcuagcucaagucucauggcgaggaagcuugaauuuggaacagacaguacauuuaaagcuuucucagccaugccuaaaaccucccuauguuucuacauuguggaaagagaauacuguaagagcugcaguaaagaagauacacaaaaauguguuaacacgaaacucgaacaaccacagagcauuuugaucgaacauaagggaacuauaauuggaaagcaaaacaauacuugcacggcuaaagcgaguugcugguuagagucaguuaagaguuuuuuuuauggucugaagaauaugcucgguggcauauuuggcaauguuuuuauaggcauuuucacauuucuuacccccuuuaucuuguuaauauuuuucuuuauguuuggguggaggauccuguuuugcuucaaguguugcagaagaaccagaggccuauucaaguacagacaccucaaagacgaugaagaaacugguuacagaaagaucauugaaagacugaacaacaaaaagggaaaaaacaggcugcuugauggugaaagacuugcugacagaaagauugcugaacuguucuccacgaaaacacacauuggc

SEQ ID NO: 3857 - RNA, 2916 nt, Artificial Sequence
  derived and/or modified CDS sequence (wt) from CCHFV(SPU 44/08, Artificial)__KJ682805.1__Gn-4aa-Gc
ucugaagagucuaaugaugacuguuuaucaaggacucagcuauugaggacagagaaugcggaaauucacagugacaacuauggugguccaggugacaagauaacuaucugcaacgguucaacuauuguagaucagagauugggcagugaacuaggguguuacacuaucaauagagugaaaucauuuaagcucugcgaaaacagugcuacagguaaaucuugugaaauagauagcaccccagucagauguaggcaggguuuuugcuugaaaauuacucaggagggaaggggccacgugaagcuaucaagaggcucagaaguugucuuggacgccugugacucaagcugugaaauaaugauaccaaagggcacuggggacauccuaguugacugcucaggugggcagcaacauuuccuaaaagauaaccugguugauuuaggaugccccaacaucccacuguuaggcaaaauggccaucuacauuuguagaaugucaaaucaucccaagacaacuauggcuuuccuuuuuugguuuagcuuugguuaugugauaaccuguauacuuuguaaagcaaucuucuaucuauuaauaguuguagggacauuaggaaaaaaguucaaacaguacagagaguuaaaaccucagaccuguaccauaugugaaacaaauccuguuaaugcaauagaugcugagaugcacgaccucaacugcaguuacaauauauguccuuauugugcaucuagguuaaccucagauggucuugccagacauguaaugcaaugccccaaacggaaggaaaaaauagaagaaaccgaauuauauuuaaacuuagaaagaaucccuuggguuguuaggaaauuacugcaggugucagaauccaccgguguagcacuaaagaggaguaguuggcugguuauacuacuugugcugcucacaguuucauugucaccaguacaaucagcacccaucagcaggaaacccuuguuuuuggacaguauuguuaaaggcaugaagaacuugcuaaauucaacaagccuagaaacaagcuuaucaauugaggcaccauggggggcaauaaauguccaaucaacuuucaaaccaacugugucagcugcaaacauagcgcuuaguuggagcucaguagaacauagaggcaauaaaauuuugguuucaggcagaucagagucaaucaugaaauuagaggaaaggacaggaauuagcugggaucuggguguggaagacgccucugaguccaaauugcucacugucucuguaauggacuugucacaaauguauucuccugucuuugaguaccuaucaggugauagacaaguggaagaauggcccaaggcaaccugcacaggagauugcccagaaagaugcggcugcacgucaucaaccugccuacacaaggaauggccccauucaagaaacuggagaugcaacccuacuugguguuggggagucggcacuggaugcaccuguugugggcuggaugugaaagaccucuuuacagauuacauguuugucaaguggaaaguugacuacauuaaaacagaagcuauaguguguguugagcuuacuagccaggaaagacaauguagcuuaauugaggcaggcacaagauucaacuuggguccugugaccaucacauugucagagccaagaaacauucagcagaagcucccuccagaaauaguuacauugcauccuaggauugaagaaggcuucuuugacuuaaugcauauacaaaaagugcuaucagcaaguacaguauguaagcuacagaguugcacacauggcgugccaggagaccuacagaucuaccacauuggaaacuuguuaaaaggagacaaggugaacgggcaccugauucacaaaauugaaccacacuucaacaccuccuggaugucuugggacggcugugaccuagacuacuacuguaauaugggggauuggccgucuugcucauauacuggcguaacccaacacaaucaugcugcauuuguaaacaugcucaacaucgaaacugauuauacaaaaaacuuccacuuucacucuaagagaguuacagcacauggggacacaccacaauuagauuuaaaagcuagaccaacuuauggugcaggugaaaucacugugcugguagagguugcugacauggaguugcauacaaagaaaauugagauaucagguuugaaguuugcaagcuuaacuugcacaggcuguuaugcuuguaguucuggcaucuccuguaagguuaggauccauguagaugaaccagaugagcuuacaguacaugugaagagcgaggauccagacauaguugcugcuaguucaagucucauggcuaggaagcuugaauuugggacagauagcacauuuaaagccuuuucagccaugcccaaaaccuccuugugcuuuuacauuguggagagggaauacugcaaaagcuguaguaaagaagacacacaaaaaugugucaacacaaagcuugaacaaccacaaagcauuuuaaucgagcacaaagggacgauaaucggaaagcagaacgacacuuguacagccaaagcaaguugcugguuagagucaauuaagaguuuuuuuuauggacuaaagaauaugcuuaguggcauuuuuggcaauguuuucauagggauuuucuuauuccucgcuccuuuuaucaugcuaauacuuuucuucauguuuggauggaggauccuguucugcuucaaguguugcagaagaacuagaggcuuauuuaaguauagacaccucaaagacgaugaagaaaucgguuacaggaaaaucauugagaggcuaaacaacaaaaaagggaaaaacaaacuacuugacggugaaagacuagcugauaggaagaucgcugagcuguucucuacaaaaacacacauuggc

SEQ ID NO: 3858 - RNA, 2916 nt, Artificial Sequence
  derived and/or modified CDS sequence (wt) from CCHFV(SPU 383/87, Artificial)__KJ682806.1__Gn-4aa-Gc
ucugaagagucuaaugaugacuguuuaucaaggacucagcuauugaggacagagaaugcggaaauucacagugacaacuauggugguccaggugacaagauaacuaucugcaacgguucaacuauuguagaucagagauugggcagugaacuaggguguuacacuaucaauagagugaaaucauuuaagcucugcgaaaacagugcuacagguaaaucuugugaaauagauagcaccccagucagauguaggcaggguuucugcuugaaaauuacucaggagggaaggggccacgugaagcuaucaagaggcucagaaguugucuuggacgccugcgacucaagcugugaaauaaugauaccaaagggcacuggggacauccuaguugacuguucaggugggcagcaacauuuccuaaaagauaaccugguugauuuaggaugccccaacaucccacuguuaggcaaaauggcaaucuacauuuguagaaugucaaaucaucccaagacaacuauggcuuuccuuuuuugguuuagcuuugguuaugugauaaccuguauacuuuguaaaguaaucuucuaucuauuaguaguuguagggacauuagggaaaaaguucaaacaguacagagaguuaaaaccucagaccuguaccauaugugaaacgaauccuguuaaugcaauagaugcugagaugcacgaccucaacugcaguuacaauauauguccuuauugugcaucuagguuaaccucagauggucuugccagacauguaauacaaugccccaaacggaaggaaaaaauagaagaaaccgaauuauauuuaaacuuggaaagaaucccuuggguuguuaggaaauuacugcaggugucagaauccaccgguguagcacuaaagaggaguaguuggcugguuauacuacuugugcuacucacaguuucauugucaccaguacaaucagcaccuaucagcaggaaacccuuguuuuuggacaguauuguuaagggcaugaagaacuugcuaaauucaacaagccuagaaacaagcuuaucaauugaggcaccauggggggcaauaaauguccagucaacuuucaaaccaacugugucagcugcaaacauagcgcuuaguuggagcucaguagaacauagaggcaauaaaauuuugguuucaggcagaucagagucaaucaugaaauuagaggaaaggacaggaauuagcugggaucuggguguggaagacgccucugaguccaaauugcucacugucucuguaauggacuugucacaaauguauucuccugucuuugaguaccuaucaggugauagacaaguggaggaauggcccaaggcaaccugcacaggagauugcccagaaagaugcggcugcacgucaucaaccugccuacacaaggaauggccccauucaagaaacuggagaugcaacccuacuugguguuggggagucggcacuggaugcaccuguugugggcuggaugugaaagaccucuuuacagauuacauguuugucaaguggaaaguugacuacauuaaaacagaagcuauaguguguguugagcuuacuagccaggaaagacaauguagcuuaauugaggcaggcacaagauucaacuuggguccugugacuaucacauugucagagccaagaaacauucagcagaagcucccuccagaaauagucacauugcauccuaggauugaagaaggcuucuuugacuuaaugcauauacaaaaagugcuaucagcaaguacaguauguaagcuacagaguugcacacauggcgugccaggagaccuacagaucuaccacauuggaaacuuguuaaaaggagacaaggugaacgggcaccugauucacaaaauugaaccacacuucaacaccuccuggaugucuugggacggcugugaccuagacuacuacuguaauaugggggauuggccaucuugcucauauacuggcguaacccaacacaaucaugcugcauuuguaaacaugcucaacaucgaaacugauuauacaaaaaacuuccacuuucacucuaagagaguuacagcacauggagacacaccacaauuagauuuaaaagcuagaccaacuuauggugcaggugaaaucacugugcugguagagguugcugacauggaguugcauacaaagaaaauugagauaucagguuugaaguuugcaagcuuaacuugcacaggcuguuaugcuuguaguucugguaucuccuguaagguuaggauccauguagaugaaccagaugagcuuacaguacaugugaagagcgaggauccagacauaguugcugcuaguucaagucucauggcuaggaagcuugaauuugggacagauagcacauuuaaagccuuuucagccaugcccaaaaccuccuugugcuuuuacauuguggagagggaauacugcaaaagcuguaguaaagaagacacacaaaaaugugucaacacaaagcuugaacaaccacaaagcauuuuaaucgagcacaaagggacgauauuuggaaagcagaacgacacuuguacagccaaagcaaguugcugguuagagucaguuaagaguuuuuuuuauggacuaaagaauaugcuuaguggcauuuuuggcaauguuuucauagggguuuucuuauuccucgcuccuuuuaucaugcuaauacuuuucuucauguuuggauggaggauccuguucugcuuuaaguguugcagaagaacuagaggcuuauuuaaguauagacaccucaaagacgaugaagaaaucgguuacaggaaaaucauugagaggcuaaacaacaaaaaagggaaaaacaaacugcuugacggugaaagacuagcugauaggaagauugcugagcuguucucuacaaaaacacacauuggc

SEQ ID NO: 3859 - RNA, 2916 nt, Artificial Sequence
  derived and/or modified CDS sequence (wt) from CCHFV(SPU 130/89, Artificial)__KJ682807.1__Gn-4aa-Gc
ucugaagagccuaauuaugacuguuuaucaaggacucagcuauugaggacagagaaugcggaaauucacagugacaacuauggugguccaggugacaagauaacuaucugcaacgguucaacuauuguagaucagagauugggcagugaacuaggguguuacacuaucaauagggugaaaucauuuaagcucugcgaaaacagugcuacagguaaaucuugugaaauagauagcaccccagucagauguaggcaggguuuuugcuugaaaauuacucaggagggaaggggccacgugaagcuaucaagaggcucagaaguugucuuggacgccugugacucaagcugugaaauaaugauaccaaagggcacuggggacauccuaguugacuguucaggugggcagcaacauuuccuaaaagauaaccugguugauuuaggaugccccaacaucccacuguuaggcaaaauggccaucuacauuuguagaaugucaaaucaucccaagacaaccauggcuuuccuuuuuugguuuagcuuugguuaugugauaaccugcauacuuuguaaaguaaucuucuaucuauuaauaguuguagggacauuaggaaaaaaguucaaacaguacagagaguuaaaaccucagaccuguaccauaugugaaacgaauccuguuaaugcaauagaugcugagaugcaugaccucaacugcaguuacaauauauguccuuauugugcaucuagguuaaccucagauggucuugccagacauguaaugcaaugccccaaacggaaggaaaaaauagaagaaaccgaauuauauuugaacuuagaaagaaucccuuggguuguuaggaaauuacugcaggugucagaauccaccgguguagcacuaaagaggaguaguuggcugguuguacuacuugugcuacucacaguuucauugucaccaguacaaucagcaccuaucagcaggaaacccuugucuuuggacaguauuguuaaaggcaugaagaacuugcuaaauucaacaagccuagaaacaagcuuaucaauugaggcaccauggggggcaauaaauguccagucaacuuucaaaccaacugugucagcugcaaacauagcgcuuaguuggagcucaguagaacauagaggcaauaaaauuuugguuucaggcagaucagagucaaucaugaaauuagaggaaaggacaggaauuagcugggaucuggguguggaagacgccucugaguccaaauugcucacugucucuguaauggacuugucacaaauguauucuccugucuuugaguaccuaucaggugauagacaaguggaggaauggcccaaggcaaccuguacaggagauugcccagaaagaugcggcugcacgucaucaaccugccuacacaaagaauggccccauucaagaaacuggagaugcaacccuacuugguguuggggagucggcacuggaugcaccuguugugggcuggaugugaaagaccucuuuacagauuacauguuugucaaguggaaaguugacuacauuaaaacagaagcuauaguguguguugagcuuacuagccaggaaagacaauguagcuuaauugaggcaggcacaagauucaacuuggguccugugaccaucacauugucagagccaagaaacauucagcagaagcucccuccagaaauagucacauugcauccuaggauugaagaaggcuucuuugacuuaaugcauauacaaaaagugcuaucagcaaguacaguauguaagcuacagaguugcacacauggcgugccaggagaccuacagaucuaccacauuggaaacuuguuaaaaggagacaaggugaacgggcaccugauucacaaaauugaaccacacuucaacaccuccuggaugucuugggacggcugugaccuagacuacuacuguaauaugggggauuggccaucuugcucauacacuggcguaacccaacacaaccaugcugcauuuguaaacaugcucaacaucgaaacugauuauacaaaaaacuuccacuuucacucuaagagaguuacagcacauggggacacaccacaauuagauuuaaaagcuagaccaacuuauggugcaggugaaaucacugugcugguagagguugcugacauggaguugcauacaaagaaaguugagauaucagguuugaaguuugcaagcuuaacuugcacaggcuguuaugcuuguaguucugguaucuccuguaaggucaggauccauguagaugaaccagaugagcuuacaguacaugugaagagcgaggauccagacauaguugcugcuaguucaagucucauggcuaggaagcuugaauuugggacagauagcacauuuaaagccuuuucagccaugcccaaaaccuccuugugcuuuuacauuguggagagggaacacugcaaaagcuguaguaaagaagacacacaaagaugugucaacacaaagcuugaacaaccacaaagcauuuuaaucgagcacaaagggacgauaauuggaaagcagaacgacacuuguacagccaaagcaaguugcugguuagagucaauuaagaguuuuuuuuauggacuaaagaauaugcuuaguggcauuuuuggcaauguuuucauagggguuuucuuauuccucgcuccuuuuaucauacuaauacuuuucuucauguuuggauggaggauccuguucugcuuuaaguguugcagaagaacuagaggcuuacuuaaguauagacaccucaaagacgaugaggaaaucgguuacaggaaaaucauugagaggcuaaacaacaaaaaagggaaaaacaaacugcuugacggugaaagacuagcugauaggaagaucgcugagcuguucucuacaaaaacacacauuggc

SEQ ID NO: 3860 - RNA, 2916 nt, Artificial Sequence
  derived and/or modified CDS sequence (wt) from CCHFV(SPU 497/88, Artificial)__KJ682808.1__Gn-4aa-Gc
ucugaagagucuaacgaugacuguuuaucaaggacucagcuauugaggacagagaaugcggaaauucacagugacaacuauggugguccaggugacaagauaacuaucugcaacgguucaacuauuguagaucagagacugggcagugaacuaggguguuacaccaucaauagagugaaaucauuuaagcucugcgaaaacagugcuacagguaaaucuugugaaauagauagcaccccagucagauguaggcaggguuuuugcuugaaaauuacucaggagggaaagggccacgugaagcuaucaagaggcucagagguuguccuggacgccugugauucaagcugugaaauaaugauaccaaagggcacaggggacauccuaguugacuguucaggugggcagcaacauuuccuaaaagauaaccugguugaucuaggaugccccaacaucccacuguuaggcaaaauggccaucuacauuuguagaaugucaaaucaucccaagacaacuaugguuuuccuuuuuugguuuagcuuuggcuaugugauaaccuguauacuuuguaaaguaaucuucuaucuauuaauaguuguagggacguuaggaaaaaaguucaaacaguacagagaguuaaaaccucagaccuguaccauaugugaaacaaacccuguuaaugcaauagaugcugagaugcacgaccucaacugcaguuacaauauauguccuuauugugcaucuagguuaaccucagauggucuugccagacauguaaugcaaugccccaaacggaaggaaaaaauagaagaaaccgaauuauauuuaaacuuagaaagaaucccuuggguuguuaggaaauuacugcaggugucagaauccaccgguguagcacuaaagaggaguaguuggcugguuauacuacuugugcuacucacaguuucauugucaccaguacaaucagcaccuaucagcaggaaacccuuguuuuuggacaguauuguuaaaggcaugaggaacuugcuaaauucaacaagccuagaaacaagcuuaucaauugaggcaccauggggggcaauaaauguccagucaacuuucaaaccaacugugucagcugcaaacauagcgcuuaguuggagcucaguagaacauagaggcaauaaaauuuugguuucaggcagaucagagucaaucaugaaauuagaggaaaggacaggaauuagcugggaucuggguguggaagacgccucugaguccaaacugcucacugucucuguuauggacuugucacaaauguauucuccugucuuugaauaccuaucaggugauagacaaguggaggaauggcccaaggcaaccugcacaggagauugcccagaaagaugcggcugcacgucaucaaccugccuacacaaggaauggccccauucaagaaacuggagaugcaacccuacuugguguuggggagucggcacuggaugcaccuguuguggguuggaugugaaagaccucuuuacagauuacauguuugucaaguggaaaguugacuacauuaaaacagaagcuauaguguguguugagcuuacuagccaggaaagacaauguagcuuaauugaggcaggcacaagauucaacuuggguccugugaccaucacauugucagaaccaaggaacauucagcaaaagcucccuccagaaauagucacauugcauccuaggauugaagaaggcuucuuugacuuaaugcauauacaaaaaguacuaucagcaaguacaguauguaagcuacagaguugcacacauggcgugccaggagaccuacagaucuaccacauuggaaacuuguuaaaaggagacaaggugaacgggcaccugauucacaaaauugaaccacacuucaacaccuccuggaugucuugggacggcugugaccuagacuacuacuguaacaugggggauuggccaucuugcucauauacuggcguaacccaacacaaucaugcugcauuuguaaacaugcucaacaucgaaacugauuauacaaaaaacuuccacuuucacucuaagagaguuacagcacauggagacacaccacaauuagauuuaaaagcuagaccaacuuauggugcaggugaaaucacugugcugguagagguugcugacauggaguugcauacaaagaaaauugagauaucagguuugaaguuugcaagcuuaacuugcacaggcuguuaugcuuguaguucugguaucuccuguaagguuaggauccauguagaugaaccagaugagcuuacaguacaugugaagagcgaggauccagacauaguugcugcuaguucaagucucauggcuaggaagcuugaauuugggacagauagcacauuuaaagccuuuucagccaugcccaaaaccuccuugugcuuuuacauuguggagagggaauacugcaaaagcuguaguaaagaagacacacaaaaaugugucaacacaaagcuugaacaaccacaaagcauuuuaaucgagcacaaagggacgauaauuggaaaacagaacgacacuuguacagccagagcaaguugcugguuagagucaaucaagaguuuuuuuuauggacugaagaauaugcuuaguggcauuuuuggcaauguuuucauagggauuuucuuauucuucgcuccuuuuaucaugcuaauacuuuucuuuauguuuggauggaggauccuguucugcuuuaaguguugcagaagaacuagaggcuuguuuaaguauagacaccucaaagacgaugaagaagucgguuacaggaaaaucauugagaggcuaaacaacaaaaaagggaaaaacaaacugcuugacggugaaagacuagcugauaggaagaucgcugagcuguucucuacaaaaacacacauuggc

SEQ ID NO: 3861 - RNA, 2916 nt, Artificial Sequence
  derived and/or modified CDS sequence (wt) from CCHFV(SPU 18/88, Artificial)__KJ682810.1__Gn-4aa-Gc
ucugaagagucuaaugaugacuguuuaucaaggacucagcuauugaggacagaaaaugcggaaauucacagugacaacuauggugguccaggugacaagauaacuaucugcaacgguucaacuauuguagaucagagacugggcagugaacuaggauguuacacuaucaauagagugaaaucauuuaagcucugugaaaacagugcuacagguaaaucuugugaaauagauagcaccccagucagauguaggcaggguuuuugcuugaaaauuacucaggagggaaggggccacgugaagcuaucaagaggcucagaaguugucuuggacgccugugauucaagcugugaaauaaugauaccaaagggcacuggggacauccuaguugacuguucaggugggcagcaacauuuccuaaaagauaaccugguugaucuaggaugccccaacaucccacuguuaggcaaaauggccaucuacauuuguagaaugucaaaucaucccaagacaacuauggguuuccuuuuuugguuuagcuuugguuaugugauaaccuguauacuuuguaaaguaaucuucuaucuauuaauaguuguagggacauuagggaaaaaguucaaacaguacagagaguuaaaaccucagaccuguaccauaugugaaacgaauccuguuaaugcaauagaugcugagaugcacgaccucaacuguaguuacaauauauguccuuauugugcaucuaggcugaccucagauggucuugccagacauguaaugcaaugccccaaacggaaggaaaaaauagaagaaaccgaauuauauuuaaacuuagaaagaauccccuggguuguuaggaaauuacugcaggugucagaauccaccgguguagcacuaaagaggaguaguuggcugguuauacuacuugugcuacucacaguuucauugucaccaguacaaucagcaccuaucagcaggaaacccuuguuuuuggacaguauuguuaaaggcaagaagaacuugcuaaauucaacaagccuagaaacaagcuuaucaauugaggcaccauggggggcaauaaauguccagucaacuuucaaaccaacugugucagcugcaaacauagcgcuuaguuggagcucaguagaacauagaggcaauaaaauuuugguuucaggcagaucagagucaaucaugaaauuagaggaaaggacaggaauuagcugggaucuggguguggaagacgccucugaguccaaauugcucacugucucuguuauggacuugucacaaauguauucuccugucuuugaguaccuaucaggugauagacaaguggaggaauggcccaaggcaaccugcacaggagauugcccagagagaugcggcugcacgucaucaaccugccuacacaaggaauggccccauucaagaaacuggagaugcaacccuacuugguguuggggagucggcacuggaugcaccuguugugggcuggaugugaaagaccucuuuacagauuacauguuugucaaguggaaaguugacuacauuaaaacagaagcuauaguguguguugagcuuacuagccaggaaagacaauguagcuuaauugaggcaggcacaagauucaacuuggguccugugaccaucacauugucagagccaagaaacauucagcaaaagcucccuccagaaauagucacauugcauccuaggauugaagaaggcuucuuugacuuaaugcauauacaaaaagugcuaucagcaaguacaguaugcaagcuacagaguugcacacauggcgugccaggagaccuacagaucuaccacauuggaaacuuguuaaaaggagacaaggugaacgggcaccugauucacaaaauugaaccacacuucaacacuuccuggaugucuugggacggcugugaccuagacuacuacuguaauaugggggauuggccaucuugcucauauacuggcguaacccaacacaaucaugcugcauuuguaaacaugcucaacaucgaaacugauuauacaaaaaacuuccacuuucacucuaagagaguuacagcacauggagacacaccacaauuagauuuaaaagcuagaccaacuuauggugcaggugaaaucacugugcugguagagguugcagacauggaguugcauacaaagaaaauugagauaucagguuugaaguuugcaagcuuaacuugcacaggcuguuaugcuuguaguucugguaucuccuguaagguuaggauccauguagaugaaccagaugagcuuacaguacaugugaagagcgaggacccagacauaguugcugcuaguucaagucucauggcuaggaagcuugaauuugggacagauagcacauuuaaagccuuuucagccaugcccaaaaccuccuugugcuuuuacauuguggagagggaauacugcaaaagcuguaguaaagaagacacacaaaaaugugucaacacaaagcuugaacaaccacaaagcauuuuaaucgagcacaaagggacgauaauugggaagcagaacgacacuuguacaggcaaagcagguugcugguuagagucaaucaagaguuuuuuuuauggacuaaagaauaugcuuaguggcauuuuuggcaauguuuucauagggauuuucuuauuccuagcuccuuuuaucaugcuaauacuuuucuucauguuuggauggaggauccuguucugcuuuaaguguugcagaagaacuagaggccuauuuaaguauagacaccucaaagacgaugaagaaaucgguuacaggaaaaucauugagaggcuaaaaaacaaaaaagggaaaaacaaacugcuugauggugaaagacuagcugauaggaagaucgcugagcuguucucuacaaaaacacacauuggc

SEQ ID NO: 3862 - RNA, 2916 nt, Artificial Sequence
  derived and/or modified CDS sequence (wt) from CCHFV(SPU 431/85, Artificial)__KJ682812.1__Gn-4aa-Gc
uccgaggagucugauggugacuguauaucaagaacucaacuauugaggacagagacuacagaaauccacagugacaacuaugguggcccaggugacaaaauaacuaucugcaaugguucaacuauuguagaucaaagacuaggcagugaacugggguguuauacuaucaauagggugaagucauuuaagcuuugcgaaaacagugccacaggaaaaucuugugaaauagauagcaccccaguuaagugcagacaagguuuuugcuugaaaaucacucaagaagggaggggccacgugaagcugucgagaggcucggaaauugucuuggacgcuugcgauucaaacugugaaauaaugauaccaaagggcaccggagacaucuuaguugacuguucagguggacaacaacauuucuuaaaagauaauuugauugaucuuggaugucccaauaucccauuauuaggcaaaauggccaucuacauuugcagaauguccaaucauccuaaaacaaccauggccuuucucuuuugguuuagcuuugguuaugugauaaccuguauacuuuguaaggugaucuuuuaccuauugauaguugcagggacaguaggaaaaaaguucaaacaguauagagaguugagaccucagaccugcaccauaugugaaacaauuccugucaaugcaauagaugcugaaaugcaugaccucaacugcaguuacaauauauguccguauugcgcaucuagauuaaccucagauggucuugccagacauguaaugcaaugcccuaagcggaaggaaaaaguagaggaaacugaauuauacuuaaaccuagaaaggauucccuggguuguuaggaaauuauugcaaguuucagagucuaccgguguggcauugaagaggagcaguuggcugacagugcugcuuguguugcuuauagucucauugucaccggugcagucagcaccuauugguagaaaacccuuauuuuuagacaguauuguuaaaggcaggaagaacuugcuaaacucaacaagcuuggaaacaagcuuaucaauugaggcaccauggggugcaauaaauguccaaucaaccuucaaacccacugugucagcugcaaacauagcacuuagcuggagcucaguggaacacagaggcaacaagauuuugguuucaggcaggucagaaucaaucaugaagcuggaggaaaggacaggaaucagcugggaucugggaguagaagacgccucugaguccaaauugcucaccgucucugucauggacuugucacaaauguauucccccgucuuugaguaccugucaggugauagacagguagaagaguggcccaaggcgaccuguacaggcgauugcccagaaagauguggcugcacaucaucaaccuguuugcacaaggaauggccccauucaaggaacuggagaugcaaccccacuugguguuggggggucggcacuggaugcaccuguugugggcuagauguaaaagaccucuuuacagauuacauguuugucaaguggaaaguugaauacauaaaaacagaggccauagugugugucgaacuuacuagccaagaaaggcaauguagcuugauugaagcaggcacaagauucaauuuagguccugugacuaucacauuaucggagccaagaaacauucagcaaaagcucccuccagaaauaauuacauugcauccuagaauugaagaaggcuuuuuugacuuaaugcaugugcaaagagugcugucagcaagcacagugugcaagcuacagaguugcacacauggugugccaggagaccuacaggucuaccacaucggaaacuuguuaaaaggagacaagguaaacgggcaucugauucacaagauugaaccacauuucaacacuuccuggaugucuugggauggcugugaccuagauuacuacugcaauaugggggauuggccuucuugcacauacacuggaguaacccaacauaaccaugcugcauuuguaaauuugcucaauaucgaaaccgauuauacaaaaaacuuucauuuucacuccaagagaguuacugcacauggagacacaccacaauuagacuugaaggccagaccaacuuauggugcaggggagguuacuguacuaguggagguugcugacauggagcugcacacaaagaaaauugagauaucaggcuugaaguuugcaagucuaacuugcacaggcugcuaugcuuguagcucugguaucuccuguaaggucaagauccauguagaugaaccagaugagcuuacaguacaugugaagagugaagacccagacauaguugcugcaggcucaagucucauggcaaggaagcuugaauuuggggcagauaguacauucaaagccuuuucagccaugcccaaaaccuccuugugcuuuuauauuguggagagagaauacuguaagagcugcaguagagaggacacacgaaaauguguuaacacuaagcuugaucgaccacagagcauuuugaucgaacauaaaggaacgauuauuggaaagcaaaacaacacaugcacagcuaaagcaagcugcuggcuagagucagucaaaaguuuuuucuacggauugaagaauaugcuuaguggcauuuucgguaauguuuucauagggauuuucuuauucauugcuccuuuuguccuguuaauacuuuucuuuauguuuggguggaggauccuguucugcuuuaagugcugcagaagaaccagaggccuauuuaaguacagacaccucaaggacgaugaagaaaccgguuacaggaaaaucauugagaggcuaaauaacaaaaagggaaaaaacaaacuacuugauggggaaaggcuagcugauaggaaaaucgccgaguuauucuccacaaaaucacauaucggc

SEQ ID NO: 3863 - RNA, 2916 nt, Artificial Sequence
  derived and/or modified CDS sequence (wt) from CCHFV(SPU 48/90, Artificial)__KJ682813.1__Gn-4aa-Gc
uccgaagaacccagugaugacugcauaucaagaacucagcuauugaggacagagacugcagagauccacggcgacaacuaugguggcccgggugacaaaauaacuaucugcaauggcucaacuauuguagaccaaagacugggcagugagcuaggguguuacacuaucaacagagugaagucauucaagcuaugcgaaaauagugccacagggaagagcuguguaauagacagugucccaguuaaaugcaggcaagguuauugucuaagaaucacucaggaaggaaggggccauguaaaauuaucuaggggcucagagguugucuuagaugcaugcgauacaagcugugaaauaaugauaccuaagggcaccggugacauccuaguugacuguucaggugggcagcaacauuuucuaaaggacaauuugauagaucuaggaugccccaaaauuccauuauugggcaaaauggcuaucuacauuugcagaaugucgaaucaccccacaacaaccauggcuuuccucuucugguucagcuuuggcuauguaauaacuuguauacuuugcaaggccaucuuuuacuuguuaauaauuauuggaacacuagggaaaagguucaggcaguauagagaguuaaaaccucagaccugcaccauaugugagacaacuccuguaaaugcaauagaugcugagaugcaugaccucaauugcaguuacaacauuugucccuacugugcaucuagacuaaccucagaugggcuugcuaggcaugugacacagugcccuaagcggaaggagaaaguggaagaaacugaacuguacuugaacuuagaaagaauuccuuggguuguaagaaagcuauugcagguaucagaguccaccgguguggcauugaaaagaagcagcuggcugauugugcugcuugugcuguucacgguuucauugucgccaguucaaucagcacccauugguagaaagccucuauuccgagacaguauaguuaaaggcaugaaaaaucugcuaaacucaacaaguuuagaaacaagucuaucaauugaggcaccauggggggcaauaaauguucagucaaccuacaagccaacugugucgacugcaaacauagcacucagcuggagcucaguggaacacagaggcaauaagaucuugguuucaggcagaucagaaucaauuaugaagcuggaagaaaggacagggaucagcugggaucucggcguagaagacgccucugaguccaaacugcuuacagucucugucauggacuugucucagauguacucuccugucuucgaguacuuaucaggagacagacagguggaagaguggcccaaagcaacuuguacaggugacugcccagaaagauguggcugcacaucaucaacauguuugcacaaagaauggccccacucaagaaauuggagaugcaauccuacuuggugcugggguguagggacuggcugcaccuguuguggauuagaugugaaagaccuuuuuacagauuauauguuugucaaguggaaaguugaauacaucaagacagaggccauaguguguguagaacuuaccagucaggaaaggcaguguagcuugauugaagcgggcacaagguucaauuuagguccugugaccaucacacugucagaaccaagaaacauccaacagaagcucccuccugaaauaaucacacuacauccuaggauugaagaagguuuuuuugaccugaugcacguucagaaaguguuaucagcaagcacaguguguaaguugcagaguugcacacaugguguaccaggagaccuacaggucuaccacaucggaaauuuauuaaaaggggacaagguaaauggacaucuaauucauaaaauugagccacacuucaacacuuccuggauguccugggaugguugugaccuagacuacuacugcaacaugggagauuggccuucuugcacauacacaggagucacccaacacaaucgugcuucauuuguaaaccugcucaacauugaaacugauuacacaaaaaacuuccauuuucacucuaaaagggucacugcacacggagacacaccacaacuggaucuuaaggcaagaccaaccuauggugcaggugagauuacuguacugguagaaguugcugacauggaguuacacacaaagaagauugaaauaucaggcuuaaaauuugcaagcuugacuugcacagguuguuaugcuuguagcucuggcaucucaugcaaaguuagaauucauguggacgaaccagaugaacuuacagugcauguuaaaagugaugauccagauguaguugcagcuagcucaagccucauggcaagaaagcuugaauuuggaacagacagcacauuuaaagcuuucucagccaugccuaaaacuucgcuauguuucuacauuguugaaaaagaauacugcaagagcugcagugaagaagacacaaaaaaauguguuaacacaaaacuugagcaaccacaaagcauuuugaucgaacacaagggaacuauaaucggaaagcaaaacagcacuugcacagccaaagugaguugcugguuagagucagccaagaguuuuuuuuauggucuaaaggacaugcuuaguggcauuuuuggcaaugucuuuauagguauuuucuuguuccuugcccccuucauccuguuaauacuauucuuuauguuuggguggaggauccuacuuugcuuuaaauguuguagaagaacuagaggccuguucaaguauagacaccucaaggacgaugaagaaacugguuauagaaggauuauugaaagacuaaacaauaaaaaaggaaaaaacaaauugcuugauggugaaagacuugcugauagaagaauugcugaacuguucuccacaaaaacacacauuggc

SEQ ID NO: 3864 - RNA, 2916 nt, Artificial Sequence
  derived and/or modified CDS sequence (wt) from CCHFV(SPU 187/90, Artificial)__KJ682814.1__Gn-4aa-Gc
uccgaagaaccuagugaugacugcauaucgagaacucaacuauugaggacagagacugcagagauccacggcgacaacuaugguggcccgggugacaaaauaaccaucugcaacggcucaacuauuguagaccaaagacugggcagugagcuaggguguuacacuaucaauagagugaagucauucaagcuaugcgaaaauagugccacagggaagagcugugaaauagacagugucccaguuaaaugcaggcaggguuauugccuaagaaucacucaggaagggaggggccauguaaaauuaucuaggggcucagagguugucuuagaugcaugcgauacaagcugugaaauaaugauaccuaagggcacuggugacauccuaguugacuguucaggugggcagcaacauuuucuaaaggacaauuugauagaucuaggaugccccaaaauuccauuauugggcaaaauggcuauuuacauuugcagaaugucgaaucaccccaaaacaaccauggcuuuccuuuucugguucagcuuuggcuacguaauaacuuguauacuuugcaaggccaucuuuuacuuguuaauaauuauuggaacgcuagggaagagguucaagcaguauagagaguuaaaaccucagaccugcaccauaugugagacaacuccuguaaaugcaauagaugcugagaugcaugaccucaacugcaguuacaacauuugucccuacugugcaucuagacuaaccucagaugggcuugcuaggcaugugacacaaugcccuaagcggaaggagaaaguggaagaaacugaacuauacuugaacuuagaaagaauuccuuggguuguaagaaagcuguugcagguaucagaguccacugguguggcauugaaaagaagcagcuggcugauugugcugcuugugcuguucacgguuucauugucaccaguucaaucagcacccauugguagaaggccucuauuccuagauaguauaguuaaagguaugaaaaaucugcuaaauucaacaaguuuagaaacaaguuuaucaauugaggcaccauggggggcaauaaauguucagucaaccuacaaaccaacugugucaacugcaaacauagcacucaguuggagcucuguggaacacagaggcaauaagaucuugguuucaggcagaucagaaucaauuaugaagcuggaagaaaggacaggaaucagcugggaccucggcguggaagacgccucugagucuaaacugcuuacagucucugucauggacuugucucagauguacucuccugucuucgaguacuuaucaggagacagacagguggaagaguggcccaaggcaacuuguacaggugacugcccagaaagauguggcugcacaucaucaacauguuuacacaaagaauggccccacucaagaaauuggaggugcaaucccacuuggugcugggguguagggacuggcugcaccuguuguggauuagaugugaaggaccuuuuuacagauuauauguuugucaaguggaaaguugaauauauuaagacagaagccauaguguguguagaacuuaccagucaggaaaggcaguguagcuugauugaagcaggcacaagguucaauuuagguccuguaaccaucacacugucagaaccacgaaacauccaacagaagcucccuccugaaauaaucacacugcaucccaggaucgaagaagguuuuuuugaccugaugcauguacagaaaguguuaucggcaagcacaguguguaaguugcagaguugcacacauggugugccaggagaccuacaggucuaccacaucgggaauuuauuaaaaggggauaaggugaauggacaucuaauucauaaaauugagccacacuucaacacuuccuggauguccugggaugguugugaccuagacuacuacugcaacaugggagauuggccuucuugcacauacacaggagucacccaacacaaucaugcuucauuuguaaaccugcucaacauugaaacugauuacacaaaaaacuuccacuuucacucuaaaagggucacugcacacggagacacaccacaacuagaucuuaaggcaagaccaaccuauggugcaggugagaucacuguacugguagaaguugcugacauggaguuacacacaaagaagauugaaauaucaggcuuaaaauuugcaagcuugacuugcacaggcuguuaugcuuguagcucuggcaucucaugcaaaguuagaauucauguggaugaaccagaugaacuuacaguacauguuaaaagugaugauccagauguaguugcagcuagcucaagucucauggcaagaaagcuugaauuuggaacagacaguauauuuaaagcuuucucagccaugccuaaaacuucucuauguuucuacauuguugaaagagaacacuguaagagcugcagcgaagaagacacuaaaaaauguguuaacacaaaacuugagcaaccacaaagcauuuugaucgaacacaagggaacuauaaucggaaagcaaaacagcacuugcacagccaagacgaguugcugguuagagucagucaaaaguuuuuuuuauggucuaaagaacaugcuuaguggcauuuuuggaaauguuuuuauagguauuuucuuguuccuugcccccuucauccuguuaauacuguucuuuauguuuggguggaggauccuauuuugcuuuaaauguugcagaagaacuagaggccuguucaaguauagacacuuaaaggacgaugaagaaacugguuauagaaggauuauugaaagauuaaacaauaaaaaaggaaaaaacaaacugcuugauggugaaagacuugcugauagaagaauugccgaacuguucucuacaaaaacacacauuggc

SEQ ID NO: 3865 - RNA, 2916 nt, Artificial Sequence
  derived and/or modified CDS sequence (wt) from CCHFV(Haskovo-V46/13, Artificial)__KR092379.1__Gn-4aa-Gc
uccgaagagcuaggugaugacuguauaucaagaacucagcuauugaggacagaaacagcagagauacaugaugacaacuauggugguccaggugauaaaauaacuaucugcaaugguucaaccauuguagaucagagacugggcagugaacuaggauguuauaccaucaacagggggaagucauucaagcuaugcgaaaacagcgcuacagggaaaaccugugagauagacagcacuccgguuaagugcaggcaagguuuuuguuuaaaaaucacccaagagggaaggggccacguaaaauuaucuagaggcucagagguuguccuggaugcuugcgacucaagcugugaaguaaugauaccuaaaggcacuggagauauccuaguggacuguucaggugggcagcaacauuucuuaaaagacaacuuaauugaccuagggugcccccauaucccgcuauuggguaagauggcuauuuacauuugcagaaugucuaaucauccuagaacaaccauggcuuuucucuucugguuuagcuuuggcuaugugaucacuuguauauuuugcaaggcucuuuuuuauucauugauaauuauugggacacuagggaaaaaaaucaagcaauauagggaacugaaaccucaaaccugcaccauaugugagacaacuccugucaaugcaauagaugcugaaaugcaugaccucaacuguaguuacaauauaugcccuuauugugcaucaagauugaccuccgaugggcuagccaggcauguaacacaaugccccaagcggaaagagaaaguugaggagacugaacuguaccugaaccuggaaagaauuccuuggauugucagaaagcuauugcaggugucagaguccaccgguguggcauugaaacgaagcagcuggcugauuguacugcuuguguuacucccaguuucauugucgccgguucaaucagcaccuguugguagaaagccccuuuucuuagacaguauaguuaaagguaugaaaaauuugcuaaacucaacaagcuuggaaacaagcuuaucaauugaggcaccauggggagcaauaaauguccagucaaccuuuaaaccaacaguaucgacugcaaacauagcacucaguuggagcucaguggagcacagaggcaacaagaucuuagucacaggcaggucugaaucaaucaugaaacuagaggaaaggacaggagucagcugggaucuaggcguagaagaugccucagaauccaaauuacuuaccguuucuaucauggauuuaucacaaauguauuccccuguuuuugaguacuugucaggggacagacagguugaagaauggccaaaagcaacuuguacaggugauugcccagaaagguguggcugcacaucaucaaccugcuuacauaaagaauggccucacucaagaaacuggagaugcaaucccacuuggugcuggggaguaggaaccggcugcaccuguugcgggguggauguaaaagaccuuuuuacggaucacauguucgucaaauggaaaguugaauacauaaaaacugaagccauaguauguguugagcucaccagccaagaaagacagugcagucugauugaggcagguacuagauucaacuugggcccugugacuauuacccugucugagccaagaaacauucagcagaagcuucccccugaaauuaucacguugcaucccaaaauugaagaaggcuucuuugacuugaugcauguacaaaaaguguugucugcaaguacaguguguaaacugcagaguugcacacaugguauaccaggagaucuacaaguuuaccacauuggcaacuuguugaaaggggauagaguaaacgggcaucuaauucacaaaauugaaccacauuucaacaccucuuggauguccugggaugguugugauuuagauuacuacugcaacaugggggauuggccuucuugcacauacacaggagugacccagcauaaccaugcugcauuuguaaacuugcuuaacauugaaacugauuacacgaaaaccuuccacuuccacucuaaaagaguuacagcacauggugacacaccacaauuggacuuaaaagcaaggccgaccuacggugcaggugagaucacugugcugguugagguugcugacauggaguugcauaccaagaaaguugaaauaucaggcuugaaauuugcaaguuugacuugcacggguugcuaugcuuguagcucuggcaucuccugcaaaguuaggauucauguagaugaaccagaugagcuuacaguacauguaaagagcagugauccugaugugguugcagcuggcacaagucuuauggcgaggaagcuugaauuuggaacagacagcacauucaaggccuuuucagcuaugcccaaaaccucuuuauguuuuuacauuguggagagagaauacugcaagagcugcagugaagaugauacacaaaaauguguugacacaaaacuugagcagccacagagcauacuaauugagcacaaaggaacaauaauuggaaagcagaaugauacuugcacagccagggcaagcuguuggcuagagucagucaagaguuuuuuuuauggauugaagaauaugcuuggcaguguuuuugguaauuuuuuaauaggcauuuuguuauuccuugccccuuuuguccuguuggugcuuuucuuuauguuuggguggaaaaucuuguuuugcuuuaaauguugcaggaggaccagaggcuuauucaaauauagacaccucaaagacgaugaggaaacaggcuacagaaggauuauugaaagacugaacagcaaaaaagggaaaaacagacugcuugauggugaaaggcuggcugauaggaaaauugcugagcuguucuccacaaaaacacacauuggc

SEQ ID NO: 3866 - RNA, 2916 nt, Artificial Sequence
  derived and/or modified CDS sequence (wt) from CCHFV(24-R-2012, Artificial)__KR814856.1__Gn-4aa-Gc
uccgaggagccaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauaccaucaacagggugaagucauucaagcuaugcgaaaacagcgccacagggaaaaccugugagauagacagcacuccgguuaagugcaggcaagguuuuuguuuaaaaaucacccaagagggaaggggccacguaaaauuaucuagaggcucagagguuguuuuggaugcuugcgacacaagcugcgaaguaaugauaccuaaaggcacuggagauauccugguggacuguucagguggacagcaacauuucuuaaaagacaauuuaauugaccuagggugcccccauaucccgcuauuggguaaaauggccauuuacaucugcagaaugucaaaucauccuagaacaacuauggcuuuucucuucugguucagcuuuggcuaugugaucaccuguauauuuugcaaggcucuuuuuuauucauugauaauuauugggacacuagggaaaaagaucaagcaauauagggaauugaaaccucaaacuuguaccauaugugagacagcuccugucaaugcaauagacgcugaaaugcaugaccuuaacugcaguuacaauauaugcccuuauugugcaucaagauugaccuccgaugggcuagcuaggcaugugccacaaugccccaagcggaaggaaaaaguugaggagacugagcuguacuugaaccuggaaagaauuccuuggauugucagaaagcuauugcaagugucagaguccacugguguggcauugaaacgaagcagcuggcugauuguacugcuuguguuacucacaguuucauugucaccgguucaaucagcaccuguugguagaaaaccucuguucuuagacaguauaguuaaaggcaugaagaauuugcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguagaagaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaacuugcuugcauaaagaauggccucacucaagaaacuggagauguaaucccacuuggugcuggggaguaggaacuggcugcaccugcugcgggguggauguaaaagaccuuuuuacagaucacauguuugucaaauggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcaugugcaaaaaguguugucugcaaguacaguguguaaacugcagaguugcacacaugguauaccaggagaucuacaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaauaucgaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcauaccaagaaaguugagauaucaggcuuaaaauuugcaagucuggcuugcacggguugcuaugcuuguagcucuggcaucuccuguaaagucaggauucauguagaugagccagaugagcucacaguacauguaaagagcaaugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaaugauacuugcacagccaaggcaagcuguuggcuagagucagucaagaguuuuuuuuauggauugaaaaauaugcuugguaguguauuugguaacuuuuucauaggcauuuuguuauuccuugccccuuuuguccuguuggugcuuuucuuuauguuuggauggaaaaucuuguuuugcuucaaauguugcaggaggaccagaggcuuacuuaaguauagacuccucaaagacgaugaggaaacaggcuacagaaggauuauugaaagacugaacaacaaaaaaggaaaaaacagacugcuugauggugaaagguuggcugauaggaaaauugcugagcuguucuccacaaaaacacacauuggu

SEQ ID NO: 3867 - RNA, 2916 nt, Artificial Sequence
  derived and/or modified CDS sequence (wt) from CCHFV(36-ST-2014, Artificial)__KR814857.1__Gn-4aa-Gc
uccgaagagccaggugacgacugcauaucaagaacucagcuauugaagacagaaacagcagagauccaugacgacaacuauggugguccaggugacaaaauaacuaucugcaaugguucaaccauuguagaucagagacugggcagugaacuaggguguuauaccaucaacaggguaaagucauucaagcuaugcgaaaacagugccacagggaaaaccugugagauagacagcacuccggucaagugcaggcaagguuuuuguuugaaaaucacccaagaggggaggggccacguaaaauuauccaggggcucagagguuguuuuggaugcuugcgacucgagcugugaaauaaugauaccuaaaggcacuggagauauccuaguagacuguucagguggacagcaacauuucuuaaaagacaacuugauugaccuagggugcccucauaucccgcuauuggguaagauggccauuuacauuugcagaaugucaaaucaucccaggacaaccauggcuuuccucuucugguucaguuuuggcuauguaaucaccuguauauuuugcaaagcucuuuuuuauucauugauaauuauugggacacuaggaaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuagcuaggcaugugacacaaugcccuaagcgaaaggagaaaguugaggagacugaacuguauuugaaccuggaaagaauuccauggauagucagaaagcuguugcaagugucagaguccacugguguggcauugaaacgaagcagcuggcugauugugcugcuuguguuacucacagucucauugucaccgguucaaucagcaccuguugguaggaaaccucuuuucuuagacaguauaguuaaagguaugaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggauuugucacaaauguauuccccuguuuuugaguacuuaucaggagauagacagguugaagaauggcccaaggcaaccugcacaggugauugcccagaaagguguggcugcacaucaucaaccugcuugcauaaagaauggccucacucaagaaacuggagauguaaucccacuuggugcuggggaguaggaaccggcugcacaugcugcggaguggauguaaaagaccuuuuuacagaucacauguuuaucaaauggaagguugaauauauaaaaaccgaagccauaguauguguugagcucaccagccaagaaagacagugcagucugauugaggcagguacuagauucaacuuggguccugugacuaucacccugucugagccaagaaacauucagcagaagcuucccccugagaucauuacgcugcauccuaaaauugaagaaggcuucuuugacuugaugcaugugcaaaaaguguuaucugcaaguacaguguguaaacugcagaguugcacacaugguauaccaggagaucuacaaauuuaccacauuggcaacuuguugaaaggggauagauuaaacgggcaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccauucuaaaagagucacagcacauggagacacaccacaauuagacuuaaaagcaaggccgacuuacggugcaggugagaucacugugcugguugagguugcugacauggaguugcauaccaagaaaguugagauaucaggcuugaaauuugcaagucuggcuugcacggguugcuaugcuuguagcucuggcaucuccuguaaagucagaauucauguagaugaaccggaugagcucacagugcauguaaagagcagugauccagaugugguugcagcuagcacaagccuuauggcaaggaagcuugaauuugggacagauagcacauucaaggcauuuucagcuaugcccaaaaccucuuuaugcuuuuacauuguggagagggaauacugcaagagcugcagugaagaugauacaaaaaaauguguugacacaaaacuugaucagccacagagcauacuaauugagcacaaagggaccauaauuggaaagcagaaugacacuugcacagccaaggcaaguuguuggcuagagucagucaagaguuuuuuuuauggauugaagaauaugcuuggcaguguuuuugguaauuuuuucguaggcauuuuguuauuccuugcccccuuugucuuguuggugcuuuucuuuauguguggauggaaauucuuguuuugcuuuaaguguugcaggaggaccagaggcuuguuuaaguauagacaccucaaagaugaugaggaaacaggcuacagaaggauuauugaaagacugaacagcaaaaaaggaaagaacagacugcuugauggugagagguuggcugauaggaaaauugcugagcuguucucuacaaaaucacacauuggc

SEQ ID NO: 3868 - RNA, 2916 nt, Artificial Sequence
  derived and/or modified CDS sequence (wt) from CCHFV(37-R-2013, Artificial)__KR814858.1__Gn-4aa-Gc
uccgaggagccaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauaccaucaacagggugaagucauucaagcuaugcgaaaacagcgccacagggaaaaccugugagauagacagcacuccgguuaagugcaggcaagguuuuuguuuaaaaaucacccaagagggaaggggccacguaaaauuaucuagaggcucagagguuguuuuggaugcuugcgacacaagcugcgaaguaaugauaccuaaaggcacuggagauauccugguggacuguucagguggacagcaacauuucuuaaaagacaauuuaauugaccuagggugcccccauaucccgcuauuggguaaaauggccauuuacaucugcagaaugucaaaucauccuagaacaacuauggcuuuucucuucugguucagcuuuggcuaugugaucaccuguauauuuugcaaggcucuuuuuuauucauugauaauuauugggacacuagggaaaaagaucaagcaauauagggaauugaaaccucaaacuuguaccauaugugagacagcuccugucaaugcaauagacgcugaaaugcaugaccuuaacugcaguuacaauauaugcccuuauugugcaucaagauugaccuccgaugggcuagcuaggcaugugccacaaugccccaagcggaaggaaaaaguugaggagacugagcuguacuugaaccuggaaagaauuccuuggauugucagaaagcuauugcaagugucagaguccacugguguggcauugaaacgaagcagcuggcugauuguacugcuuguguuacucacaguuucauugucaccgguucaaucagcaccuguugguagaaaaccucuguucuuagacaguauaguuaaaggcaugaagaauuugcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguagaugaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaacuugcuugcauaaagaauggccucacucaagaaacuggagauguaaucccacuuggugcuggggaguaggaacuggcugcaccugcugcgggguggauguaaaagaccuuuuuacagaucacauguuugucaaauggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcaugugcaaaaaguguugucugcaaguacaguguguaaacugcagaguugcacacaugguauaccaggagaucuacaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaauaucgaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcauaccaagaaaguugagauaucaggcuuaaaauuugcaagucuggcuugcacggguugcuaugcuuguagcucuggcaucuccuguaaagucaggauucauguagaugagccagaugagcucacaguacauguaaagagcaaugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaauguuacuugcacagccaaggcaagcuguuggcuagagucagucaagaguuuuuuuuauggauugaaaaauaugcuugguaguguauuugguaacuuuuucauaggcauuuuguuauuccuugccccuuuuguccuguuggugcuuuucuuuauguuuggauggaaaaucuuguuuugcuucaaauguugcaggaggaccagaggcuuacuuaaguauagacuccucaaagacgaugaggaaacaggcuacagaaggauuauugaaagacugaacaacaaaaaaggaaaaaacagacugcuugauggugaaagguuggcugauaggaaaauugcugagcuguucuccacaaaaacacacauuggu

SEQ ID NO: 3869 - RNA, 2916 nt, Artificial Sequence
  derived and/or modified CDS sequence (wt) from CCHFV(44-ST-2010, Artificial)__KR814859.1__Gn-4aa-Gc
uccgaagagccaggugacgacugcauaucaagaacucagcuauugaagacagaaacagcagagauccaugacgacaacuauggugguccaggugacaaaauaacuaucugcaaugguucaaccauuguagaucagagacugggcagugaacuaggguguuauaccaucaacaggguaaagucauucaagcuaugcgaaaacagugccacagggaaaaccugugagauagacagcacuccggucaagugcaggcaagguuuuuguuugaaaaucacccaagaggggaggggccacguaaaauuauccaggggcucagagguuguuuuggaugcuugcgacucgagcugugaaauaaugauaccuaaaggcacuggagauauccuaguagacuguucagguggacagcaacauuucuuaaaagacaacuugauugaccuagggugcccucauaucccgcuauuggguaagauggccauuuacauuugcagaaugucaaaucaucccaggacaaccauggcuuuccuccucugguucaguuuuggcuauguaaucaccuguauauuuugcaaagcucuuuuuuauucauugauaauuauugggacacuaggaaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuagcuaggcaugugacacaaugcccuaagcgaaaggagaaaguugaggagacugaacuguauuugaaccuggaaagaauuccauggauagucagaaagcuguugcaagugucagaguccacugguguggcauugaaacgaagcagcuggcugauugugcugcuuguguuacucacagucucauugucaccgguucaaucagcaccuguugguaggaaaccucuuuucuuagacaguauaguuaaagguaugaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggauuugucacaaauguauuccccuguuuuugaguacuuaucaggagauagacagguugaagaauggcccaaggcaaccugcacaggugauugcccagaaagguguggcugcacaucaucaaccugcuugcauaaagaauggccucacucaagaaacuggagauguaaucccacuuggugcuggggaguaggaaccggcugcacaugcugcggaguggauguaaaagaccuuuuuacagaucacauguuuaucaaauggaagguugaauauauaaaaaccgaagccauaguauguguugagcucaccagccaagaaagacagugcagucugauugaggcagguacuagauucaacuuggguccugugacuaucacccugucugagccaagaaacauucagcagaagcuucccccugagaucauuacgcugcauccuaaaauugaagaaggcuucuuugacuugaugcaugugcaaaaaguguuaucugcaaguacaguguguaaacugcagaguugcacacaugguauaccaggagaucuacaaauuuaccacauuggcaacuuguugaaaggggauagauuaaacgggcaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccauucuaaaagagucacagcacauggagacacaccacaauuagacuuaaaagcaaggccgacuuacggugcaggugagaucacugugcugguugagguugcugacauggaguugcauaccaagaaaguugagauaucaggcuugaaauuugcaagucuggcuugcacggguugcuaugcuuguagcucuggcaucuccuguaaagucagaauucauguagaugaaccggaugagcucacagugcauguaaagagcagugauccagaugugguugcagcuagcacaagccuuauggcaaggaagcuugaauuugggacagauagcacauucaaggcauuuucagcuaugcccaaaaccucuuuaugcuuuuacauuguggagagggaauacugcaagagcugcagugaagaugauacaaaaaaauguguugacacaaaacuugaucagccacagagcauacuaauugagcacaaagggaccauaauuggaaagcagaaugacacuugcacagccaaggcaaguuguuggcuagagucagucaagaguuuuuuuuauggauugaagaauaugcuuggcaguguuuuugguaauuuuuucguaggcauuuuguuauuccuugcccccuuugucuuguuggugcuuuucuuuauguguggauggaaaaucuuguuuugcuuuaaguguugcaggaggaccagaggcuuguuuaaguauagacaccucaaagaugaugaggaaacaggcuacagaaggauuauugaaagacugaacagcaaaaaaggaaagaacagacugcuugauggugagagguuggcugauaggaaaauugcugagcuguucucuacaaaaucacacauuggc

SEQ ID NO: 3870 - RNA, 2916 nt, Artificial Sequence
  derived and/or modified CDS sequence (wt) from CCHFV(46-ST-2012, Artificial)__KR814860.1__Gn-4aa-Gc
uccgaagagccaggugaugacugcauaucaagaacucagcuauugaggacagaaacagcggagauccaugaugacaacuauggugguccaggugauaaaauaacuaucugcaacgguucaaccauuguagaucagagacugggcagugaacuaggguguuauaccaucaacagagugaagucauucaagcuaugcgaaaacagcgccacagggaaaaccugugagauagacagcacuccgguuaagugcaggcaaggcuuuuguuuaaaaaucacccaagagggaaggggccacguaaaauuaucuagaggcucagagguugucuuggaugccugcgacucaagcugcgaaguaaugauaccuaaaggcacuggagauauccugguggacuguucagguggacagcaacauuucuuaaaagacaacuuaauugaccuagggugcccccauaucccgcuauuggguaaaauggccauuuacaucugcagaaugucaaaucauccuagaacaacuauggcuuuucucuucugguucagcuuuggcuaugugaucaccuguauauuuugcaaggcucuuuuuuauucauugauaauuauugggacacuagggaaaaagaucaagcaauauagggaacugaaaccucaaacuuguaccauaugugagacagcuccugucaaugcaauagaugcugaaaugcaugaccuuaacugcaguuacaauauaugcccuuauugugcaucaagauugaccuccgaugggcuagcuaggcaugugccacagugccccaagcgaaaggaaaaaguugaggagacugagcuguacuugaaccuggaaagaauuccuuggaucgucagaaagcuauugcaagugucagaauccacugguguggcauugaaacgaagcagcuggcugauuguacugcuuguguuacucacaguuucauugucaccgguucaaucagcaccuguugguagaaaaccucuguucuuagacaguauaguuaaaggcaugaaaaauuugcuaaacucaacaagcuuagaaacaagcuuaucaaucgaggcaccauggggagcaauaaauguccagucaaccuuuaaaccaacaguaucgacugcaaacauagcacucaguuggagcucaguggagcacagaggcaacaagaucuuagucacaggcaggucugaaucaauuaugaaacuggaggaaaggacaggagucagcugggaucuaggcguagaggaugccucugaauccaaauuacuuaccgucucuaucauggaucugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcuggggaguaggaacuggcugcaccugcugcgggguggauguaaaagaccuuuuuacagaucacauguuugucaaguggaagguugaauauauaaaaacugaagccauaguauguguugagcucaccagccaagaaagacagugcagucugauugaggcagguaccagauucaacuugggcccugugacuauuacccugucugagccaagaaacauacagcagaagcuucccccugagauuaucacauugcaucccaaaguugaagagggcuucuuugacuugaugcaugugcaaaaaguguugucugcaaguacaguguguaaacugcagaguugcacacacgguauaccaggagaucuacaaguuuaccacauuggcaacuuacugaaaggagauaggauaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacauugaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcacaccaaaaaaguugagauaucaggcuugaaauuugcaagucuggcuugcacggguugcuaugcuuguagcucuggcaucuccuguaaagucaggauucauguagaugagccagaugagcucacaguacauguaaagagcagugauccagaugugguugcagccagcacaagucucauggcgaggaagcuugaguuugggacagacaguaccuucaaggccuuuucagcuaugcccaaaaccucuuuauguuuuuacauuguggagagagaauacuguaagagcugcagugaagaggacacacaaaaauguguugacacaagacuugagcagccgcagagcauacuaauugagcacaaaggaacgauaauuggaaagcagaaugauacuugcacagccaaggcaagcuguugguuagagucagucaagaguuuuuuuuauggauugaagaauaugcuugguagugucuuugguaauuuuuucauaggcauucuguuauuccuugccccuuuuguccuguuggugcuuuucuuuauguuuggguggaaaaucuuguuuugcuuuaaauguugcaggaggaccagaggcuuacuuaaguauagacaccucaaagacgaugaggaaacaggcuacagaaggauuauugaaagacugaacaacaaaaaagggaaaaacagacugcuugauggugaaagguuggcugauaggaagauugcugagcuguucuccacaaaaacacacauuggu

SEQ ID NO: 3871 - RNA, 2916 nt, Artificial Sequence
  derived and/or modified CDS sequence (wt) from CCHFV(47-ST-2013, Artificial)__KR814861.1__Gn-4aa-Gc
uccgaagagccaggugacgacugcauaucaagaacucagcuguugaagacagaaacagcagagauccaugacgacaacuauggugguccaggugacaaaauaacuaucugcaaugguucaaccauuguagaucagagacuggguagugaacuaggguguuauaccaucaacagggugaagucauucaagcuaugcaaaaacagugccacagggaaaaccugugagauagacagcacuccggucaagugcaggcaagguuuuuguuugaaaaucacccaagagggaaggggccacguuaaauuauccaggggcucagagguuguuuuggaugcuugcgacucgagcugugaaauaaugauaccuaaaggcacuggagauauccuaguagacugcucagguggacagcaacauuucuuaaaagacaacuugauugaccuagggugcccucauaucccgcuauuggguaagauggccauuuacauuugcagaaugucaaaucaucccaggacaaccauggcuuuccucuucugguucaguuuuggcuauguaaucaccuguauauuuugcaaggcucuuuuuuauucauugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagauugaccucugaugggcuagcuagacaugugacacaaugcccuaagcgaaaggagaaaguugaggagacugaacuguauuugaaccuggaaagaauuccuuggauagucagaaaguuauugcaagugucagaguccacugguguggcauugaaacgaagcaguuggcugauugugcugcuuguguuacucacagucucauugucaccgguucaaucagcaccuguugguaggaaaccucuuuucuuagacaguauaguuaaagguaugaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagauccuggucacaggcaggucugaaucaauuaugaaacuagaggaaaggacaggagucagcugggaucuagguguagaagaugccucugaauccaaauuacuuaccgucucuaucauggauuugucacaaauguauuccccuguuuuugaguacuuaucaggagauagacagguugaagaauggcccaaggcaaccugcacaggugaaugcccagaaagguguggcugcacaucaucaaccugcuugcauaaagaauggccucacucaagaaacuggagauguaaucccacuuggugcuggggaguaggaaccggcugcacaugcugcggaguggauguaaaagaccuuuuuacagaucacauguuuaucaaauggaagguugaauauauaaaaaccgaagccauaguauguguugagcucaccagccaagaaagacagugcagucugauugaggcagguacuagauucaacuuagguccugugacuaucacccugucugagccaagaaacauucagcagaagcuucccccugagaucauuacgcugcaucccaaaauugaagaaggcuucuuugacuugaugcauguacaaaaaguguuaucugcaaguacaguguguaaacugcagaguugcacacaugguauaccaggagaucuacaaauuuaccacauuggcaacuuguugaaaggggauagaguaaacgggcaucuaauucacaaaauugaaccacauuuuaacaccucuuggauguccugggaugguugugaccuagacuacuacugcaacaugggggauuggccuucuugcacauacacaggagugacccaacauaaucaugcugcauuuguaaacuugcuuaacauugaaacugauuacacaaaaaccuuccacuuccacucuaaaagagucacagcacauggagacacaccacaauuagacuuaaaagcaaggccgaccuacggugcaggugagaucaccgugcugguugagguugcugacauggaguugcauaccaagaaaguugagguaucaggcuugaaauuugcaagucuggcuugcacggguugcuaugcuuguagcucuggcaucuccuguaaagucagaauucauguagaugaaccagaugagcucacagugcauguaaagagcagugauccagaugugguugcagcuagcacaagccuuauggcaaggaagcuugaauuugggacagauaguacauucaaggcauuuucagcuaugccuaaaaccucuuuaugcuuuuacauuguggagagggaauacugcaaaagcugcagugaagaugauacaaaaaaauguguugacacaaaacuugaacagccacagagcauacuaauugagcacaaagggacaauaauuggaaagcagaaugauacuugcacagccaaggcaaguuguuggcuagagucagucaagaguuuuuuuuauggauugaagaauaugcuuggcaguguuuuugguaauuuuuuuguaggcauuuuguuauuccuugccccuuuugucuuguuggugcuuuucuuuauguuuggauggaaaaucuuguuuugcuuuaaguguugcaggaggaccagaggcuuguuuaaguauagacaccucaaagaugaugaggaaacaggcuacagaaggauuauugaaagacugaacagcaaaaaagggaaaaacagacugcuugauggugagagguuggcugauaggaaaauugcugagcuguucucuacgaaaacacacauuggc

SEQ ID NO: 3872 - RNA, 2916 nt, Artificial Sequence
  derived and/or modified CDS sequence (wt) from CCHFV(52-R-2014, Artificial)__KR814862.1__Gn-4aa-Gc
uccgaggagccaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauacuaucaacagggugaagucauucaagcuaugcgaaaacagcgccacagggaaaaccugugagauagacagcacuccgguuaagugcaggcaagguuuuuguuuaaaaaucacccaagagggaagaggccacguaaaauuaucuagaggcucagagguuguuuuggaugcuugcgacacaagcugcgaaguaaugauaccuaaaggcacuggagauauccugguggacuguucagguggacagcaacauuucuuaaaagacaauuuaauugaccuagggugcccccaugucccgcuauuggguaaaauggccauuuacaucugcagaaugucaaaucauccuagaacaacuauggcuuuucucuucugguucagcuuuggcuaugugaucaccuguauauuuugcaaggcucuuuuuuauucauugauaauuauugggacacuagggaaaaagaucaagcaauauagggaauugaaaccucaaacuuguaccauaugugagacagcuccugucaaugcaauagacgcugaaaugcaugaccuuaacugcaguuacaauauaugcccuuauugugcaucaagauugaccuccgaugggcuagcuaggcaugugccacaaugccccaagcggaaggaaaaaguugaggagacugagcuguacuugaaccuggaaagaauuccuuggauugucagaaagcuauugcaagugucagaguccacugguguggcauugaaacgaagcagcuggcugauuguacugcuuguguuacucacaguuucauugucaccgguucaaucagcaccuguugguagaaaaccucuguucuuagacaguauaguuaaaggcaugaagaauuugcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguagaugaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaacuugcuugcauaaagaauggccucacucaagaaacuggagauguaaucccacuuggugcuggggaguaggaacuggcugcaccugcugcgggguggauguaaaagaccuuuuuacagaucacauguuugucaaauggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcaugugcaaaaaguguugucugcaaguacaguguguaaacugcagaguugcacacaugguauaccaggagaucuacaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaauaucgaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcauaccaagaaaguugagauaucaggcuuaaaauuugcaagucuggcuugcacggguugcuaugcuuguagcucuggcaucuccuguaaagucaggauucauguagaugagccagaugagcucacaguacauguaaagagcaaugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaaugauacuugcacagccaaggcaggcuguuggcuagagucagucaagaguuuuuuuuauggauugaaaaauaugcuugguaguguauuugguaacuuuuucauaggcauuuugcuauuccuugccccuuuuguccuguuggugcuuuucuuuauguuuggauggaaaaucuuguuuugcuucaaauguugcaggaggaccagaggcuuacuuaaguauagacuccucaaagacgaugaggaaacaggcuacagaaggauuauugaaagacugaacaacaaaaaaggaaaaaacagacugcuugauggugaaagguuggcugauaggaaaauugcugaacuguucuccacaaaaacacacauuggu

SEQ ID NO: 3873 - RNA, 2916 nt, Artificial Sequence
  derived and/or modified CDS sequence (wt) from CCHFV(75-R-2012, Artificial)__KR814863.1__Gn-4aa-Gc
uccgaggagccaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauaccaucaacagggugaagucauucaagcuaugcgaaaacagcgccacagggaaaaccugugagauagacagcgcuccgguuaagugcaggcaagguuuuuguuuaaaaaucacccaagagggaaggggccacguaaaauuaucuagaggcucagagguuguuuuggaugcuugcgacucaagcugcgaaguaaugauaccuaaaggcacuggagauauccugguggacuguucagguggacagcaacauuucuuaaaagacaacuuaauugaccuagggugcccacauaucccgcuauuggguaaaauggccauuuacaucugcagaaugucaaaucauccuagaacaacuauggcuuuucucuucugguucagcuuuggcuaugugaucaccuguauauuuugcaaggcucuuuuuuauucauugauaauuauugggacacuagggaaaaagaucaagcaauauagggaauugaaaccucaaacuuguaccauaugugagacagccccugucaaugcaauagacgcugaaaugcaugaccuuaacugcaguuacaauauaugcccuuauugugcaucaagauugaccuccgaugggcuagcuaggcaugugccacaaugccccaagcggaaggaaaaaguugaggagacugagcuguacuugaaccuagaaagaauuccuuggauugucagaaagcuauugcaagugucagaguccacugguguggcauugaagcgaagcagcuggcugauuguacugcuuguguuacucacaguuucauugucaccgguucaaucagcaccuguugguagaaaaccucuguucuuagacaguauaguuaaaggcaugaagaauuugcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcagguccgaaucaauuaugaaacuggaggaaaggacaggagucagcugggaucuaggcguagaagaugccucugaguccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcuggggaguagguacuggcugcaccugcugcgggguggauguaaaagaccuuuuuacagaucacauguuugucaaauggaagguugaauauauaaaaacugaagccauaguauguguugagcucaccagucaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcaugugcaaaaaguguugucugcaaguacaguguguaaacugcagaguugcacacaugguauaccaggagaucuacaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacauugaaacugauuacacgaaaaccuuccacuuccacucuaaaagaguuacagcacauggugacacaccacaauuagacuuaaaagcaaggccgaccuacggugcaggugagaucaccgugcugguugagguugcugacauggaguugcauaccaagaaaguugagauaucaggcuuaaaauuugcaagucuggcuugcacggguugcuaugcuuguagcucuggcaucuccuguaaagucaggauucauguagaugagccagaugagcucacaguacauguaaagagcagugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaaugauacuugcacagccaaggcaagcuguuggcuagagucagucaagaguuuucuuuauggauugaaaaauaugcuugguaguguauuugguaacuuuuucauaggcauuuuguuauuccuugccccuuuuguccuguuggugcuuuucuuuauguuuggauggaaaaucuuguucugcuucaaauguugcaggaggaccagaggcuuacuuaaguauagacuccucaaagacgaugaggaaacaggcuacagaaggauuauugaaagacugaacaacaaaaaaggaaaaaacagacugcuugauggugaaagguuggcugauaggaaaauugcugagcuguucuccacaaaaacacacauuggu

SEQ ID NO: 3874 - RNA, 2916 nt, Artificial Sequence
  derived and/or modified CDS sequence (wt) from CCHFV(75-ST-2010, Artificial)__KR814864.1__Gn-4aa-Gc
uccgaagagucaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauaccaucaacagggugaagucauucaagcuaugcgaaaacagcgccacagggaaaaccugugagauagacagcacuccgguuaagugcaggcaagguuuuuguuuaaaaaucacccaagaaggaaggggccacguaaaauuaucuagaggcucagagguuguuuuggaugcuugcgacucaagcugcgaaguaaugauaccuaaaggcacuggagauaucuugguggacuguucagguggacagcaacauuucuuaaaagacaacuuaauugaccuagggugcccccauaucccgcuauuggguaaaauggccauuuacaucugcagaaugucaaaucacccuagaacaacuauggcuuuucucuucugguucagcuuuggcuaugugaucaccuguuuauuuugcaaggcucuuuuuuauucauugauaaucauugggacacuagggaaaaagaucaagcaauauagggaauugagaccucaaaccuguaccauaugugagacagcuccugucaaugcaauagaugcugaaaugcaugaccuuaacugcaguuacaauauauguccuuauugugcaucaagauugaccuccgaugggcuagcuaggcaugugccacaaugccccaagcggaaggaaaaaguugaggagacugagcuguacuugaaccuggaaagaauaccuuggauugucagaaagcuauugcaagugucagaguccacugguguggcauugaaacgaagcagcuggcugauuguacugcuuguguuacucacaguuucauugucaccgguucaaucagcaccuguugguagaaaaccucuguucuuagacaguauaguuaaaggcaugaagaauuugcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguagaagaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcuggggaguaggaacuggcugcaccugcugcgggguggauguaaaagaccuuuuuacagaucacauguuugucaaguggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcauguacaaaaaguguugucugcaaguacaguguguaaacugcagaguugcacacaugguauaccaggagaucuacaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacauugaaacugauuacacgaaaaccuuccacuuccacucuaaaagaguuacagcacauggugacacaccacaauuagacuuaaaagcaaggccaaccuacggugcaggugagaucacugugcugguugagguugcugacauggaguugcauaccaagaaaguugagauaucaggccugaaauuugcaagucuggcuugcacggguugcuaugcuuguagcucuggcaucuccuguaaagucaggauucauguagaugagccagaugagcucacaguacauguaaagagcagugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaaugauacuugcacagccaaggcaagcuguuggcuagagucagucaagaguuuuuuuuauggauugaaaaauaugcuugguaguguauuuggcaacuuuuucauaggcauuuuguuauuccuugccccuuuuguccuguuggugcuuuucuuuauguuuggauggaaaaucuuguuuugcuucaaauguugcaggagggccagaggcuugcuuaaguauagacaccuaaaagacgaugaggaaacaggcuacagaaagauuauugaaaggcugaacaacaaaaaaggaaaaaacagacugcuugauggugaaagguuggcugauaggaaaauugcugagcuguucuccacaaaaacacacauuggu

SEQ ID NO: 3875 - RNA, 2916 nt, Artificial Sequence
  derived and/or modified CDS sequence (wt) from CCHFV(3756-ST-2007, Artificial)__KR814866.1__Gn-4aa-Gc
uccgaagagccaggugacgacugcauaucaagaacucagcuauugaagacagaaacagcagagauccaugacgacaacuauggugguccaggugacaaaauaacuaucugcaaugguucaaccauuguagaucagagacugggcagugaacuaggguguuauaccauuaacagggugaagucauucaagcuaugcgaaaacagugccacagggaaaaccugugagauagacagcacuccggucaagugcaggcaagguuuuuguuugaaaaucacccaagagggaaggggccacguaaaauuauccaggggcucagagguuguuuuggaugcuugcgacucgagcugugaaauaaugauaccuaaaggcacuggagauauccuaguagacuguucagguggacagcaacauuucuuaaaagacaacuugauugaccuagggugcccucauaucccgcuauuggguaaaauggccauuuacauuugcagaaugucaaaucaucccaggacaaccauggcuuuccucuucugguucaguuuuggcuauguaaucaccuguauauuuugcaaggcucuuuuuuauucauugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuagcuaggcaugugacacaaugcccuaagcgaaaggagaaaguugaggagacugaacuguauuugaaccuggaaagaauucccuggauagucagaaagcuauugcaagugucagaguccacugguguggcauugaaacgaagcaguuggcugauugugcugcuuguguuacucacagucucauugucaccgguccaaucagcaccuguugguaggaaaccucuuuucuuagacaguauaguuaaagguaugaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggauuugucacaaauguauuccccuguuuucgaguacuuaucaggagauagacagguugaagaauggcccaaggcaaccugcacaggugauugcccagaaagguguggcugcacaucaucaaccugcuugcauaaagaauggccucauucaagaaacuggagauguaaucccacuuggugcuggggaguaggaaccggcugcacaugcugcggaguggauguaaaagaccuuuuuacagaccacauguuuaucaaauggaagguugaauauauaaaaaccgaagccauaguauguguugagcucaccagccaagaaagacaaugcagucugauugaggcagguacuagauucaacuuggguccugugacuaucacccugucugagccaagaaacauucagcagaagcuucccccugagaucauuacgcugcaucccaaaauugaagaaggcuucuuugacuugaugcaugugcaaaaaguguuaucugcaaguacaguguguaaacugcagaguugcacacauggcauaccaggagaucuacaaauuuaccacauuggcaacuuguugaaaggggauagaguaaacgggcaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaagaaaguugagauaucaggcuugaaauuugcaagucugacuuguacggguugcuaugcuuguagcucuggcaucuccuguaaagucagaauucauguagaugaaccagaugagcucacagugcauguaaagagcagugauccagaugugguugcagcuagcacaagccuuauggcaaggaagcuugaauuugggacagauagcacauucaaggcauuuucagcuaugcccaaaaccucuuuaugcuuuuacauuguggagagggaauacugcaagagcugcagugaagaugauacaaaaaaauguguugacacaaaacuugagcagccacagagcauacuaauugagcacaaagggacgauaauuggaaagcagaaugauacuugcacagccaaggcaaguuguuggcuagagucggucaagaguuuuuuuuauggauugaagaauaugcuuggcaguguuuuugguaguuuuuucguaggcauuuuguuauuccuuaccccuuuugucuuguuggugcuuuucuuuauguuuggauggaaaaucuuguuuugcuuuaaguguugcaggaggaccagaggcuuguuuaaguauagacaccucaaagaugacgaggaaacaggcuacagaaggauuauugaaagacugaacagcaaaaaaggaaaaaacagacugcuugauggugagagguuggcugauaggaaaauugcugagcuguucucuacaaaaacacacauuggc

SEQ ID NO: 3876 - RNA, 2916 nt, Artificial Sequence
  derived and/or modified CDS sequence (wt) from CCHFV(3809-ST-2007, Artificial)__KR814867.1__Gn-4aa-Gc
uccgaagagccaggugaugacugcauaucaagaacucaguuauugaggacagaaacagcagagauccaugaugacaacuauggugguccaggugauaaaauaacuaucugcaacgguucaaccauuguagaucagagacugggcagugaacuaggguguuauaccaucaacagggugaagucauucaagcuaugcgaaaacagcgccacagggaaaaccugugagauagacagcacuccgguuaagugcaggcaagguuuuuguuuaaaaaucacccaagagggaaggggccacguaaaauuaucuagaggcucagagguugucuuggaugccugcgacucaagcugcgaaguaaugauaccuaaaggcacuggagauauccugguggacuguucagguggacagcaacauuucuuaaaagacaacuuaauugaccuagggugcccccauaucccgcuauuggguaaaauggccauuuacaucugcagaaugucaaaucauccuagaacaacuauggcuuuucucuucugguucagcuuuggcuaugugaucaccuguauauuuuguaaggcucuuuuuuauucauugauaauuauugggacacuagggaaaaagaucaagcaauauagggaauugaaaccucaaacuuguaccauaugugagacagcuccugucaaugcaauagaugcugaaaugcaugaccuuaacugcaguuacaauauaugcccuuauugugcaucaagauugaccuccgaugggcuggcuaggcaugugccacaaugccccaagcggaaggaaaaaguugaggagacugagcuguacuugaaccuggaaagaaucccuuggauugucagaaagcuauugcaagugucagaguccacugguguggcauugaaacgaagcagcuggcugauuguacugcuuguguuacucacaguuucauugucaccgguucaaucagcaccuguugguagaaaaccucuguucuuagacaguauagucaaaggcaugaagaauuugcuaaacucaacaagcuuagaaacaagcuuaucaauugaagcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguggaagaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcuggggaguaggaacuggcuguaccugcugcgggguggauguaaaagaccuuuuuacagaucacauguuugucaaauggaagguugaauauauaaaaacugaagccauaguauguguugagcucaccagccaggaaagacagugcagucugauugaggcagguacuagauucaacuugggcccugugacuaucacccugucugagccaagaaacauucagcagaagcuucccccugagauuaucacguugcaucccaaaguugaagagggcuucuuugacuugaugcaugugcaaaaaguguugucugcaaguacaguguguaaacugcagaguugcacacaugguauaccaggagaucuucaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacauugaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcauaccaagaaaguugagauaucaggcuugaaauuugcaagucuggcuugcacggguugcuaugcuuguagcucuggcaucuccuguaaagucaggauucauguagaugagccagaugagcucacaguacauguaaagagcagugauccagaugugguugcagcuagcacaagucucauggcgaggaagcuugaauuugggacagacaguacauucaaggccuuuucagcuaugcccaaaaccucuuuauguuuuuacauuguggagaaagaauacugcaggagcugcagugaagaggacacacaaaaauguguugacacaaaacuugagcagccacagagcauacuaauugagcacaaaggaacgauaauuggaaagcagaaugauacuugcacagccaaagcaagcuguuggcuagagucagucaagaguuuuuuuuauggauugaagaauaugcuugguagugucuuugguaacuuuuucauaggcauuuuguuauuccuuaccccuuuuguccuguuggugcuuuucuuuauguuuggauggaaaaucuuguuuugcuucaaauguugcaggaggaccagaggcuuacuuaaguauagacaccucaaagacgaugaggaaacaggcuacagaaggauuauugaaagacugaacaacaaaaaagggaaaaacagacugcuugauggugaaagguuggcugauaggaaaauugcugagcuguuuuccacaaaaacacacauuggu

SEQ ID NO: 3877 - RNA, 2916 nt, Artificial Sequence
  derived and/or modified CDS sequence (wt) from CCHFV(3820-ST-2007, Artificial)__KR814868.1__Gn-4aa-Gc
uccgaagagccaggugacgacugcauaucaagaacucagcuauugaagacagaaacagcagagauccaugacgacaacuaugguaguccaggugacaaaaucacuaucugcaaugguucaaccauuguagaucagagacugggcagugaacuaggguguuauaccaucaacagggugaagucauucaagcuaugcgaaaacagugccacagggaaaaccugugagauagacagcacuccggucaagugcaggcaagguuuuuguuugaaaaucacccaagagggaaggggccacguaaaauuauccaggggcucagagguuguuuuggaugcuugcgacucgagcugugaaauaaugauaccuaaaggcacuggagauauccuaguagacuguucagguggacagcaacauuucuuaaaagacaacuugauugaccuagggugcccucauaucccgcuauuggguaaaauggccauuuacauuugcagaaugucaaaucaucccaggacaaccauggcuuuccucuucugguucaguuuuggcuauguaaucaccuguauauuuugcaaggcucuuuuuuauucacugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuggcuaggcaugugacacaaugcccuaagcgaaaggagaaaguugaggagacugaacuguauuugaaccuggaaagaauuccuuggauagucagaaagcuauugcaagugucagaguccacugguguggcauugaaacgaagcaguuggcugauugugcugcuuguguuacucgcagucucauugucaccgguccaaucagcaccuguugguaggaaaccccuuuucuuagacaguauaguuaaagguaugaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaccuaggcguagaagaugccucugaauccaaauuacuuaccgucucuaucauggauuugucacaaauguauuccccuguuuuugaguacuuaucaggagauagacagguugaagaauggcccaaggcaaccugcacaggugauugcccagaaagguguggcugcacaucaucaaccugcuugcauaaagaauggccucauucaagaaacuggagauguaaucccacuuggugcuggggaguaggaaccggcugcacaugcugcggaguggauguaaaagaccuuuuuacagaccacauguuuaucaaauggaagguugaauauauaaaaaccgaagccauaguauguguugagcucaccagccaagaaagacagugcagucugauugaggcagguacuagauucaacuuggguccugugacuaucacccugucugagccaagaaacauucagcagaagcuucccccugagaucauuacgcugcaucccaaaauugaagaaggcuucuuugacuugaugcaugugcaaaaaguguuaucugcaaguacaguguguaaacugcagaguugcacacaugguauaccaggagaucuacaaauuuaccacauuggcaacuuguugaaaggggauagaguaaacggccaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaaaaaaguugagauaucaggcuugaaauuugcaagucugacuuguacggguugcuaugcuuguagcucuggcaucuccuguaaagucagaauucauguagaugaaccagaugagcucacagugcauguaaagagcagugauccagaugugguugcagcuagcacaagccuuauggcaaggaagcuugaauuugggacagauagcacauucaaggcauuuucagcuaugcccaaaaccucuuuaugcuuuuacauuguggagagggaauacugcaagagcugcagugaagaugauacaaaaaaauguguugacacaaaacuugagcagccacagagcauacuaauugagcacaaagggacgauaauuggaaagcagaaugauacuugcacagccaaggcaaguuguuggcuagagucagucaagaguuuuuuuuauggauugaagaauaugcuuggcaguguuuuugguaguuuuuucguaggcauuuuguuauuccuugccccuuucgucuuguuggugcuuuucuuuauguuuggauggaaaaucuuguuuugcuuuaaguguugcaggaggaccagaggcuuguuuaaguauagacaccucaaagaugacgaggaaacaggcuacagaaggauuauugaaagacugaacagcaaaaaaggaaaaaacagacugcuugauggugagagguuggcugauaggaaaauugcugagcuguucucuacaaaaacacacauuggc

SEQ ID NO: 3878 - RNA, 2916 nt, Artificial Sequence
  derived and/or modified CDS sequence (wt) from CCHFV(4495-ST-2008, Artificial)__KR814869.1__Gn-4aa-Gc
uccgaagagucaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauaccaucaacagggugaagucauucaagcuaugcgaaaacagcgccacagggaaaaccugugagauagacagcacuccgguuaagugcaggcaagguuuuuguuuaaaaaucacccaagaaggaaggggccacguaaaauuaucuagaggcucagagguuguuuuggaugcuugcgacucaagcugcgaaguaaugauaccuaaaggcacuggagauaucuugguggacuguucagguggacagcaacauuucuuaaaagacaacuuaauugaccuagggugcccccauaucccgcuauuggguaaaauggccauuuacaucugcagaaugucaaaucauccuagaacaacuauggcuuuucucuucugguucagcuuuggcuauguaaucaccuguuuauuuugcaaggcucuuuuuuauucauugauaaucauugggacacuagggaaaaagaucaagcaauauagggaauugagaccucaaacuuguaccauaugugagacagcuccugucaaugcaauagaugcugaaaugcaugaccuuaacugcaguuacaauauaugcccuuauugugcaucaagauugaccuccgaugggcuagcuaggcaugugccacaaugccccaagcggaaggaaaaaguugaggagacugagcuguacuugaaccuggaaagaauuccuuggauugucagaaagcuauugcaagugucagaguccacugguguggcauugaaacgaagcagcuggcugauuguacugcuuguguuacucacaguuucauugucaccgguucaaucagcaccuguugguagaaaaccucuguucuuagacaguauaguuaaaggcaugaagaauuugcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggaaucagcugggaucuaggcguagaagaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcuggggaguaggaacuggcugcaccugcugcgggguggauguaaaagaccuuuuuacagaucacauguuugucaaguggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcauguacaaaaaguguugucugcaaguacaguguguaaacugcagaguugcacacaugguauaccaggagaucuacaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacauugaaacugauuacacgaaaaccuuccacuuccacucuaaaagaguuacagcacauggugacacaccacaauuagacuuaaaagcaaggccaaccuacggugcaggugagaucacugugcugguugagguugcugacauggaguugcauaccaagaaaguugagauaucaggccugaaauuugcaagucuggcuugcacggguugcuaugcuuguagcucuggcaucuccuguaaagucaggauucauguagaugagccagaugagcucacaguacauguaaagagcagugauccagaugugguugcagcuagcacaagucucauggcgaggaagcuugaauuugggacagacaguacauucaaggccuuuucagcuaugcccaaaaccucuuuauguuuuuacauuguggagagggaauacugcaagagcugcagugaagaggacacacaaagauguguugacacaaaacuugagcagccacagagcauacuaauugagcacaaaggaacgauaauuggaaagcagaaugauacuugcacagccaaggcaagcuguuggcuagagucagucaagaguuuuuuuuauggauugaaaaauaugcuugguaguguauuuggcaacuuuuucauaggcauuuuguuauuccuugccccuuuuguccuguuggugcuuuucuuuauguuuggauggaaaaucuuguuuugcuucaaauguugcaggagggccagaggcuugcuuaaguauagacaccuaaaagacgaugaggaaacaggcuacagaaagauuauugaaaggcugaacaacaaaaaaggaaaaaacagacugcuugauggugaaagguuggcugauaggaaaauugcugagcuguucuccacaaaaacacacauuggu

SEQ ID NO: 3879 - RNA, 2916 nt, Artificial Sequence
  derived and/or modified CDS sequence (wt) from CCHFV(4691-ST-2009, Artificial)__KR814871.1__Gn-4aa-Gc
uccgaagagccaggugacgacugcauaucaagaacucagcuauugaagacagaaacagcagagauccaugacgacaacuauggugguccaggugacaaaauaacuaucugcaaugguucaaccauuguagaucagagacugggcagugaacuaggguguuauaccaucaacagggugaagucauucaagcuaugcgaaaacagugccacagggaaaaccugugagauagacagcacuccggucaagugcaggcaggguuuuuguuugaaaaucacccaagagggaaggggccacguaaaauuauccaggggcucagagguuguuuuagaugcuugcgacucgagcugugaaauaaugauaccuaaaggcacuggagauauccuaguagacuguucagguggacagcaacauuucuuaaaagacaacuugauugaccuagggugcccucauaucccgcuuuuggguaagauggccauuuacauuugcagaaugucaaaucaucccaggacaaccauggcuuuccucuucugguucaguuuuggcuauguaaucaccuguauauuuugcaaggcucuuuuuuauucauugauaauuauuggaacacuaggaaaaaaaaucaagcaauauagggagcuaaagccucaaacuugcaccauaugugagacagcuccugucaaugcaauagaugcugaaaugcaugaccucaacuguaguuauaauauaugcccuuauugugcaucaagacugaccucugaugggcuagcuaggcaugugacacaaugcccuaagcgaaaggagaaaguugaggagacugaacuguauuugaaccuggaaagaauuccuuggauagucagaaagcuauugcaagugucagaguccacugguguggcauugaaacgaagcaguuggcugauugugcugcuuguguuacucacagucucauugucaccgguucaaucagcaccuguugguaggaaaccucuuuucuuagacaguaucguuaaagguaugaaaaauuugcuaaacucaacaagcuuagaaacaagcuuaucaauugaggcaccauggggagcaauaaauguccagucaaccuuuaaaccagcaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggauuugucacaaauguauuccccuguuuuugaguacuuaucaggagauagacagguugaagaauggcccaaggcaaccugcacaggugauugcccagaaagguguggcugcacaucaucaaccugcuugcauaaagaauggccucacucaagaaacuggagauguaaucccacuuggugcuggggaguaggaaccggcugcacaugcugcggaguggauguaaaagaccuuuuuacagaucacauguuuaucaaauggaagguugaauauauaaaaaccgaagccauaguauguguugagcucaccagccaagaaagacagugcagucugauugaggcagguacuagauucaacuuggguccugugacuaucacccugucugagccaagaaacauucagcagaagcuucccccugagaucauuacgcugcaucccaaaauugaagaaggcuucuuugacuugaugcaugugcaaaaaguguuaucugcaaguacaguguguaaacugcagaguugcacacaugguauaccaggagaucuacaaauuuaccacauuggcaaccuguugaaaggggauagaguaaacgggcaucuaauucacaaaauugaaccacauuuuaacaccucuuggauguccugggaugguugugaccuagacuacuauugcaacaugggggauuggccuucuugcacauacacaggagugacccaacacaaucaugcugcauuuguaaacuugcuuaacauugaaacugauuacacgaaaaccuuccacuuccacucuaaaagagucacagcgcauggagacacaccacaauuggacuuaaaagcaaggccgaccuacggugcaggugagaucacugugcugguugagguugcugacauggaguugcauaccaagaaaguugagauaucaggcuugaaauuugcaagucuggcuugcacggguugcuaugcuuguagcucuggcaucuccuguaaagucagaauucauguagaugaaccagaugagcucacagugcauguaaagagcagugauccagaugugguugcagcuagcacaagccuuauggcaaggaagcuugaauuugggacagauagcacauucaaggcauuuucagcuaugcccaaaaccucuuuaugcuuuuacauuguggagagggaauacugcaagagcugcagugaagaugauacaaaaaaauguguugacacaaaacuugagcagccacagagcauacuaauugagcauaaagggacgauaauuggaaagcagaaugauacuugcacagccaaggcaaguuguuggcuagagucagucaagaguuuuuuuuauggauuaaagaauaugcuuggcaguguuuuugguaauuuuuucguaggcauuuuguuauuccuugccccuuuugucuuguuggugcucuucuuuauguuuggauggaaaaucuuguuuugcuuuaaguguugcaggaggaccagaggcuuguuuaaguauagacaccucaaagaugaugaggaaacaggcuacagaaggauuauugaaagacugaacagcaaaaaaggaaaaaacagacugcuugacggugagagguuggcugauaggaaaauugcugagcuguucucuacaaaaacacacauuggc

SEQ ID NO: 3880 - RNA, 2916 nt, Artificial Sequence
  derived and/or modified CDS sequence (wt) from CCHFV(4701-ST-2009, Artificial)__KR814872.1__Gn-4aa-Gc
uccgaagagccaggugacgacugcauaucaagaacucagcuauugaagacagaaacagcagagauccaugacgacaacuauggugguccaggugacaaaauaacuaucugcaaugguucaaccguuguagaucagagacugggcagugaacuaggguguuauaccaucaacagggugaagucauucaagcuaugcgaaaacagugccacagggaaaaccugugagauagacagcacuccgguuaagugcaggcaaggguuuuguuugaaaaucacccaagagggaaggggccacguaaaauuauccaggggcucagagguuguuuuggaugcuugcgacucaagcugugaaauaaugauaccuaaaggcacuggagauauccuaguagacuguucagguggacagcaacauuucuuaaaagacaacuugauugaccuagggugcccucauaucccgcuauuggguaaaauggccauuuacauuugcagaaugucaaaucaucccaggacaaccauggcuuuccucuucugguucaguuuuggcuauguaaucaccuguauauuuugcaaggcucuuuuuuauucauugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuggcuaggcaugugacacaaugcccuaagcgaaaagagaaaguugaggagacugaacuguauuugaaccuggaaagaauuccuuggauagucagaaagcuauugcaagugucagaguccacugguguggcauugaaacgaagcaguuggcugauugugcugcuuguguuacucacagucucauugucaccgguccaaucagcaccuguugguaggaaaccccuuuucuuagacaguauaguuaaagguaugaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggauuugucacaaauguauuccccuguuuuugaguacuuaucaggagauagacagguugaagaauggcccaaggcaaccuguacaggugauugcccagaaagguguggcugcacaucaucaaccugcuugcauaaagaauggccucauucaagaaacuggagauguaaucccacuuggugcuggggaguaggaaccggcugcacaugcugcggaguggauguaaaagaccuuuuuacagaccacauguuuaucaaauggaagguugaauauauaaaaaccgaagccauaguauguguugagcucaccagccaagaaagacagugcagucugauugaggcagguacuagauucaacuuggguccugugacuaucacccugucugagccaagaaacauucagcagaagcuucccccugagaucauuacgcugcauccuaaaauugaagaaggcuucuuugacuugaugcaugugcaaaaaguguuaucugcaaguacaguguguaaacugcagaguugcacacaugguauaccaggagaucuacaaauuuaccacauuggcaacuuguugaaaggggauagaguaaacggccaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaauauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaaaaaaguugagauaucaggcuugaaauuugcaagucugacuuguacggguugcuaugcuuguagcucuggcaucuccuguaaagucagaauucauguagaugaaccagaugagcucacagugcauguaaagagcagugauccagaugugguugcagcuagcacaagccuuauggcaaggaagcuugaauuugggacagauagcacauucaaggcauuuucagcuaugcccaaaaccucuuuaugcuuuuacauuguggagagggaauacugcaagagcugcagugaagaugauacaaaaaaauguguugacacaaaacuugagcagccacagagcauacuaauugagcacaaagggacgauaauuggaaagcagaaugauacuugcacagccaaggcaaguuguuggcuagagucagucaagaguuuuuuuuauggauugaagaauaugcuuggcaguguuuuuggugguuuuuucguaggcauuuuguuauuccuugccccuuucgucuuguugguacuuuucuuuauguuuggauggaaaaucuuguuuugcuuuaaguguugcaggaggaccagaggcuuguuuaaguauagacaccucaaagaugacgaggaaacaggcuacagaaggauuauugaaagacugaacagcaaaaaaggaaaaaacagacugcuugauggugagagguuggcugauaggaaaauugcugagcuguucucuacaaaaacacacauuggc

SEQ ID NO: 3881 - RNA, 2916 nt, Artificial Sequence
  derived and/or modified CDS sequence (wt) from CCHFV(5170-R-2011, Artificial)__KR814873.1__Gn-4aa-Gc
uccgaagagccaggugacgacugcauaucaagaacucagcuauugaagacagaaacagcagaaauccaugacgacaacuauggugguccaggugacaaaauaacuaucugcaaugguucaaccauuguagaucagagacugggcagugaacuaggguguuauaccaucaacagggugaagucauucaagcuaugcgaaaacagugccacagggaaaaccugugagauagacagcacuccggucaagugcaggcaagguuuuuguuugaaaaucacccaagagggaaggggccacguaaaauuauccaggggcucagagguuguuuuggauguuugcgacucgagcugugaaauaaugauaccuaaaggcacuggagauauccuaguagacuguucagguggacagcaacauuucuuaaaagacaacuugauugaccuagggugcccucauaucccgcuauuggguaaaauggccauuuacauuugcagaaugucaaaucaucccaggacaaccauggcuuuccucuucugguucaguuuuggcuauguaaucaccuguauauuuugcaaggcucuuuuuuauucauugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaagggcuagcuaggcaugugacacaaugcccuaagcgaaaggagaaaguugaggagacugaacuguauuugaaccuggaaagaauuccuuggauagucagaaagcuauugcaagugucagaguccacugguguggcauugaaacgaagcaguuggcugauugugcugcuuguguuacucacagucucauugucaccgguccaaucagcaccuguugguaggaaaccucuuuucuuagacaguauaguuaaagguaugaaaaauuugcuaaacucaacaagcuuagaaacaagcuuaucaauugaggcaccauggggagcaauaaauguccagucaaccuuuaaaccaacaguaucuacugcaaacauagcacucaguuggagcucaguagagcacagaggcaacaagaucuuggucacaggcaggucugaaucaauuaugaaacuagaggaaaggacaggagucagcugggaucuaggcguggaagaugccucugaauccaaauuacuuaccgucucuaucauggacuugucacaaauguauuccccuguuuuugaguacuuaucaggagauagacagguugaagaauggcccaaggcaaccugcacaggugauugcccagaaagguguggcugcacaucaucaaccugcuugcauaaagaauggccucauucaagaaacuggagauguaaucccacuuggugcuggggaguaggaaccggcugcacaugcugcggaguggauguaaaagaccuuuuuacagaccacauguuuaucaaauggaagguugaauauauaaaaaccgaagccauaguauguguugagcucaccagccaagaaagacagugcagucugauugaggcagguacuagauucaacuuggguccugugacuaucacccugucugagccaagaaacauucagcagaagcuucccccugagaucauuacgcugcaucccaaaauugaagaaggcuucuuugacuugaugcaugugcaaaaaguguuaucugcaaguacaguguguaaacugcagaguugcacacaugguauaccaggagaucuacaaauuuaccacaucgguaacuuguugaaaggggauagaguaaacgggcaucugauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaagaaaguugagauaucaggcuugaaauuugcaagucugacuuguacggguugcuaugccuguagcucuggcaucucuuguaaagucagaauucauguagaugaaccagaugagcucacagugcauguaaagagcagugauccagaugugguugcagcuagcacaagccuuauggcaaggaagcuugaauuugggacagauagcacauucaaggcauuuucagccaugcccaaaaccucuuuaugcuuuuacauuguagagagggaauacugcaagagcugcagugaagaugauacaaaaaaauguguugacacaaaacuugagcagccacagagcauacuaauugagcacaaggggacgauaauuggaaagcagaaugauacuugcacagccaaggcaaguuguuggcuagagucagucaagaguuuuuuuuauggacugaagaauaugcuuggcaguguuuuugguaguuuuuucguaggcauuuuguuauuccuugccccuuuugucuuguuggugcuuuucuuuauguuuggauggaaaaucuuguuuugcuuuaaguguugcaggaggaccagaggcuuguuuaaguauagacaccucaaagaugacgaggaaacaggcuacagaaggauuauugaaagacugaacagcaaaaaagggaaaaacagacugcuugauggugagagguuggcugauaggaaaauugcugagcuguucucuacaaaaacacacauuggc

SEQ ID NO: 3882 - RNA, 2916 nt, Artificial Sequence
  derived and/or modified CDS sequence (wt) from CCHFV(Oman-199809166, Artificial)__KR864901.1__Gn-4aa-Gc
uccgaagagucuggugaagacuguauaucaaggacucagcuguugaggacagaaacugcagaaauccauggugauaacuauggugguccaggugacaaaauaaccaucugcaaugguucaaccauuguagaucaaaggcuggguagugaacugggguguuacacuaucaauagggugaagucauuuaagcuaugcgaaaacagugccacagguaaguccugugaaauagauaacacuccaguaaaaugcaagcaagguuuuugcuugaaaauaacccaagaaggaaggggccacgugaagcuuucaagagacucagaaguuguccuggacgccugcgauucaagcugugaaauaaugauaccaaagggcacuggagacauccugguugacugcucaggugggcagcagcacuucuuaaaagacaaccugauugaucugggaugccccaacaucccauuauuaggcaaaauggcaaucuacauuuguagaaugucaaaucauccuaaaacaacuauggcuuuucuuuuuugguuuagcuuugguuaugugauaaccugcauacuuuguaaagucauuuuuuaucuauugauaguuguuggaacuuuagggaaaaaguuuaaacaguauagagaguuaaaaccucagaccugcacaauaugugaaacaacuccugucaaugcaauagaugcugagaugcacgaucucaauuguaguuacaauauauguccuuauugugcaucuagguuaacuucagauggucuugccagacauguaaugcaguguccuaagcggaaggaaaaaauagaagaaaccgaauuauaccugaacuuagaaagaaucccuuggguugucagaaaacuacugcagguaucagaauccacugguguagcacuaaagaggagcaguuggcugauugugcuacuugugcuucucacaguuucauugucaccaguacaaucagcaccuaucgguagaaagcccuuauuuuuagacaguauugcuaaggguaugaagaaccugcugaauucaacaagcuuagaaacaagcuuaucaauugaggcaccauggggagcaauaaacguccaaucuacuuucaaaccuacugugucaacugcaaacauagcacuuaguuggagcucaguggaacacagagguaauaagaucuugguuucaggcagaucagagucaaucaugaagcuagaagaaagaacaggaaucagcugggauuugggaguagaagaugccucugaguccaaauuacuuacuguuuccgucauggacuuaucacagauguacucuccugucuuugaguaccuaucaggugacagacaaguagaggaauggccaaaggcaaccuguacaggcgauugcccggaaagauguggcugcacaucaucaaccugccuacacaaggaauggccucacucaagaaacuggagaugcaaccccacuugguguuggggagucggcaccggaugcaccuguuguggacuagauguaaaggaccuuuuuacagauuacauguuuguuaaauggaaggucgaauauauaaaaacagaggcuauaguguguguugagcuuacuagccaagaaagacaauguagcuugauugaggcaggcacaagauucaacuuagguccugugacuaucacauuaucagagccaagaaacauucagcaaaagcucccuccagaaauugucacauuacauccuagaauugaagaagguuuuuuugacuuaaugcauguacagaagguacuaucagcaagcacagugugcaagcuacagaguugcacacauggcguaccaggagacuuacaggucuaccacaucggaaacuuacuaaaaggagacaaagugaaugggcaucugauacauaaaguugaaccacauuucaacaccuccuggaugucuugggacggcugugaccuagauuacuacugcaauaugggggauuggcccucuugcacguauacuggaguuacccaacauaaucaugcugcauuuguaaaccuacuuaacauugaaacugauuacacaaagaacuuccacuuucacucuaagagagucacugcacauggggacacuccacaauuagauuuaaaagccagaccaaauuauggugcaggugaaaucacugugcugguggaaguugcugacauggaguuacacacaaagaaaauugagauaucagguuugaaguuugcaagccuaaccugcacagguuguuaugcuuguagcucuggcaucucauguaagguuaggauccauguagaugaaccagaugagcuuacaguacaugugaagagugaagacccagacauaguugcugcuagcucaagucucauggcaagaaagcuugaauucgggacggauaguacauucaaagccuucucagccaugccuaaaaccuccuugugcuuuuacauuguugagagagaauacuguaaaagcugcaguaaagaagacacacaaaaguguguuaacgcaaagcuugagcgaccacagagcauuuuaauugagcacaaaggaacgauaauuggaaagcagaacgacacuugcacagcuaaagcaagcugcuggcuagagucagucaagaguuucuuuuauggacuaaagaacaugcuuaguggcauuuuuggcaauguuuucauagggauuuucuuauuccuugcuccuuuuauccuguuaauacuuuucuuuauguuuggguggagaauccuauucugcuuuaagugcugcaggagaacuagaggccuauuuaaguacagacaccucaaagaugaugaagaaaccgguuauaggaaaaucauugagagacuaaacaacaaaaaagguaaaaacaagcugcuugacggugaaagauuagcugauagaaagaucgcugagcuguucucuacaaaaacacacauuggc

SEQ ID NO: 3883 - RNA, 2916 nt, Artificial Sequence
  derived and/or modified CDS sequence (wt) from CCHFV(200406546-Turkey, Artificial)__KR864902.1__Gn-4aa-Gc
uccgaagagccaggugaugacugcauaucaagaacucagcuauugaggacagaaacagcagagauucaugaugauaacuaugguggcccaggugauaaaauaacuaucugcaacgguucaacuauuguagaucagagacugggcagugaacuaggguguuauacuaucaacagggugaagucauucaagcuaugcgaaaacagcgccacagggaaaaccugugagauagacagcacuccaguuaagugcaggcaagguuuuuguuuaaaaaucacccaagagggaaggggccacguaaaauuaucuagaggcucagagguugucuuggacguuugcgacucaagcugugaaguaaugauaccuaaaggcacuggagauauccugguggacuguucagguggacagcaacauuucuuaaaagacaaccuaauugaccuagggugcccccaugucccgcuauuggguaggauggccauuuacauuugcagaaugucaaaucauccuagaacaacuauggcuuuucucuucugguucagcuuuggcuaugugaucaccuguauauuuugcaaggcucuuuuuuauucauugauaauuauugggacacuagggaaaaaguucaagcaguauagggaacugaaaccucaaacuuguaccauaugugagacggcuccugucaaugcaauagaugcugaaaugcaugaccuuaacugcaguuacaauauaugcccuuauugugcaucaagauugaccuccgacgggcuagcuaggcaugugccacaaugccccaagcggaaagaaaaaguugaggagacugaacuguacuugaaccuggagagaauuccuuggauugucagaaagcuauugcaggugucagaguccacugguguggcauugaaacgaagcagcuggcugauuguacugcuuguguuacucacaguuucguugucaccgguucaaucggcaccuguugguagaaaaccucuguucuuagacaguauaguuaaaggcaugaaaaauuugcuaaacucaacaagcuuagaaacaaguuuaucaauugaggcaccauggggagcaauaaauguccagucaaccuuuaaaccaacaguaucgacugcaaauauagcacucaguuggagcucaauagagcacaggggcaacaagaucuuagucacaggcaggucugaaucaauuaugaagcuggaggaaaggacaggggucagcugggaucuaggcguagaagaugccucugaaucuaaauuacucacugucucuauuauggauuugucacaaauguacuccccuguuuuugaguacuugucaggagacagacagguugaggaauggcccaaagcaacgugcacaggugacugcccagaaaggugugguugcacaucaucaaccugcuugcauaaagaauggccucacucaagaaacuggagauguaaucccacuuggugcuggggaguaggaacuggcugcaccugcugcgggguggaugugaaagaccuuuuuacagaucacauguuugucaaauggaagguugaauauauaaaaacugaagccauaguauguguugagcucaccagccaagaaagacagugcagucugauugaggcagguacuagauucaacuugggcccugugacuauuacccugucugagccaagaaacauucagcagaagcuucccccugagauuaucacguugcaucccaaaguugaagaaggcuucuuugacuugaugcauguacaaaaaguguugucugcaaguacaguguguaaacugcaaagcugcacacaugguauaccaggagaucuacaaguuuaccacauuggcaacuugcugaaaggugauagaguaaacgggcaucuaauucacaaaauugaaccacauuucaacaccucuuggauguccugggaugguugugacuuagacuacuacugcaacaugggggauuggccuucuugcacauacacaggagugacccagcauaaccaugcugcauuuguaaacuugcuuaacauugaaacugauuacacgaaaaccuuccacuuccacucuaaaagagucacagcacauggugacacaccacaauuagacuuaaaagcaaggccgaccuacggugcaggugagaucacugugcugguugaaguugcugauauggagcugcauaccaagaaaguugagauaucaggcuugaaauuugcaagucuagcuugcacggguugcuaugcuuguagcucuggcaucuccuguaaagucaggauucauguagaugagccagaugagcucacaguacauguaaagagcagugauccugaugugguugcagcuagcacaagucucacggcgaggaagcuugaauuugggacagacagcacauucaaggccuuuucagcuaugcccaagaccucuuuauguuuuuacauuguggagaaagaauacugcaagagcugcaaugaagaugacacacaaaaauguguugacacaaagcuugagcagccacagagcauacuaauugagcacaaaggaacgauaauuggaaagcagaaugauacuugcacagccaaggcaagcuguuggcuggagucagucaagaguuuuuuuuauggauuaaagaauaugcuugguagugucuuugguaauuuuuucauaggcauuuuguuauuccuugccccuuuuguccuguuggugcuuuucuuuauguuuggauggaaaaucuuguuuugcuuuaaauguugcaggaggaccagaggcuuauuuaaguauagacaccucaaagacgaugaggaaacaggcuacaaaaggauuauugaaagauugaacaacaaaaaagggaaaaacagacugcuugauggugaaagguuggcugauaggaaaauugcugagcuguucuccacaaaaacacacauuggu

SEQ ID NO: 3884 - RNA, 2916 nt, Artificial Sequence
  derived and/or modified CDS sequence (wt) from CCHFV(1-CR/HU-2015, Artificial)__KU161584.1__Gn-4aa-Gc
uccgaagagccaggugaugacugcauaucaagaacucagcuauugaggacagaaacagcagagauccaugacgacaacuacggcgguccaggugacaaaauaacuaucugcaaugguucaaccaucguagaucagagacugggcagugaacuaggguguuauaccaucaacagggugaagucauucaagcuaugcgaaaacagcgcuacagggaaaaccugugagauagacagcacuccggucaagugcaggcaagguuucuguuuaaaaaucacccaagagggaaggggccacguaaaauuaucuagaggcucagagguugucuuggaugcuugcgacucaagcugugaagugaugauaccuaaaggcaccggagauauccuaguagacuguucagguggacagcagcauuuuuuaaaagacaacuugauugaccuagggugcccccacaucccgcuauuggguaagauggccauuuacauuugcagaaugucaaaucauccuaggacaaccauggcuuuucucuucugguucagcuuuggcuaugugaucaccuguauauuuugcaaggcucuuuuuuauucauuaauaauuauugggacacuagggaaaaagaucaagcaguauagagaacuaaaaccucaaacuuguacuauaugugagacagcuccugucaaugcaauagaugcugaaaugcaugaccucaacuguaguuacaauauaugcccuuauugugcaucaagacugaccucugaugggcuagcuaggcauguaacgcaaugcccuaagcgaaaggagaaaguugaggagacugaacuguacuugaaccuagaaagaauuccuuggaucgucagaaagcuauugcaagugucagaguccacugguguggccuugaaacgaagcaguugguugauugugcugcuuguguuacucacaguuucauugucaccgguucaaucagcaccuguugguaggaaaccccuuuuccuagacaguauaguuaaagguaugaaaaauuugcuaaacucgacaagcuuagaaacaagcuuaucaauugaggcaccauggggagcaauaaauguccagucaaccuuuaaaccaacaguaucaacugcaaacauagcacucaguuggagcucaguggagcacagaggcaacaagaucuuagucacaggcaggucugaaucaauuaugaaacuagaggaaaggacaggagucagcugggaucuaggcguagaagaugccucugaauccaaauuacuuaccgucucuauaauggauuuaucacaaauguauuccccuguuuuugaguacuugucaggagacagacagguugaagaguggcccaaagcaacuuguacaggugauugcccagaaagguguggcugcacaucaucaaccugcuugcauaaagaauggccucacucaagaaacuggagauguaaucccacuuggugcuggggaguaggaaccggcugcaccuguugcgggguggauguaaaagaccuuuuuacagaucacauguuugucaaauggaagguugaauauauaaaaacugaagccauaguauguguugagcucaccagccaggaaagacagugcagucuuauugaggcagguacaagauucaacuuaggcccugugacuaucacccugucugagccaagaaacauucagcagaagcuucccccugagaucauuacguugcaucccaaaauugaagaaggcuucuuugacuugaugcauguacaaaaaguguugucugcaaguacaguguguaaacugcagaguugcacacaugguauaccaggagaccuacaaguuuaccacauuggcaacuuguugaaaggggauagaguaaacgggcaucuaauucacaaaauugaaccacauuuuaacaccucuuggauguccugggaugguugugaucuagacuacuacugcaacaugggggacuggccuucuugcacauacacaggagugacccagcauaaucaugcugcauuuguaaacuugcuuaacauugaaacugauuacacgaaaaccuuccacuuccacucuaaaagagucacagcacauggugacacaccacaauuagacuuaaaagcaaggccgaccuacggugcaggugagaucacugugcugguugagguugcugacauggaguugcauaccaaaaaaguugagauaucaggcuugaaauuugcaagccuggcaugcacggguugcuaugcuuguagcucuggcaucuccuguaaagucagaauucauguagaugaaccagaugagcucacagugcauguaaagagcagugauccagacgugguugcagcuagcacaagucuuauggcaaggaagcuugaauuugggacagacagcacauucaaggccuuuucagcuaugccuaaaaccucuuuauguuuuuacauuguggagagagaauacugcaagagcugcagugaagaugauaccaaaaaauguguugacacaaaacuugagcagccacagagcauacuaauugagcacaaagggacgauaauuggaaagcagaaugauacuugcacagccaaggcaagcuguuggcuagagucagucaagaguuuuuuuuauggauugaagaauaugcucggcaguguuuuuggcaauuuuuuuauaggcauuuuguuauuccuugccccuuuuguccuguuggugcuuuucuuuauguuuggauggaaaaucuuguuuugcuuuaaauguugcaggaggaccagaggcuuguuuaaguauagacaccucaaagacgaugaggaaacaggcuacagaaggauuauugaaagacugaacaacaaaaaggggaaaaacagacugcuugauggugaaagguuggcugauaggaaaauugcugagcuguucuccacaaaaacacacauuggc

SEQ ID NO: 3885 - RNA, 2916 nt, Artificial Sequence
  derived and/or modified CDS sequence (wt) from CCHFV(Gaib, Artificial)__KX013445.1__Gn-4aa-Gc
uccgaagaauccagugaugacugcauaucaagaacucagcuauuaaggacagagacugcagaaauccauaaugauaauuauggagggccaggugacaaaauaacuauuuguaaugguucaacuauuguagaucaaaggcuaggcagugaacugggauguuacacuaucaauagaguaaagucauuuaagcuaugcgaaaacagugcuacagggaaauccugugaaauagauagcaucccuguaaagugcaggcaaggguuuuguuuaaaaauuacucaggagggaagaggccaugugaaguugucaagagguucagaaguugucuuagaugccugugauucaagcugugaaauaaugauaccaaaaggcaccggagacauccuaguggacuguucaggugggcaacaacauuuuuuaaaggauaacuugauugacuuagggugucccaauaucccacuguuaggcaaaauggcuaucuacauuuguagaaugucuaaucaucccaaaacaaccauggccuuucucuuuugguuuaguuuugguuaugugauaaccuguauauuuugcaaagccaucuuuuauuuguugauaaucguggggacacuuggaaaaaaguucaaacaguauagagaguuaaaaccucagaccuguaccauaugugaaacaacuccugucaacgcaauagacgcugaaaugcaugaucuuaacugcaguuacaauauaugcccuuauugugcaucuagauuaaccucagauggacuugccagacacguugugcacugcccuaagcggaaggagaaaauagaagagacugaacuguacuuaaacuuagaaagaguuccuuggguuguuagaaaacuacuucaggugucugaaucaacugguguggcacugaagaggagcaguuggcuaauugugcuacuugugcuacuuacagucucauugucaccaguucaaucagcacccaucgguaggaaaccccuguucucagacagcauaguuaagggcaugaaaaaccugcugaacucaacaaguuuagagacaaguuuaucaauugaggcaccauggggagcgauaaauguccaaucaaccuuuaaaccuacuguaucaacugcaaauauagcacucaguuggagcucaauagagcacagaggcaacaagauucuggucucaggcagaucagagucaaucaugaagcuagaagagaggacaggaaucagcugggaccuaggcguggaagaugcuuccgagucuagguuacuuacuguuucuguuauggauuugucacaaauguacucucccguuuuugaauaccugucaggugacagacagguggaggaauggccuaaagcaaccugcacaggcgacuguccugaaagauguggaugcacaucgucaaccugcuuacacaaagaauggccucauucaagaaauuggagaugcaaucccacuuggugcuggggaguugguaccgggugcaccugcuguggacuagauguaaaagaccuuuuuacagacuauauguuugucaaauggaaagucgaguacauaaagacagaggcuauaguguguguugaacuuacaagccaagaaaggcaaugcaguuugauugaggcaggcacaagauucaacuuagguccagugaccaucacauugucagaaccgagaaacauucagcaaaagcuuccuccugaaauaaucacauugcacccuagaauugaagaaggcuucuuugaccuaaugcacgugcagaaagugcugucugcuaguacgguguguaaacuacagaguugcacacacggugugccgggggaucuacaggucuaccacauuggcaauuuguuaaaaggggauaaggugaacggacaucugauucacaagauugaaccacacuucaacacuucuuggauguccugggaugguugugaccuggacuacuacugcaauaugggggauuggccuuccugcacguauacuggaguaacccaacauaaccacgccgcauuugugaaccugcucaacauugaaacugauuauaccaaaaacuuccacuuccacucuaagagaguuacugcacauggagacacaccgcaauuggauuugaaggcuagaccaaccuauggugcaggcgagaucacugugcugguagaaguugcugacauggagcuacacacaaaaaagauugagauaucaggccugaaauuugcgagucuaacuugcacagguugcuaugcuugcagcucuggcaucuccuguaaaguuaggauccauguagaugaaccagaugagcuuacagugcaugugaaaagugaagauccagacauaguugcagcuagcucaagucucauggcaaggaagcuugaauuugguacagacaguaccuuuaaagccuuuucagcuaugcccaaaaccucuuuaugcuuuuacauuguagagagagaauauugcaagagcugcaguagagaagacacacaaaaaugugucagcacaaaacuugagcaaccacagagcauuuuaauugaacacaaaggaacgauaaucggaaaacagaauaacaccugcacaacuaaaacaaccuguugguuggaaucaguaaagaguuucuuuuauggacuaaagaacaugcuuagcaguauuuuuggcaauguuuucgugggcauuuucucauuccuugccccuuucaucuuacugauacuuuucuucauguuuggguggagaauccuauuuugcuuuaaguguugcagaaggacuagaggcuuauuuaaguacagacaucucaaagacgaugaagagaccgguuauaggaggaucauugaaagauuaaacaacaaaaaaggaaagagcaaguugcuugauggugaaagguuggcugauaggaagauugcugagcuguucuccacaaaaacacacauugga

SEQ ID NO: 3886 - RNA, 2916 nt, Artificial Sequence
  derived and/or modified CDS sequence (wt) from CCHFV(Hodzha, Artificial)__KX013448.1__Gn-4aa-Gc
ucugaagaaucuggugacgacugcauaucaagaacucagcuacugaggacagagacugcagagauccauggugaugauuauggugguccgggcgacaagauuaccauuugcaaugguucaacuauuguagaucaaagacuagguagugaacugggguguuacacuaucaauagagugaagucauucaagcugugcgaaaacagugcaacagggaagagcugugaaauagacagcaccccaguuaaaugcaggcaggguuauugccuaaaaaucacucaggaaggaaggggccaugugaaauuauccaggggcucggagguugucuuggaugcaugcgauucaagcugugaaguaaugauaccuaagggcacaggugacauccuaguagacuguucaggugggcagcaacauuuuuugaaagacaacuuaauugaucuaggaugucccagaauuccauuauuagguaaaauggcuauuuauauuugcagaaugucgaaucacccugagacaaccauggcuuuccucuuuugguucaguuucggcuaugugauaaccuguauacucugcaaggccauuuucuacuuauuaauaauuguuggaacacuagggaagagguucaagcaguauagagaguuaaaaccccagaccuguaccauaugugagacaacuccugcaaaugcaauagaugcugaaaugcaugaccuuaacugcaguuacaacauaugucccuauugugcaucuagacuaaccucagaugggcuugcuaggcaugugacacaaugcccuaagcggaaggagaagguagaagaaacugaauuguacuugaacuuagagagaauucccuggauuguaagaaagcuguugcaggugucggaguccacugguguugcauuaaaaagaagcagcuggcugauugugcugcuugugcuguucgcaguuucauuaucaccuguucaaucagcacccauugguagaaggccccuguuccuggauaguauaguuaaaggcaagaaaaaucuguuaaacuccacaaguuuagaaacaagcuugucgauugaggcaccauggggggcaauaaauguucagucaaccuacaaaccaacuguaucaacugcaaacauagcacuuaguuggaguucaguugaacacagagguaauaagauuuugguuucaggcagaucagaaucaauuaugaagcuggaagaaagaacaggaaucagcugggaucuuggcguugaagaugccucugaaucuaagcuacuuacugucucugucauggacuugucucagauguacuccccugucuucgaguacuuaucgggugacagacaaguagaagaguggcccaaggcaaccugcacaggugacugcucagaaagauguggcugcacaucaucaaccugcuuacauaaagaauggccccauucacgaaacuggagaugcaaucccacuuggugcugggggguggggacuggcugcaccuguuguggauuagaugugaaagaccuauuuacagauuauauguucgucaaguggaaaguugauuacauuaaaacagaggccauaguguguguagaacucaccagucaggaaaggcaguguagcuugguugaggcgggcacaagguucaauuuagguccuguaaccaucacauugucagaaccgaggaacauacaacaaaagcucccuccugaaauaaucacauugcauccuaggauugaagaagguuuuuuugaccugaugcauguacaaaaagugcugucagcaagcacaguguguaaauugcagaguugcacacauggugugccaggagaucuacaggucuaccacaucggaaauuuauuaaaaggagauaaagugaacggacaccuaauucauaaaauugagccgcacuucaauacuuccuggauguccugggauggcugugaccuagacuacuacugcaacaugggagacuggccuucuugcacauauaccggaguuacucaacacaaucaugcuucauuuguaaaccugcucaacauugaaacugacuauacaaaaagcuuccacuuucacucuaaaaggguuacugcacauggagacacaccacaauuggaucugaaggcaagaccaaccuacggcgcaggagaaaucacuguacugguagaaguugcugauauggaguuacacacaaagaagaucgaaauaacaggccucaaauuugcaagccugacuugcacagguuguuaugcuuguaguucaggcaucuccugcaaaguuaggauucacguggaugaaccagaugagcuaacaguacauguuaaaagugaugauccagauguaguugcagccagcucaagucucauggcaaggaaacuugaguuuggaacagacaguacauucaaagcuuucucagccaugccuaaaacuuccuuaugcuucuacauugucgaaagggaguacuguaagagcugcaguaaagaagacacacagaaauguguuaacacaaaacuugagcaaccacagagcauuuugaucgaacaaaagggaacuauaaucggaaagcaaaacaauacuugcacagccaaggcaaguugcugguuagagucaguuaaaaguuucuuuuauggucuaaagaacaugcuuaguggcauuuuuggcaauguuuuuguaggcauuuucuuauuucuugcccccuuuaucuuguuaauacuuuucuucauguuuggauggaggauccuguuuugcuucaaguguugcagaagaaccaggggccuguuuaaguauaaacaucucaaagacgaugaagaaacugguuacagaaggaucauugaaagacugaacaacaagaaggggaaaaacaagcugcuugacggugaaagacuugccgauagaaggauugccgaacuauucuccacaaaaacacacauuggc

SEQ ID NO: 3887 - RNA, 2916 nt, Artificial Sequence
  derived and/or modified CDS sequence (wt) from CCHFV(IbAn7620, Artificial)__KX013451.1__Gn-4aa-Gc
uccgaagaacccagugaugacuguauaucaagaacucaacuauugaggacagagacugcagagauccacggcgacaacuaugguggcccgggugauaaaauaaccaucugcaauggcucaacuauuguagaccaaagacugggcagugaacuaggguguuacaccaucaauagagugaagucauucaagcuaugcgaaaacagugccacagggaagaauugugaaauagacagugucccaguuaaaugcaggcaggguuauugccuaagaaucacucaagaagggaggggccacguaaaauuaucuaggggcucagagauugucuuagaugcaugcgauacaagcugugaaauaaugauaccuaagggcacuggugacauccuaguugacuguucaggugggcagcaacauuuucuaaaggacaauuugauagaucuaggaugcccuaaaauuccauuauugggcaaaauggcuauuuacauuugcagaaugucgaaccaccccaaaacaaccauggcuuuccucuucugguucagcuuugguuauguaauaaccuguauacuuugcaaggccauuuuuuacuuguuaauaauuauuggaacacuagggaaaaggcucaagcaguauagagaguugaaaccucagaccugcaccauaugugagacaacuccuguaaaugcaauagaugcugagaugcaugaccucaauugcaguuacaacauuugucccuacugugcaucuagacuaaccucagaugggcuugcuaggcaugugauacaaugcccuaagcggaaggagaaaguggaagaaacugaacuguacuugaacuuagaaagaauuccuuggguuguaagaaagcuguugcaggugucagagucaacugguguggcauugaaaagaagcaguuggcugauugugcugcuugugcuauucacuguuucauuaucaccaguucaaucagcacccauugguagaaagccuuuguuccuagauaguauagcuaaaggcaugaaaaauccgcuaaauucaacaaguuuagaaacgaguuuaucaauugaggcaccauggggagcaauagauguucagucaaccuacaaaccaacugugucaacugcaaacauagcacucaguuggagcucaguggaacacagagguaauaagaucuugguuucaggcagaucagaaucaauuaugaagcuagaagaaaggacgggaaucagcugggaucucggcguagaagaugccucugagucuaaacugcuuacagucucugucauggaccugucucagauguacucuccugucuucgaguacuuaucaggggacagacagguggaagaguggcccaaagcaacuuguacaggugauugcccagaaagaugugguugcacaucaucaaccuguuugcacaaagaauggccucacucaagaaauuggagaugcaaucccacuuggugcuggggaguagggacuggcugcaccuguuguggauuagaugugaaagaccuuuuuacagauuauauguuugucaaguggaaaguugaauacaucaagacagaggccauaguguguguagaacuuaccagucaggaaaggcaguguagcuugauugaagcgggcacgagguucaauuuagguccugugaccaucacacugucagaaccaagaaacauccaacaaaaacucccuccugaaauaaucacacugcauccuaggaucgaagaagguuuuuuugaucugaugcaugugcaaaagguguuaucggcaagcacaguguguaaguugcagaguugcacacauggugugccaggagaccuacaggucuaccacaucggaaauuuauuaaaaggggauaagguaaauggacaucuaauucauaaaauugagccacacuucaacacuuccuggauguccugggaugguugugaccuagacuacuacugcaacaugggagauuggccuucuugcacauacacaggggucacccaacacaaucaugcuucauuuguaaacuuacucaacauugaaacugauuacacaaagaacuuccacuuucacucuaaaagggucacugcacacggagacacaccacaacuagaucuuaaggcaagaccaaccuauggugcaggcgagaucacuguucugguagaaguugcuaacauggaguuacauacaaagaagauugaaauaucaggcuuaaaauuugcaagcuugacuuguacagguuguuaugcuuguagcucuggcaucucaugcaaaguuagaauucauguggaugaaccagaugaacuuacaguacauguuaaaagugaugauccagaugugguugcagcuagcucaagucucauggcaagaaagcuugaauuuggaacagacaguacauuuaaagcuuucucggccaugcccaaaacuucucuauguuucuacauuguugaaagagaacacuguaagagcugcagugaagaagauacaaaaaaauguguuaacacaaagcuugagcaaccacaaagcauuuugaucgaacacaagggaacuauaauaggaaagcaaaacagcacuugcacggcuaaggcgaguugcugguuggagucagucaagaguuuuuuuuauggccuaaagaacaugcuuaguggcauuuuuggcaaugucuuuaugggcauuuucuuguuccuugcccccuucauccuguuaauacuauucuuuauguuuggguggaggauccuauucugcuuuaaauguuguagaagaaccagaggccuguucaaguacagacaccucaaagacgaugaagaaacugguuauagaaggauuauugaaagacuaaacaauaaaaaaggaaaaaacaagcugcuugauggugaaagacuugcugauagaagaauugccgaacuguucucuacaaaaacacacauuggc

SEQ ID NO: 3888 - RNA, 2916 nt, Artificial Sequence
  derived and/or modified CDS sequence (wt) from CCHFV(K128_76, Artificial)__KX013454.1__Gn-4aa-Gc
ucugaugaaucuggugaugacugcauaucaaggacucagcuguugagaacagagacugcagagauccauggugacaauuauggugguccgggugacaagauuaccauuugcaaugguucaacuauuguagaccaaagacuggguagugaacugggguguuacacuaucaauagagugaagucauucaagcugugcgaaaacagugccacagggaagagcugugaaauagacaguaucccaguuaagugcaggcaggguuauugccuaaaaaucacucaagaaggaaggggccaugugaaauuauccaggggcucagagguugucuuggaugcaugcgacucaagcugugaaguaaugauaccuaagggcacaggugacauucuaguagacuguucaggugggcagcaacauuuuuugaaggacaacuugauugaccuaggaugucccaaaauuccauuguugggcaaaauggcuauuuauauuuguagaaugucgaaucaccccaaaacgaccauggcuuuccucuuuugguucaguuuuggcuaugugauaacuuguauagucugcaaagccauuuuuuacuuauuaauaauuguuggaacacuagggaagagguuuaagcaguauagagaguuaaaaccccagaccuguaccaucugugagacaacuccuacaaaugcaauagaugcugaaaugcaugaccuuaacugcaguuacaacauaugucccuauugugcaucuagacuaaccucagaugggcuugcuaggcauguaacucauugcccuaagcggaaggagaaaguagaagaaacugaauuguacuugaacuuagaaagaauuccauggguuguaagaaagcuauugcagguaucagaguccaccgguguagcauuaaaaagaagcagcuggcugauugugcugcuugugcuguuugcaguuucauuaucaccaguucaaucagcacccauuaguagaaggccccuguuucaggacaguauagucaaaggcaugaaaaaccugcuaaacucaacaaguuuagaaacaagcuugucgauugaggcaccauggggggcaauaaauguucagucaaccuacaaaccagcugugucagcugcaaacauagcacuuaguuggaguucaguugaacacagagguaguaagauuuugguuucaggcagaucagaaucaauuaugaagcuggaagaaaggacaggaaucagcugggaucuuggcguagaagaugccucugaaucuaagcuacuuacagucucugucauggacuugucucagauguacuccccugucuucgaguacuugucaggugacagacaaguagaagaguggcccaaggcaaccuguacaggugacugcccagagagaugugguuguacaucaucaaccuguuugcauaaagaauggccccauucaagaaacuggagguguaaucccacuuggugcugggggguagggacuggcugcaccuguugugguuuagaugugaaagaccuuuuuacagacuauauguucgucaaguggaaaguugaauauauuaagacagaggccauaguguguguagaacuuaccagucaggaaaggcaguguaguuuaauugaggcagguacaagguucaauuuagguccugugaccaucacauugucagaaccgaggaacauccaacaaaagcucccuccugaaauaaucacacugcauccuaggauugaagaagguuuuuuugaccugaugcaugugcaaaaggugcugucagcaagcacaguguguaaguugcagaguugcacacauggugugccaggagaucuacaagucuaccacaucgggaauuuacuaaaaggagauagaguuaacggacaccuaauucauaaaauugagccacacuuuaacacuucuuggauguccugggauggcugugaccuagacuauuacugcaacaugggagacuggccuucuugcacauauaccggaguuacccagcacaaucaugcuucauuugugaaccugcucaacauugaaacugacuauacaaaaagcuuccauuuucacucuaaaaggguuacugcacauggagacacaccacaauuagaucugaaggcaaggccaaacuauggcgcaggagagaucaccguacugguagagguugccgauauggaguuacacacaaagaagauugaaauaucaggccuaaaguuugcaagcuugacuuguacagguuguuaugcuuguaguuccgguaucuccuguaaaguuaggauucauguggaugaaccagaugaacuuacaguacauguuaaaagugaugauccagauguaguugcagcuagcucaagucucauggcaaggaagcuugaauuuggaacagacaguacauuuaaggcuuucucagccaugcccaaaaccuccuuauguuucuacauugucgaaagggaguacugcaagagcugcaguaaagaagacacacaaaaauguguuaacacaaaacuugagcagccacagagcauuuuaaucgaacauaagggaacuauaaucggaaagcaaaacaauaccugcacagcaaagacaaguugcugguuagagucaguuaaaaguuucuuuuaugguuuaaagaacaugcuuaguggcauuuuuggcaauguuuuuguggguauuuucuuauuucuugcccccuucaucuugcuaauacuuuucuuuauguuuggguggaggauccuguuuugcuucaagugcuguagaagaaccagaggccuguucagauauaagcaucucgaaaacgaugaagaaacugguuacagaagaaucauugaaagacugaacaacaaaaaaggaaaaaacaagcugcuugauggugaaagacuugcugauagaagaaucgccgaacuauucuccacaaaaacacacauuggc

SEQ ID NO: 3889 - RNA, 2916 nt, Artificial Sequence
  derived and/or modified CDS sequence (wt) from CCHFV(K168_40, Artificial)__KX013457.1__Gn-4aa-Gc
ucugaugagucuggugaugacugcauaucaaggacucagcuacugagaacagagacugcagagauccauggugacaauuauggugguccgggugacaagauuaccauuugcaaugguucaacuauuguagaccaaagacugggcagugaacugggguguuacacuaucaauagagugaagucauucaagcugugcgaaaacagugccacagggaagagcugugaaguagacaguaucccaguaaaaugcaggcaggguuauugccuaaaaaucacucaggaaggaaggggccacgugaaauuauccagagguucagagguugucuuggaugcaugcgauucaagcugugaaguaaugauaccuaagggcacaggugacauccuaguggacuguucaggugggcagcaacauuucuugaaggacaacuuaauugaccuaggaugucccaaaauuccauuguugggcaaaauggcuauuuauauuugcagaaugucgaaucaccccaagacaaccauggcuuuccucuuuugguucaguuuuggcuaugugauaacuuguauagucugcaaggccauuuuuuacuuauuaauaauuguuggaacacuagggaagagguuuaagcaguauagagaguuaaaaccccagaccugcaccaucugugagacaacuccuacaaaugcaauagaugcugaaaugcaugaccuuaacugcaguuacaacauaugucccuauugugcaucuagacuaaccucagaugggcuugcuaggcauguaacucauugcccuaagcggaaagagaaaguagaagaaacugaauuguacuugaacuuagagagaauucccuggguuguaagaaagcuguugcagguaucagaguccaccgguguagcauuaaaaagaagcagcuggcugauugugcugcuugugcuguuugcaguuucauuaucaccaguucaaucagcaccuauugguagaaggccccuguuucuggacgguauagucaaaggcaugaaaaaccugcuaaacucaacaaguuuggaaacaagcuugucgauugaggcaccauggggggcaauaaauguucagucaaccuacaaaccaacuguaucagcugcaaacauagcacuuaguuggaguucaguugaacacagagguaauaagauuuugguuucaggcagaucagaaucaauuaugaagcuggaagaaaggacaggaaucagcugggaucuuggcguagaagaugccucugaaucuaagcuacucacagucucugucauggacuugucucagauguacucuccugucuucgaguacuugucaggugacagacaaguagaagaguggcccaaggcaaccuguacaggugacugcccagagagauguggcuguacaucaucaaccuguuugcauaaagaauggccccauucaagaaacuggagguguaaucccacuuggugcugggggguagggacuggcugcaccuguugugguuuagaugugaaagaccuuuuuacagacuauauguuugucaaguggaaagucgaauacauuaagacagaggccauaguguguguagaacuuaccagucaggaaaggcaguguagcuuaauugaggcggguacaagguucaauuuaggucccgugaccaucacauugucagaaccgaggaacauccaacaaaaacucccuccugaaauaaucacacugcauccuaggauugaagaagguuuuuuugaccugaugcauguacaaaaggugcugucagcaagcacaguguguaaguugcagaguugcacacauggugugccaggagaucuacaggucuaccacaucggaaauuuacuaaaaggagauaaaguuaacggacaccuaauucauaaaauugaaccacacuucaacacuucuuggaugucuugggauggcugugaccuagacuacuacugcaacaugggagauuggccuucuugcacauauaccgggguuacccagcacaaucaugcuucauuuauaaaccugcucaacauugaaacugacuauacaaaaagcuuccauuuucacucuaaaaggguuacugcacauggagacacaccacaauuagaucugaaggcaaggccaaacuauggcgcaggagagaucaccguacugguagagguugccgauauggaguuacacacaaagaagauugaaauaucaggacuaaaguuugcaagcuugacuuguacagguuguuaugcuuguaguuccgguaucuccuguaaaguuaggauucauguggaugaaccagaugaacuuacaguacauguuaaaagugaugauccagauguaguugcugcuagcucaagucucauggcaaggaagcuugaauuuggaacagacaguacauuuaaggcuuucucagccaugccaaaaaccuccuuauguuucuauauugucgaaagggaauacugcaagagcugcaguaaagaagacacacaaaaauguguuaacacgaagcuugagcauccacagagcauuuugaucgaacauaagggaacuauaaucggaaagcagaacaauaccugcacagcaaagacaaguugcugguuagagucaguuaagaguuucuuuuaugguuuaaagaacaugcuuaguggcauuuucggcaacguuuuuguaggcauuuucuuauuucuugcccccuucaucuugcuaauacuuuucuuuauguuuggguggaggauccuauuuugcuucaagugcuguagaagaaccagaggccuguuuagauauaaacaucucgaagacgaugaagaaacugguuacagaagaaucauugaaagacugaacaacaaaaaaggaaaaaacaagcugcuugauggugaaagacuugcugauagaagaauugccgaacuauucuccacaaaaacacacauuggc

SEQ ID NO: 3890 - RNA, 2916 nt, Artificial Sequence
  derived and/or modified CDS sequence (wt) from CCHFV(K168_125, Artificial)__KX013460.1__Gn-4aa-Gc
ucugaugagucuggugaugacugcauaucaaggacucagcuacugagaacagagacugcagagauccauggugacaauuauggugguccgggugacaagauuaccauuugcaaugguucaacuauuguagaccaaagacugggcagugaacugggguguuacacuaucaauagagugaagucauucaagcugugcgaaaacagugccacagggaagagcugugaaguagacaguaucccaguaaaaugcaggcaggguuauugccuaaaaaucacucaggaaggaaggggccacgugaaauuauccagagguucagagguugucuuggaugcaugcgauucaagcugugaaguaaugauaccuaagggcacaggugacauccuaguggacuguucaggugggcagcaacauuucuugaaggacaacuuaauugaccuaggaugucccaaaguuccauuguugggcaaaauggcuauuuauauuugcagaaugucgaaucaccccaagacaaccauggcuuuccucuuuugguucaguuuuggcuaugugauaacuuguauagucugcaaggccauuuuuuacuuauuaauaauuguuggaacacuagggaagagguuuaagcaguauagagaguuaaaaccccagaccugcaccaucugugagacaacuccuacaaaugcaauagaugcugaaaugcaugaccuuaacugcaguuacaacauaugucccuauugugcaucuagacuaaccucagaugggcuugcuaggcauguaacucauugcccuaagcggaaagagaaaguagaagaaacugaauuguacuugaacuuagagagaauucccuggguuguaagaaagcuguugcagguaucagaguccaccgguguagcauuaaaaagaagcagcuggcugauugugcugcuugugcuguuugcaguuucauuaucaccaguucaaucagcaccuauugguagaaggccccuguuucuggacaguauagucaaaggcaagaaaaaccugcuaaacucaacaaguuuggaaacaagcuugucgauugaggcaccauggggggcaauaaauguucagucaaccuacaaaccaacuguaucagcugcaaacauagcacuuaguuggaguucaguugaacacagagguaauaagauuuugguuucaggcagaucagaaucaauuaugaagcuggaagaaaggacaggaaucagcugggaucuuggcguagaagaugccucugaaucuaagcuacucacagucucugucauggacuugucucagauguacucuccugucuucgaguacuugucaggugacagacaaguagaagaguggcccaaggcaaccuguacaggugacugcccagagagauguggcuguacaucaucaaccuguuugcauaaagaauggccccauucaagaaacuggagguguaaucccacuuggugcugggggguagggacuggcugcaccuguugugguuuagaugugaaagaccuuuuuacagacuauauguuugucaaguggaaagucgaauacauuaagacagaggccauaguguguguagaacuuaccagucaggaaaggcaguguagcuuaauugaggcggguacaagguucaauuuaggucccgugaccaucacauugucagaaccgaggaacauccaacaaaaacucccuccugaaauaaucacacugcauccuaggauugaagaagguuuuuuugaccugaugcauguacaaaaggugcugucagcaagcacaguguguaaguugcagaguugcacacauggugugccaggagaucuacaggucuaccacaucggaaauuuacuaaaaggagauaaaguuaacggacaccuaauucauaaaauugaaccacacuucaacacuucuuggaugucuugggauggcugugaccuagacuacuacugcaacaugggagauuggccuucuugcacauauaccgggguuacccagcacaaucaugcuucauuuauaaaccugcucaacauugaaacugacuauacaaaaagcuuccauuuucacucuaaaaggguuacugcacauggagacacaccacaauuagaucugaaggcaaggccaaacuauggcgcaggagagaucaccguacugguagagguugccgauauggaguuacacacaaagaagauugaaauaucaggccuaaaguuugcaagcuugacuuguacagguuguuaugcuuguaguuccgguaucuccuguaaaguuaggauucauguggaugaaccagaugaacuuacaguacauguuaaaagugaugauccagauguaguugcugcuagcucaagucucauggcaaggaagcuugaauuuggaacagacaguacauuuaaggcuuucucagccaugccaaaaaccuccuuauguuucuauauugucgaaagggaauacugcaagagcugcaguaaagaagacacacaaaaauguguuaacacgaagcuugagcauccacagagcauuuugaucgaacauaagggaacuauaaucggaaagcagaacaauaccugcacagcaaagacaaguugcugguuagagucaguuaagaguuucuuuuaugguuuaaagaacaugcuuaguggcauuuucggcaacguuuuuguaggcauuuucuuauuucuugcccccuucaucuugcuaauacuuuucuuuauguuuggguggaggauccuauuuugcuucaagugcuguagaagaaccagaggccuguuuagauauaaacaucucgaagacgaugaagaaacugguuacagaagaaucauugaaagacugaacaacaaaaaaggaaaaaacaagcugcuugauggugaaagacuugcugauagaagaauugccgaacuauucuccacaaaaacacacauuggc

SEQ ID NO: 3891 - RNA, 2916 nt, Artificial Sequence
  derived and/or modified CDS sequence (wt) from CCHFV(K229_194, Artificial)__KX013463.1__Gn-4aa-Gc
uccgaagagccaggugacgacugcauaucaagaacucagcuauugaagacagaaacagcagagauccaugacgacaacuauggugguccaggugacaaaauaacuaucugcaaugguucaaccauuguagaucagagacugggcagugaacuaggguguuauaccaucaacagggugaagucauucaagcuaugcgaaaacagugccacagggaaaaccugugagauagacagcacuccggucaagugcaggcaagguuuuuguuugaaaaucacccaagagggaaggggccacguaaaauuauccaggggcucagagguuguuuuggaugcuugcgacucgagcugugaaauaaugauaccuaaaggcacuggagauauccuaguagacuguucagguggacagcaacauuucuuaaaaggcaacuugauugaccuagggugcccucauaucccgcuauuggguaagauggccauuuacauuugcagaaugucaaaucaucccaggacaaccauggcuuuccucuucugguucaguuuuggcuauguaaucaccuguauauuuugcaaggcucuuuuuuauucauugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuagcuaggcaugugacacaaugcccuaagcgaaaggagaaaguugaggagacugaacuguauuugaaccuggaaagaauuccauggauagucagaaagcuguugcaaguaucagaguccacugguguggcauugaaacgaagcagcuggcugauugugcugcuuguguuacucacagucucauugucaccgguucaaucagcaccuguugguaggaaaccucuuuuuuuagacaguauaguuaaagguaagaaaaaucugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggaccugucacaaauguauuccccuguuuuugaguacuuaucaggagauagacagguugaagaauggcccaaggcaaccugcacaggugauugcccagaaagguguggcugcacaucaucaaccugcuugcauaaagaauggccucacucaagaaacuggagauguaaucccacuuggugcuggggaguaggaaccggcugcacaugcugcggaguggauguaaaagaccuuuuuacagaucacauguuuaucaaauggaagguugaauauauaaaaaccgaagccauaguauguguugagcucaccagccaagaaagacagugcagucugauugaggcagguacuagauucaacuuggguccugugacuaucacccugucugagccaagaaacauucagcagaagcuucccccugagaucauuacgcugcauccuaaaauugaagaaggcuucuuugacuugaugcaugugcaaaaaguguuaucugcaaguacaguguguaaacugcagaguugcacacaugguauaccaggagaucuacaaauuuaccacauuggcaaccuguugaaaggggauagauuaaacgggcaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaagaaaguugagauaucaggcuugaaauuugcaagucuggcuugcacggguugcuauucuuguagcucuggcaucuccuguaaagucagaauucauguagaugaaccggaugagcucacagugcauguaaagagcagugauccagaugugguugcagcuagcacaagccuuauggcaaggaagcuugaauuugggacagauagcacauucaaggcauuuucagcuaugcccaaaaccucuuuauguuuuuacauuguggagagggaauacugcaagagcugcagugaagaugauacaaaaaaauguguugacacaaaacuugagcagccacagagcauacuaauugagcacaaagggacgauaauuggaaagcaaaaugacacuugcacagccaaggcaaguuguuggcuagagucagucaagaguuuuuuuuauggauugaagaauaugcuuggcaguguuuuugguaauuuuuucguaggcauuuuguuauuccuugcccccuuugucuuguuggugcuuuucuuuauguuuggauggaaaaucuuguuuugcuuuaaguguugcaggaggaccagaggcuuguuuaaguauagacaccucaaagaugaugaggaaacaggcuacagaaagauuauugaaagacugaacagcaaaaaaggaaaaaacagacugcuugauggugagagguuggcugauaggaaaauugcugagcuguucucuacaaaaacacacauuggc

SEQ ID NO: 3892 - RNA, 2916 nt, Artificial Sequence
  derived and/or modified CDS sequence (wt) from CCHFV(K229_243, Artificial)__KX013466.1__Gn-4aa-Gc
uccgaagagccaggugaugacugcauaucaagaacucagcuauugaggacagaaacagcagagauccaugaugacaacuauggugguccaggugauaaaauaacuaucugcaacgguucaaccauuguagaucagagacugggcagugaacuaggguguuauaccaucaacagggugaagucauucaagcuaugcgaaaacagcgccacagggaaaaccugugagauagacagcacuccgguuaagugcaggcaagguuuuuguuuaaaaaucacccaagagggaaggggccacguaaaauuaucuagaggcucagagguugucuuggaugccugcgacucaagcugcgaaguaaugauaccuaaaggcacuggagauauccugguggacuguucagguggacagcaacauuucuuaaaagacaacuuaauugaccuagggugcccccauaucccgcuauuggguaaaauggccauuuacaucugcagaaugucaaaucauccuagaacaacuauggcuuuucucuucugguucagcuuuggcuaugugaucaccuguauauuuuguaaggcucuuuuuuauucauugauaauuauugggacacuagggaaaaagaucaagcaauauagggaauugaaaccucaaacuuguaccauaugugagacagcuccugucaaugcaauagaugcugaaaugcaugaccuuaacugcaguuacaauauaugcccuuauugugcaucaagauugaccuccgaugggcuggcuaggcaugugccacaaugccccaagcggaaggaaaaaguugaggagacugagcuguacuugaaccuggaaagaaucccuuggauugucagaaagcuauugcaagugucagaguccacugguguggcauugaaacgaagcagcuggcugauuguacugcuuguguuacucacaguuucauugucaccgguucaaucagcaccuguugguagaaaaccucuguucuuagacaguauaguuaaaggcaugaagaauuugcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguggaagaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcuggggaguaggaacuggcuguaccugcugcgggguggauguaaaagaccuuuuuacagaucacauguuugucaaauggaagguugaauauauaaaaacugaagccauaguauguguugagcucaccagccaggaaagacagugcagucugauugaggcagguacuagauucaacuugggcccugugacuaucacccugucugagccaagaaacauucagcagaagcuucccccugagauuaucacguugcaucccaaaguugaagagggcuucuuugacuugaugcaugugcaaaaaguguugucugcaaguacaguguguaaacugcagaguugcacacaugguauaccaggagaucuucaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacauugaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcauaccaagaaaguugagauaucaggcuugaaauuugcaagucuggcuugcacggguugcuaugcuuguagcucuggcaucuccuguaaagucaggauucauguagaugagccagaugagcucacaguacauguaaagagcagugauccagaugugguugcagcuagcacaagucucauggcgaggaagcuugaauuugggacagacaguacauucaaggccuuuucagcuaugcccaaaaccucuuuauguuuuuacauuguggagaaagaauacugcaagagcugcagugaagaggacacacaaaaauguguugacacaaaacuugagcagccacagagcauacuaauugagcacaaaggaacgauaauuggaaagcagaaugauacuugcacagccaaagcaagcuguuggcuagagucagucaagaguuuuuuuuauggauugaagaauaugcuugguagugucuuugguaacuuuuucauaggcauuuuguuauuccuuaccccuuuuguccuguuggugcuuuucuuuauguuuggauggaaaaucuuguuuugcuucaaauguugcaggaggaccagaggcuuacuuaaguauagacaccucaaagacgaugaggaaacaggcuacagaaggauuauugaaagacugaacaacaaaaaagggaaaaacagacugcuugauggugaaagguuggcugauaggaaaauugcugagcuguucuccacaaaaacacacauuggu

SEQ ID NO: 3893 - RNA, 2916 nt, Artificial Sequence
  derived and/or modified CDS sequence (wt) from CCHFV(K315_14, Artificial)__KX013469.1__Gn-4aa-Gc
uccgaagagccaggugacgacugcauaucaagaacucagcuauugaagacagaaacagcagaaauccaugacgacaacuauggugguccaggugacaaaauaacuaucugcaaugguucaaccguuguggaucagagacugggcagugaacuaggguguuauaccaucaacagggugaagucauucaagcuaugcaaaaacagugccacagggaaaaccugugagauagacagcacuccggucaagugcaggcaagguuuuuguuugaaaaucacccaagagggaaggggccacguaaaauuauccaggggcucagagguuguuuuggauguuugcgacucgagcugugaaauaaugauaccuaaaggcacuggagauauccuaguagacuguucagguggacagcaacauuucuuaaaagacaacuugauugaccuagggugcccucauaucccgcuauuggguaaaauggccauuuacauuugcagaaugucaaaucaucccaggacaaccauggcuuuccucuucugguucaguuuuggcuauguaaucaccuguauauuuugcaaggcucuuuuuuauucauugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaagggcuagcuaggcaugugacacaaugcccuaagcgaaaggagaaaguugaggagacugaacuguauuugaaccuggaaagaauuccuuggauagucagaaagcuauugcaagugucagaguccacugguguggcauugaaacgaagcaguuggcugauugugcugcuuguguuacucacagucucauugucaccgguccaaucagcaccuguugguaggaaaccucuuuucuuagacaguauaguuaaagguaugaaaaaauugcuaaacucaacaagcuuagaaacaagcuuaucaauugaggcaccauggggagcaauaaauguccagucaaccuuuaaaccaacaguaucuacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggacuugucacaaauguauuccccuguuuuugaguacuuaucaggagauagacagguugaagaauggcccaaggcaaccugcacaggugauugcccagaaagguguggcugcacaucaucaaccugcuugcauaaagaauggccucauucaagaaacuggagauguaaucccacuuggugcuggggaguaggaaccggcugcacaugcugcggaguggauguaaaagaccuuuuuacagaccacauguuuaucaaauggaagguugaauauauaaaaaccgaagccauaguauguguugagcucaccagccaagaaagacagugcagucugauugaggcagguacuagauucaacuuggguccugugacuaucacccugucugagccaagaaacauucagcagaagcuucccccugagaucauuacgcugcaucccaaaauugaagaaggcuucuuugacuugaugcaugugcaaaaaguguuaucugcaaguacaguguguaaacugcagaguugcacacaugguauaccaggagaucuacaaauuuaccacaucgguaacuuguugaaaggggauagaguaaacgggcaucugauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaagaaaguugagauaucaggcuugaaauuugcaagucugacuuguacggguugcuaugccuguagcucuggcaucuccuguaaagucagaauucauguagaugaaccagaugagcucacagugcauguaaagagcagugauccagaugugguugcagcuagcacaagccuuauggcaaggaagcuugaauuugggacagauagcacauucaaggcauuuucagccaugcccaaaaccucuuuaugcuuuuacauuguagagagggaauacugcaagagcugcagugaagaugauacaaaaaaauguguugacacaaaacuugagcagccacagagcauacuaauugagcacaaggggacaauaauuggaaagcagaaugauacuugcacagccaaggcaaguuguuggcuagagucagucaagaguuuuuuuuauggacugaagaauaugcuuggcaguguuuuugguaguuuuuucguaggcauuuuguuauuccuugccccuuuugucuuguuggugcuuuucuuuauguuuggauggaaaaucuuguuuugcuuuaaguguugcaggaggaccagaggcuuguuuaaguauagacaccucaaagaugacgaggaaacaggcuacagaaggauuauugaaagacugaacagcaaaaaagggaaaaacagacugcuugauggugagagguuggcugauaggaaaauugcugagcuguucucuacaaaaacacacauuggc

SEQ ID NO: 3894 - RNA, 2916 nt, Artificial Sequence
  derived and/or modified CDS sequence (wt) from CCHFV(K323_27, Artificial)__KX013472.1__Gn-4aa-Gc
uccgaagagccaggugacgacugcauaucaagaacucagcuauugaagacagaaacagcagagauccaugacgacaacuauggugguccaggugacaaaauaacuaucugcaaugguucaaccauuguagaucagagacugggcagugaacuaggguguuauaccaucaacagggugaagucauucaagcuaugcgaaaacagugccacagggaaaaccugugagauagacagcacuccggucaagugcaggcaagguuuuuguuugaaaaucacccaagagggaaggggccacguaaaauuauccaggggcucagagguuguuuuggaugcuugcgacucgagcugugaaauaaugauaccuaaaggcacuggagauauccuaguagacuguucagguggacagcaacauuucuuaaaagacaacuugauugaccuagggugcccucauaucccgcuauuggguaaaauggccauuuacauuugcagaaugucaaaucaucccaggacaaccauggcuuuccucuucugguucaguuuuggcuauguaaucaccuguauauuuugcaaagcucuuuuuuauuuauugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuagcuaggcaugugacacaaugcccuaagcgaaaggagaaaguugaggagacugaacuguauuugaaccuggaaagaauuccuuggauagucagaaagcuauugcaagugucagaguccacugguguggcauugaaacgaagcaguuggcugacugugcugcuuguguuacucacagucucauugucaccgguccaaucagcaccuguuggcaggaaaccucuuuucuuagacaguauagccaaagguaugaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggauuugucacaaauguauuccccuguuuuugaguacuuaucaggagauagacagguugaagaauggcccaaggcaaccugcacaggugauugcccagaaagguguggcugcacaucaucaaccugcuugcauaaagaauggccucauucaagaaacuggagauguaaucccacuuggugcuggggaguaggaaccggcugcacaugcugcggaguggauguaaaagaccuuuuuacagaccacauguuuaucaaauggaagguugaauacauaaaaaccgaagccauaguauguguugagcucaccggccaagaaagacagugcagucugauugaggcagguacuagauucaacuuggguccugugacuaucacccugucugagccaagaaacauucagcagaagcuucccccugagaucauuacgcugcaucccaaaauugaagaaggcuucuuugacuugaugcaugugcaaaaaguguuaucugcaaguacaguguguaaacugcagaguugcacacaugguauaccaggagaucuacaaauuuaccacauuggcaacuuguugaaaggggauagaguaaacgggcaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaagaaaguugagauaucaggcuugaaauuugcaagucugacuuguacggguugcuaugcuuguagcucuggcaucuccuguaaagucagaauucauguagaugaaccagaugagcucacagugcauguaaagagcagugauccagauguuguugcagcuagcacaagccuuauggcaaggaagcuugaauuugggacagauagcacauucaaggcauuuucagcuaugcccaaaaccucuuuaugcuuuuacauuguggagagggaauacugcaagagcugcagugaagaugauacaaaaaaauguguugacacaaaacuugagcagccacagagcauacuaauugagcacaaagggacgauaauuggaaagcagaaugauacuugcacagccaaggcaaguuguuggcuggagucagucaagaguuuuuuuuauggauugaagaauaugcuuggcaguguuuuugguaguuuuuucguaggcauuuuguuauuccuugccccuuuugucuuguuggugcuuuucuuuauguuuggauggaaaaucuuguuuugcuuuaaguguugcaggaggaccagaggcuuguuuaaguauagacaccucaaugaugacgaggaaacaggcuacagaaggaucauugaaagacugaacagcaaaaaaggaaaaaacagacugcuugauggugagagguuggcugauaggaaaauugcugagcuguucucuacaaaaacacacauuggc

SEQ ID NO: 3895 - RNA, 2916 nt, Artificial Sequence
  derived and/or modified CDS sequence (wt) from CCHFV(K340_6, Artificial)__KX013475.1__Gn-4aa-Gc
uccgaagagccaggugacgacugcauaucaagaacucagcuauugaagacagaaacagcagagauccaugacgacaacuauggugguccaggugacaaaauaacuaucugcaaugguucaaccauuguagaucagagacugggcagugaacuaggguguuauaccaucaacagggugaagucuuucaagcuaugcgaaaacaguaccacagggaaaaccugugagauagacagcacuccggucaagugcaggcaaggcuuuuguuugaaaaucacccaagagggaaggggccacguaaaauuauccaggggcucagagguuguuuuggaugcuugcgacucgagcugugaaauaaugauaccuaaaggcacuggagauauccuaguagacuguucagguggacagcaacauuucuuaaaagacaacuugauugaccuagggugcccucauaucccgccauuggguaaaauggccauuuacauuugcagaaugucaaaucaucccaggacaaccauggcuuuccucuucugguucaguuuuggcuauguaaucaccuguauauuuugcaaggcucuuuuuuauucauugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuggcuaggcaugugacacaaugcccuaagcgaaaggagaaaguugaggagacugaacuguauuugaaccuggaaagaauuccuuggauagucagaaagcuauugcaagugucagaguccacugguguggcauugaaacgaagcaguuggcugauugugcugcuuguguuacucacagucucauugucaccgguccaaucagcaccuguugguaggaaaccccuuuccuuagacaguauaguuaaagguaugaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggauuugucacaaauguauuccccuguuuuugaguacuuaucaggagauagacagguugaagaauggcccaaggcaaccugcacaggugauugcccagaaagguguggcugcacaucaucaaccugcuugcauaaagaauggccucauucaagaaacuggagauguaaucccacuuggugcuggggaguaggaaccggcugcacaugcugcggaguggauguaaaagaccuuuuuacagaccacauguuuaucaaauggaagguugaauauauaaaaaccgaagccauaguauguguugagcucaccagccaagaaagacagugcagucugauugaggcagguacuagauucaacuuggguccugugacuaucacccugucugagccaagaaacauucagcagaagcuucccccugagaucauuacgcugcaucccaaaauugaagaaggcuucuuugacuugaugcaugugcaaaaaguguuaucugcaaguacaguguguaaacugcagaguugcacacaugguauaccaggagaucuacaaauuuaccacauuggcaacuuguugaaaggggauagaguaaacggccaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccacucuaaaagagucacagcacauggagacacaccacaauuagacuuaaaagcaaggccgaccuacggugcaggugagaucacugugcugguugagguuacugacauggaguugcauaccaaaaaaguugagauaucaggcuugaaauuugcaagucugacuuguacggguugcuaugcuuguagcucuggcaucuccuguaaagucagaauucauguagaugaaccagaugagcucacagugcauguaaagagcagugauccagaugugguugcagcuagcacaagccuuauggcaaggaagcuugaauuugggacagauagcacauucaaggcauuuucagcuaugcccaaaaccucuuuaugcuuuuacauuguggagagggaauacugcaagagcugcagugaagaugauacaaaaaaauguguugacacaaaacuugagcagccacagagcauacuaauugagcacaaagggacgauaauuggaaagcagaaugauacuugcacagccaaggcaaguuguuggcuagagucagucaagaguuuuuuuuauggauugaagaauaugcuuggcaguguuuuugguaguuuuuucguaggcauuuuguuauuccuugccccuuucgucuuguuggugcuuuucuuuauguuuggauggaaaaucuuguuuugcuuuaaguguugcaggaggaccagaggcuuguuuaaguauagacacuucaaagaugacgaggaaacaggcuacagaaggauuauugaaagacugaacagcaaaaaaggaaaaaacagacugcuugauggugagagguuggcugauaggaaaauugcugagcuguucucuacaaaaacacacauuggc

SEQ ID NO: 3896 - RNA, 2916 nt, Artificial Sequence
  derived and/or modified CDS sequence (wt) from CCHFV(Mamon, Artificial)__KX013478.1__Gn-4aa-Gc
uccgaggagccaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauaccaucaacagggugaagucauucaagcuaugcgaaaacagcgccacagggaaaaccugugagauagacagcacuccgguuaagugcaggcaagguuuuuguuuaaaaaucacccaagagggaaggggccacguaaaauuaucuagaggcucagagguuguuucggaugcuugcgacucaagcugcgaaguaaugauaccuaaaggcacuggagauauccugguggacuguucagguggacagcaacauuucuuaaaagacaacuuaauugaccuagggugcccccauaucccgcuauuggguaaaauggccauuuacaucugcagaaugucaaaucauccuagaacaacuguggcuuuucucuucugguucagcuuuggcuaugugaucaccuguauauuuugcaaggcucuuuuuuauucauugauaauuauugggacacuagggaaaaagaucaagcaauauagggaauugaaaccucaaacuuguaccauaugugagacagcuccugucaaugcaauagacgcugaaaugcaugaccuuaacugcaguuacaauauaugcccuuauugugcaucaagauugaccuccgaugggcuagcuaggcaugugccacaaugccccaagcggaaggaaaaaguugaggagacugagcuguacuugaaccuggaaagaauuccuuggauugucagaaagcuauugcaagugucagaguccacugguguggcauuaaaacgaagcagcuggcugauuguacugcuuguguuacucacaguuucauugucaccgguucaaucagcaccuguugguagaaaaccucuguucuuagacaguauaguuaaaggcaugaagaauuugcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguagaagaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcuggggaguaggaacuggcugcaccugcugcgggguggauguaaaagaccuuuuuacagaucacauguuugucaaauggaagguugaauauauaaaaacugaagccauaguguguguugagcucaccagccaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcaugugcaaaaaguguugucugcaaguacaguguguaaacugcagaguugcacacaugguauaccaggagaucuacaaguuuaccacauuggcaacuugcugaaaggugauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacauugaaacugauuacacgaaaaccuuccacuuccacucuaaaagaguuacagcacauggugacacaccacaauuagacuuaaaagcaaggccgaccuacggugcaggugagaucacugugcucguugagguugcugacauggaguugcauaccaagaaaguugagauaucaggcuuaaaauuugcaagucuggcuugcacggguugcuaugcuuguagcucuggcaucuccuguaaagucaggauucauguagaugagccagaugagcucacaguacauguaaagagcagugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaaugauacuugcacagccaagacaagcuguuggcuagagucagucaagaguuuuuuuuauggauugaaaaauaugcuugguaguguauuugguaacuuuuucauaggcauuuuguuauuccuugccccuuuuguccuguuggugcuuuucuuuauguuuggauggaaaaucuuguuuugcuucaaauguugcaggaggaccagaggcuuacuuaaguauagacaccucaaagacgaugaggaaacaggcuacagaaggauuauugaaagacugaacaacaaaaaaggaaaaaacagacugcuugauggugaaagguuggcugauaggaaaauugcugagcuguucuccacaaaaacacacauuggu

SEQ ID NO: 3897 - RNA, 2916 nt, Artificial Sequence
  derived and/or modified CDS sequence (wt) from CCHFV(Min, Artificial)__KX013481.1__Gn-4aa-Gc
uccgaggagccaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauaccaucaacagggugaagucguucaagcuaugcgaaaacagcgccacagggaaaaccugugagauagacagcacuccgguuaagugcaggcaagguuuuuguuuaaaaaucacccaagagggaaggggccacguaaaauuaucuagaggcucagagguuguuuuggaugcuugcgacucaagcugcgaaguaaugauaccuaaaggcacuggagauauccugguggacuguucagguggacagcaacauuucuuaaaagacaacuuaauugaccuagggugcccccauaucccgcuauuggguaaaauggccauuuacaucugcagaaugucaaaucauccuagaacaacuauggcuuuucucuucugguucagcuuuggcuaugugaucaccuguauauuuugcaaggcucuuuuuuauucauugauaauuauugggacacuagggaaaaagaucaagcaauauagggaauugaaaccucaaacuuguacuauaugugagacagcuccugucaaugcaauagacgcugaaaugcaugaccuuaacugcaguuacaauauaugcccuuauugugcaucaagauugaccuccgaugggcuagcuaggcaugugccacaaugccccaagcggaaggaaaaaguugaggagacugagcuguacuugaaccuggaaagaauuccuuggauugucagaaagcuauugcaagugucagaguccacugguguggcauugaaacgaagcagcuggcugauuguacugcuuguguuacucacaguuucauugucaccgguucaaucagcaccuguugguagaaaaccucuguucuuagacaguauaguuaaaggcacgaagaauuugcuaaacucaacaagcuuagaaacaagcuuaucaauugaggcaccauggggagcaauaaauguccagucaaccuuuaaaccaacagugucgacugcaaacauagcacucaguuggagcucaguggagcacaggggcaacaagaucuuagucacaggcaggucugaaucaauuaugaaacuggaggaaaggacaggagucagcugggaucuaggcguagaagaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaauccuacuuggugcuggggaguaggaacuggcugcaccugcugcgggguggauguaaaagaccuuuuuacagaucacauguuugucaaauggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcaugugcaaaaaguguugucugcaaguacaguguguaaacugcagaguugcacacaugguauaccaggagaucuacaaguuuaccacauuggcaacuugcugaaaggggauaggauaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacauugaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcauaccaagaaaguugagauaucaggcuugaaauuugcaagucuggcuugcacggguugcuaugcuuguagcucuggcaucuccuguaaagucaggauucauguagaugagccagaugagcucacaguacauguaaagagcagugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaaugauacuugcacagccaaggcaagcuguuggcuagagucagucaagaguuuuuuuuauggauugaaaaauaugcuugguaguguauuugguaacuuuuucauaggcauuuuguuauuccuugccccuuuuguccuguuggugcuuuucuuuauguuuggauggaaaaucuuguuuugcuucaaauguugcaggaggaccagaggcuuacuuaaguauagacaccucaaagacgaugaggaaacaggcuacagaaggauuauugaaagacugaacaacaaaaaaggaaaaaacagacugcuugauggugaaagguuggcugauaggaaaauugcugagcuguucuccacaaaaacacacauuggu

SEQ ID NO: 3898 - RNA, 2916 nt, Artificial Sequence
  derived and/or modified CDS sequence (wt) from CCHFV(Nakiwogo, Artificial)__KX013484.1__Gn-4aa-Gc
gcagaaggagugagcaaugacugcguuucaaggacccagcuaaucaaaacagaaguugcagagauucacgaagauagcuacggugggccuggagaaaaaauaacaaucugcaacggcuccacaaucguggaccaaaggcuugguagcgaacuagguugcuacacaauuaaccgcgugaagacuuauaagcuuugugagaacagugccacagaaaaggguugugagaucgauaguguuccagucaaaugcaaacaaggguucugccucaaaguaacccaagagggcaggggccaugugaaacuaucuagaggaacggaaauuguccuggaugugugugacaccaguugugaguugaugauaccuaaaggcacuggagacauauugguggauugcucaggaggacagcagcacuucuugcaggacaacuugauugacuuagguugcccaaauguaccauuacuaggcaagauggcaauauauaucugcaggaugucgaaccauccuaagaccaccauggcuuuuuuguucugguucaguuuuggcuaugucaucacaugcguaguaugcaaagugcucuucuaucugcuaauugucauugggacacuaggaaagaaacuuaaacaguauagggaacuaaaaccucagacaugcauugucugugaaucaaucccugucaauguaauagaugcugaaaugcacgagcucaauugcaauuacaauauaugcccauacugugcguccagacugacuucagauggacuaguuagacaugugacucaaugucccaaaaggaaggaaaaggucgaggagacugagcuguacuugaaccuggagaggauaccuugguugguaagaagacuacugcaagugucagagucaacagggauggcucuaaagagaaguugcuggaugaccacacuccucauucugcuaguaguuucauugucuccaguucaaucugcuccaguugguagaaagccccuuuaccuggauagcauagccaaggggaugaaaagucuguuaaauucuacgaacuuagagacaagccugucgauugaggccccauggggagcaaucaauguucagucaacuuuuaaaccaacaguuucagcugccaacauagcacuuagcuggaguucaguugaacacaggggcaacaaaauccuaguuucgggcaggucagagucaauuaugaaacuggaagaacggaccggcaucagcuggagccuagguguagaggaugcuucugagucaaagacgcuuacuguuucugucauggaucugucucaaauguauucuccugucuuugaguaucugucaggugauagacaaguagaagaguggccaaaggccacuugcacaggcgacugcccagagagauguggcugcaccuccucaaccugcuugcauaaagaauggccgcacucgagaaacuggcgaugcaaccccacuugguguuggggaguagggacuggcugcaccugcugcggacuggauguuagagaccuuuucacggacuacaugauggucaaguggaaaguggaauauguaaaaacagaagcuauaauguguguugagcuaacuagucaggaaaggcaguguaguuuaauugaggcagguacaagguuuaaccugggcccugugacaauaacccugucagagccaagaaauguccagcaaaggcucccuuccgaaaucguuacacugcacccuaagauagaggaaggauucuuugauuugaugcaugugcaaaaaguacuauucugcaagcacaguuugcaagcuacaagcugcacacacggugucccaggcgauuugcaggucuaccauguuggcaaccuacugaaaggagacaagguuaaugggcacucaauucacaagauagagucucauuucaacacuucauggaugucaugggauggaugugaccuagacuacuuuugcaacaugggugacuggccuucauguacauauacuggagugacacagcacaaccgugcggcauucgucaacaugcucaauauugagacugauuacacaaagacuuuucacuuccauuccaagaggguuacggcacacggugacaccccucaacuggaucugaaggcaagaccaacauauggugcaggcgaggucacuguucuaguggagguugcagaucuggagcuacacacuaagaaaauagaagugucaggguugaaguuugcaagucugaccugcucugguuguuaugccugcaguuccggcaucuccugcaaaguuagaauucaugugaaugaaccagaugaguucacaguacacgugaaaagcaaugauccagacguuguggcagcaggaucaagucugauggcaaggaaaauagaguuaggggcugacagcaccuuuaaagccuuuucaucaaugccuaaaaacucuuugugcuuuuauauaguggaaagagacuacugcagcagcugcaccgaugaugacacucagaaguguguuaacacaaagcucgaacauccacaaagcauauuaauugagcauaagggaacaauaauugguaagcaaaaugacaccuguccgaccaaaacaagcugcuggcuagaaucagucaagaguuuuuuuuauggacugaaaaacaugcuggguggcaucuucgguaaugucuucuuaggcaucuuccuauuccuugcuccuuuugcacugcugauacucuucuucuucuucggguggaggcuucuguucugucugaaguguugcagaaggaccaggggucugcuaaaguauaaacaacuuaaggaugaagaagaagccggguacaagaaaaucaucgagaggcugaaugacaaaaagggcaaaagucgacuuuuugacggagagaggcucgcugacaggaagauugcugaacucuuuucaaccaaaacucauauaggg

SEQ ID NO: 3899 - RNA, 2916 nt, Artificial Sequence
  derived and/or modified CDS sequence (wt) from CCHFV(Saf, Artificial)__KX013487.1__Gn-4aa-Gc
uccgaggagccaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauaccaucaacagggugaagucauucaagcuaugcgaaaacagcgccacagggaaaaccugugagauagacagcacuccgguuaagugcaggcaagguuuuuguuuaaaaaucacccaagagggaaggggccacguaaaauuaucuagaggcucagagguuguuuuggaugcuugcgacucaagcugcgaaguaaugauaccuaaaggcacuggagauauccugguggacuguucagguggacagcaacauuacuuaaaagacaacuuaauugaccuagggugcccccauaucccgcuauuggguaaaauggccauuuacaucugcagaaugucaaaucauccuagaacaacuauggcuuuucucuucugguucagcuuuggcuaugugaucaccuguauauuuugcaaggcucuuuuuuauucauugauaauuauugggacacuagggaaaaagaucaagcaauauagggaauugaaaccucaaacuuguaccauaugugagacggcuccugucaaugcaauagacgcugaaaugcaugaccuuaacugcaguuacaauauaugcccuuauugugcaucaagauugaccuccgaugggcuagcuaggcaugugccacaaugccccaagcggaaggaaaaaguugaggagacugagcuguacuugaaccuggaaagaauuccuuggauugucagaaagcuauugcaagugucagaguccacugguguggcauugaaacgaagcagcuggcugauuguacugcuuguguuacucacaguuucauugucaccgguucaaucagcaccuguugguagaaaaccucuguucucagacaguauaguuaaaggcaugaagaauuugcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguagaagaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcuggggaguaggaacuggcugcaccugcugcgggguggauguaaaagaccuuuuuacagaucacauguuugucaaauggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcaugugcaaaaaguguugucugcaaguacaguguguaaacugcagaguugcacacaugguauaccaggagaucuacaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacauugagacugauuacaugaaaaccuuccacuuccacucuaaaagaguuacagcacauggugacacaccacaauuagacuuaaaagcaaggccgaccuacggugcaggugagaucacugugcugguugagguugcugacauggaguugcauaccaagaaaguugagauaucaggcuugaaauuuguaagucuggcuugcacggguugcuaugcuuguagcucuggcaucuccuguaaagucaggauucauguagaugagccagaugagcucacaguacauguaaagagcagugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaaugauacuugcacagccaaggcaagcuguuggcuagagucagucaagaguuuuuuuuauggauugaaaaauaugcuugguaguguauuugguaacuuuuucauaggcauuuuguuauuccuugccccuuuuguccuguuggugcuuuucuuuauguuuggauggaaaaucuuguuuugcuucaaauguugcaggaggaccagaggcuuacuuaaguauagacaccucaaagacgaugaggaaacaggcuacagaaggauuauugaaagacugaacaacaaaaaaggaaaaaacagacugcuugauggugaaagguuggcugauaggaaaauugcugagcuguucuccacaaaaacacacauuggu

SEQ ID NO: 3900 - RNA, 2916 nt, Artificial Sequence
  derived and/or modified CDS sequence (wt) from CCHFV(Ast199, Artificial)__KX056051.1__Gn-4aa-Gc
uccgaagagccaggugacgacugcauaucaagaacucagcuauugaagacagaaacagcagagauccaugacgacaacuauggugguccaggugacaaaauaacuaucugcaaugguucaaccauuguagaucagagacugggcagugaacuaggguguuacaccaucaacagggugaagucauucaagcuaugcgaaaacagugccacagggaaaaccugugagauagacagcacuccggucaagugcaggcaagguuuuuguuugaaaaucacccaagagggaaggggccacguaaaauuauccaggggcucagagguuguuuuggaugcuugcgacucgagcugcgaaauaaugauaccuaaaggcacuggagauauccuaguagacuguucagguggacagcaacauuucuuaaaagacaacuugauugaccuagggugcccucauaucccgcuauuggguaagauggccauuuacauuugcagaaugucaaaucaucccaggacaaccauggcuuuccucuucugguucaguuuuggcuauguaaucaccuguauauuuugcaaggcucuuuuuuauucauugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuagcuaggcaugugacacaaugcccuaagcgaaaggagaaaguugaggagacugaacuguauuugaaccuggaaagaauuccauggauagucagaaagcuguugcaagugucagaguccacugguguggcauugaaacgaugcagcuggcugauugugcugcuuguguuacucacagucucauugucaccgguucaaucagcaccuguugguaggaaaccucuuuucuuagacaguauaguuaaagguaugaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggauuugucacaaauguauuccccuguuuuugaguacuuaucaggagauagacagguugaagaauggcccaaggcaaccugcacaggugauugcccagaaagguguggcugcacaucaucaaccugcuugcauaaagaauggccucacucaagaaacuggagauguaaucccacuuggugcuggggaguaggaaccggcugcacaugcugcggaguggauguaaaagaccuuuuuacagaucacauguuuaucaaauggaagguugaauauauaaaaaccgaagccauaguauguguugagcucaccagccaagaaagacagugcagucugauugaggcagguacuagauucaacuuggguccugugacuaucacccugucugagccaaggaacauucagcagaagcuucccccugagaucauuacgcugcauccuaaaauugaagaaggcuucuuugacuugaugcaugugcaaaaaguguuaucugcaaguacaguguguaaacugcagaguugcacacaugguauaccaggagaucuacaaauuuaccacauuggcaacuuguugaaaggggauagauuaaacgggcaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaagaaaguugagguaucaggcuugaaauuugcaagucuggcuugcacggguugcuaugcuuguagcucuggcaucuccuguaaagucagaauucauguagaugaaccggaugagcucacagugcauguaaagagcagugauccagaugugguugcagcuagcacaagccuuauggcaaggaagcuugaauuugggacagauagcacauucaaggcauuuucagcuaugcccaaaaccucuuugugcuuuuacauuguggagagggaauacugcaagagcugcagugaagaugauacaaaaaaauguguugacacaaaacuugagcagccacagagcauacuaauugagcacaaagggacgauaauuggaaagcagaaugauacuugcacagccaaggcaaguuguuggcuagagucagucaagaguuuuuuuuauggauugaagaauaugcuuggcaguguuuuugguaauuuuuucguaggcauuuuguuauuccuugccccuuuugucuuguuggugcuuuucuuuauauuuggauggaaaaucuuguuuugcuuuaaguguugcaggaggaccagaggcuuguuuaaguauagacaccucaaagaugaugaggaaacaggcuacagaaagauuauugaaagacugaacagcaaaaaaggaaaaaacagacugcuugauggugagagguuggcugauaggaaaauugcugagcuguucucuacaaaaacacacauuggc

SEQ ID NO: 3901 - RNA, 2916 nt, Artificial Sequence
  derived and/or modified CDS sequence (wt) from CCHFV(Ast149, Artificial)__KX056054.1__Gn-4aa-Gc
uccgaagagccaggugacgacugcauaucaagaacucagcuauugaagacagaaacagcagagauccaugacgacaacuauggugguccaggugacaaaauaacuaucugcaaugguucaaccauuguagaucagagacugggcagugaacuaggguguuauaccaucaacagggugaagucauucaagcuaugcgaaaacagugccacagggaaaaccugugagauagacagcacuccggucaagugcaggcaagguuuuuguuugaaaaucacccaagagggaaggggccacguaaaauuauccaggggcucagagguuguuuuggaugcuugcgacucgagcugugaaauaaugauaccuaaaggcacuggagauauccuaguagacuguucagguggacagcaacauuucuuaaaagacaacuugauugaccuagggugcccucauaucccgcuauuggguaagauggccauuuacauuugcagaaugucaaaucaucccaggacaaccauggcuuuccucuucugguucaguuuuggcuauguaaucaccuguauauuuugcaaggcucuuuuuuauucguugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuagcuaggcaugugacacaaugcccuaagcgaaaggagaaaguugaggagacugaacuguauuugaaccuggaaagaauuccauggauagucagaaagcuguugcaagugucagaguccacugguguggcauugaaacgaagcagcuggcugauugugcuacuuguguuacucacagucucauugucaccgguucaaucagcaccuguugguaggaaaccucuuuucuuagacaguauaguuaaagguaugaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggauuugucacaaauguauuccccuguuuuugaguacuuaucaggagauagacagguugaagaauggcccaaggcaaccugcacaggugauugcccagaaagguguggcugcacaucaucaaccugcuugcauaaagaauggccucacucaagaaacuggagauguaaucccacuuggugcuggggaguaggaaccggcugcacaugcugcggaguggauguaaaagaccuuuuuacagaucacauguuuaucaaauggaagguugaauauauaaaaaccgaagccauaguauguguugagcucaccagccaagaaagacagugcagucugauugaggcagguacuagauucaacuuggguccugugacuaucacccugucugagccaaggaacauucagcagaagcuucccccugagaucauuacgcugcauccuaaaauugaagaaggcuucuuugacuugaugcaugugcaaaaaguguuaucugcaaguacaguguguaaacugcagaguugcacacaugguauaccaggagaucuacaaauuuaccacauuggcaacuuguugaaaggggauagauuaaacgggcaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaagaaaguugagguaucaggcuugaaauuugcaagucuggcuugcacggguugcuaugcuuguagcucuggcaucuccuguaaagucagaauucauguagaugaaccggaugagcucacagugcauguaaagagcagugauccagaugugguugcagcuagcacaagccuuauggcaaggaagcuugaauuugggacagauagcacauucaaggcauuuucagcuaugcccaaaaccucuuugugcuuuuacauuguggagagggaauacugcaagagcugcagugaagaugauacaaaaaaauguguugacacaaaacuugagcagccacagagcauacuaauugagcacaaagggacgauaauuggaaagcagaaugauacuugcacagccaaggcaaguuguuggcuagagucagucaagaguuuuuuuuauggauugaagaauaugcuuggcaguguuuuugguaauuuuuucguaggcauuuuguuauuccuugccccuuuugucuuguuggcgcuuuucuuuauauuuggauggaaaaucuuguuuugcuuuaaguguugcaggaggaccagaggcuuguuuaaguauagacaccucaaagaugaugaggaaacaggcuacagaaagauuauugaaagacugaacagcaaaaaaggaaaaaacagacugcuugauggugagagguuggcugauaggaaaauugcugagcuguucucuacaaaaacacacauuggc

SEQ ID NO: 3902 - RNA, 2916 nt, Artificial Sequence
  derived and/or modified CDS sequence (wt) from CCHFV(Ast137, Artificial)__KX056057.1__Gn-4aa-Gc
uccgaagagccaggugacgacugcauaucaagaacucagcuauugaagacagaaacagcagagauccaugacgacaacuauggugguccaggugacaaaauaacuaucugcaaugguucaaccauuguggaucagagacugggcagugaacuaggguguuauaccaucaacagggugaagucauucaagcuaugcgaaaacagugccacagggaaaaccugugagauagacagcacuccggucaagugcaggcaaggguuuuguuugaaaaucacccaagagggaaggggccacguaaaauuauccaggggcucagagguuguuuuggaugcuugcgacucgagcugugaaauaaugauaccuaaaggcacuggagauauccuaguagacuguucagguggacagcaacauuucuuaaaagacaacuugauugaccuagggugcccucauaucccgcuauuggguaagauggccauucacauuugcagaaugucaaaucaucccaggacaaccauggcuuuccucuucugguucaguuuuggcuauguaaucaccuguauauuuugcaaggcucuuuuuuauucauugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuagcuaggcaugugacacaaugcccuaagcgaaaggagaaaguugaggagacugaacuguauuugaaccuggaaagaauuccauggauagucagaaagcuguugcaagugucagaguccacugguguggcauugaaacgaagcagcuggcugauugugcugcuuguguuacucacagucucauugucaccgguucaaucagcaccuguugguaggaaaccucuuuucuuagacaguauaguuaaagguacgaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggauuugucacaaauguauuccccuguuuuugaguacuuaucaggagauagacagguugaagaauggcccaaggcaaccugcacaggugauugcccagaaagguguggcugcacaucaucaaccugcuugcauaaagaauggccucacucaagaaacuggagauguaaucccacuuggugcuggggaguaggaaccggcugcacaugcugcggaguggauguaaaagaccuuuuuacagaucacauguuuaucaaauggaagguugaauauauaaaaaccgaagccauaguauguguugagcucaccagccaagaaagacagugcagucugauugaggcagguacuagauucaacuuggguccugugacuaucacccugucugagccaaggaacauucagcagaagcuucccccugagaucauuacgcugcauccuaaaauugaagaaggcuucuuugacuuaaugcaugugcaaaaaguguuaucugcaaguacaguguguaaacugcagaguugcacacaugguauaccgggagaucuacaaauuuaccacauuggcaacuuguugaaaggggauagauuaaacgggcaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccacucuaaaagggucacagcacauggagacacaccacaauuagacuuaaaagcaaggccgaccuacggugcaggugagaucacugugcugguugagguugcugacauggaguugcauaccaagaaaguugagguaucaggcuugaaauuugcaagucuggcuugcacggguugcuaugcuuguagcucuggcaucuccuguaaagucagaauucauguagaugaaccggaugagcucacagugcauguaaagagcagugauccagaugugguugcagcuagcacaagccuuauggcaaggaagcuugaauuugggacagauagcacauucaaggcauuuucagcuaugcccaaaaccucuuugugcuuuuacauuguggagagggaauacugcaagagcugcagugaagaugauacaaaaaaauguguugacacaaaacuugagcagccacagagcauacuaauugagcacaaagggacgauaauuggaaagcagaaugauacuugcacagccaaggcaaguuguuggcuagagucagucaagaguuuuuuuuauggauugaagaauaugcuuggcaguguuuuugguaauuuuuucguaggcauuuuguuauuccuugccccuuuugucuuguuggugcuuuucuuuauauuuggauggaaaaucuuguuuugcuuuaaguguugcaggaggaccagaggcuuguuuaaguauagacaccucaaagaugaugaggaaacaggcuacagaaagauuauugaaagacugaacagcaaaaaaggaaaaaacagacugcuugauggugagagguuggcugauaggaaaauugcugagcuguucucuacaaaaacacacauuggc

SEQ ID NO: 3903 - RNA, 2916 nt, Artificial Sequence
  derived and/or modified CDS sequence (wt) from CCHFV(Ast133, Artificial)__KX056060.1__Gn-4aa-Gc
uccgaagagccagaugacgacugcauaucaagaacucagcuauugaagacagaaacagcagagauccaugacgacaacuauggugguccaggugacaaaauaacuaucugcaaugguucaaccauuguagaucagagacugggcagugaacuaggguguuauaccaucaacagggugaagucauucaagcuaugcgaaaacagugccacagggaaaacuugugagauagacagcacuccggucaagugcagacaagguuuuuguuugaaaaucacccaagagggaaggggccacguaaaauuauccaggggcucagagguuguuuuggaugcuugcgacucgagcugugaaauaaugauaccuaaaggcacuggagauauccuaguagacuguucagguggacagcaacauuucuuaaaagacaacuugauugaccuagggugcccucauaucccgcuauuggguaaaauggccauuuacauuugcagaaugucaaaucaucccaggacaaccauggcuuuccucuucugguucaguuuuggcuauguaaucaccuguauauuuugcaaggcucuuuuuuauuuauugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuagcuaggcaugugacacaaugcccuaagcgaaaggagaaaguugaggagacugaacuguauuugaaccuggaaagaauuccuuggauagucagaaagcuauugcaagugucagaguccacugguguggcauugaaacgaagcaguuggcugauugugcugcuuguguuacucacagucucauugucaccgguccaaucagcaccuguugguaggaaaccucuuuucucagacaguauaguuaaagguaugaaaaauuugcuaaacucaacaagcuuagaaacaagcuuaucaauugaggcaccauggggagcaauaaauguccaaucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggauuugucacaaauguauuccccuguuuuugaguacuuaucaggagauagacagguugaagaauggcccaaggcaaccugcacaggugauugcccagaaagguguggcugcacaucaucaaccugcuugcauaaagaauggccucauucaagaaacuggagauguaaucccacuuggugcuggggaguaggaaccggcugcacaugcugcggaguggauguaaaagaccuuuuuacagaccacauguuuaucaaauggaagguugaauauauaaaaaccgaagccauaguauguguugagcucaccagccaagaaagacagugcagucugauugaggcagguacuagauucaacuuggguccugugacuauuacccugucugagccaagaaacauucagcagaagcuucccccugagaucauuacgcugcaucccaaaauugaagaaggcuucuuugacuugaugcaugugcaaaaaguguuauccgcaaguacaguguguaaacugcagaguugcacacaugguauaccaggagaucuacaaauuuaccacauuggcaacuuguugaaaggggauagaguaaacgggcaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaagaaaguugagauaucaggcuugaaauuugcaagucugacuuguacggguugcuaugcuuguagcucuggcaucuccuguaaagucagaauucauguagaugaaccagaugagcucacagugcauguaaagagcagugauccagaugugguugcagcuagcacaagccuuauggcaagaaagcuugaauuugggacagauagcacauucaaggcauuuucagcuaugcccaaaaccucuuuaugcuuuuacauuguggagagggaauacugcaagagcugcagugaagaugauacaaaaaaauguguugacacaaaacuugagcagccacagagcauacuaauugagcacaaagggacgauaauuggaaagcagaaugauacuugcacagccaaggcaaguuguuggcuagagucagucaagaguuuuuuuuauggauugaagaauaugcuuggcaguguuuuugguaguuuuuuuguaggcauuuuguuauuccuugccccuuuugucuuguuggugcuuuucuuuauguuuggauggaaaaucuuguuuugcuuuaaguguugcaggaggaccagaggcuuguuuaaguauagacaccucaaagaugacgaggaaacaggcuacagaaggauuauugaaagacugaacagcaaaaaaggaaaaaacagacugcuugauggugagagguuggcugauaggaaaauugcugagcuguucucuucaaaaacacacauuggc

SEQ ID NO: 3904 - RNA, 2916 nt, Artificial Sequence
  derived and/or modified CDS sequence (wt) from CCHFV(SK/2015/human, Artificial)__KX458183.1__Gn-4aa-Gc
ucugaagaaucuggugaugacugcauaucaagaacucgccuauugagaacagagacugcagagauccauggugauagcuauggugguccaggugacaagauuacuauuugcaaugguucaacuauuguagaucaaagacuggguagugagaugggguguuacacuaucaauagagugaagucauucaagcugugcgaaaacagugcaacagggaagagcugugaaauagacaguaucccaguuaggugcaggcaggguuauugccuaaaaaucacucaggagggaaggggccaugugaaauuauccaggggcucagagguugucuuggaugcaugcgacucaagcugugaaguaaugauaccuaagggcacaggugacauccuuguagacuguucaggugggcagcaacauuuuuugaaggacaacuuaauugaucuaggaugucccaauauuccauuauuagguaaaauggcuauuuauauuugcagaaugucgaaucacccuaagacaaccauggcuuuucucuuuugguucaguuuuggcuaugugauaaccuguauacucugcaaggcuauuuucuacuuauuaauaauuguuggaacacuagggaagagguuuaagcaguacagagaguuaaaaccccagaccugcaccauaugugagacaacuccugcaaaugcaauagaugcugaaaugcaugaccuuaacugcaguuacaccauaugccccuauugugcaucuagacuaaccucagaugggcuugcuaggcaugugacacaaugcccuaagcggaaggagaaaguagaagaaacugaauuguaccugaacuuagagagaauucccuggguuguaagaaagcuguugcagguaucggaguccacugguguugcauuaaaaagaaguagcuggcugauugugcugcuuguguuguucacaguuucauuaucaccaguucaaucagcacccaucgguagaaggcccuuguuccuggauaguauaguaagaggcaugaaaaaucugcuaaacucaacaaguuuggagacaagcuuaucgauugaggcaccauggggagcaauaaauguucagucaaccuacaagccaacugugucaacugcaaacauagcacuuaguuggaguucaguugaacacagagguaauaagauuuugguuucaggcagaucagaaucaauuaugaagcuagaagaaaggacaggagucagcugggaccuuggcguagaagaugccucugaaucuaagcuacuuacagucucugucauggacuuaucucagauguacucuccugucuucgaguacuuaucaggugacagacaaguagaagaguggcccaaggcaaccuguacaggugacugcccagaaagauguggcugcacaacgucaaccugcuugcauaaagaauggccucauucaagaaacuggagauguaaucccacuuggugcuggggaguggggacuggcugcacuuguuguggauuagaugugaaagaccuuuuuacugauuauauguucgucaaguggaaaguugaauacauuaaaacagaggccauaguguguguggaacucaccagucaaggaaggcaaugcagcuugauugaggcgggcacaagguucaauuuagguucugugaccaucacauugucggaaccgaggaacauucaacauaagcucccuccugaaauaaucacauugcauccuaggauugaagaagguuucuuugaccugaugcauguacaaaaaguguugucagcuagcacaguguguaaguugcagaguugcacacacggugugccaggugaucuacaggucuaucauaucggaaauuuauuaaaaggggauaaagugaauggacaccuaauucauaaaauugagccacacuucaacacuuccuggauguccugggauggcugugacuuagacuacuacugcaacaugggagacuggccuucuuguacauauaccggaguuacccaacacaaucaugcuucauuuguaaaccuacucaacauugaaacugacuauacaaaaaacuuccacuuucacucuaaaaggguuacugcgcauggagacacaccacaauuagaucugaaagcaagaccaacuuacggcgcaggagaaaucacuguacugguagaaguugcugacauggaguuacacacgaagaaaauugaaauaucaggccuaaaauuugcaagccugacuugcacaggcuguuaugcuuguaguucuggcauuuccugcaaaguuaggauucauguggaugaaccagaugaacuuacaguacacguuaagagugaugauccagauguaguggcagcuagcucaagucucauggcaaggaagcuugaguuuggaacagacaguacguuuaaagcuuucucagccaugcccaaaaccuccuuauguuucuacauuguagaaagggaguacuguaagagcugcaguaaagaagacacacaaaaauguguuaacacaaaacuugagcaaccacagagcaucuugaucgaacauaggggaacuauaaucggaaagcagaacaauaccugcauagccaaagcaaguugcugguuagagucaguuaaaaguuucuuuuauggucuaaagaacaugcuuaguggcauuuuuggcaaucucuuucugggcaucuucuuauuucuugcccccuuuaucuuguuaauacuuuuuuucauguuuggauggaggauccuguuuugcuuuaaguguugcagaagaaccaggggccuguucaaguauagacaucucaaagacgaugaagaaacugguuacagaaggaucauugaaagacugaacaacaagaaagggaagaacaagcugcuugauggugaaagacuugccgauagaagaauugccgaacuauucuccacaaagacacacauuggc

SEQ ID NO: 3905 - RNA, 2916 nt, Artificial Sequence
  derived and/or modified CDS sequence (wt) from CCHFV(YL16070, Artificial)__KY354081.1__Gn-4aa-Gc
gcagaaggaggaagcagugacugcauuucaagaacucagcuaguuaaaacagagguugcagaaauucaugaggacaguuacggugggccuggugagaaaauaacaaucugcaaugguuccacaauuguagaucaaaggcuugguagugaauugggcugcuauacaaucaacagaguaaaauccuacaagcuaugcgagaacagugccucagggaaaagcugugaaauagauagcaucccagucaaaugcaaacaaggguuuugccucaaaauaacccaagaaggaagaggucauguaaaacuguccagagggacagaaauuguucuagaugucugugauuccagcugugagcugaugauaccuaagggcacuggagacauuuuaguggauugcucaggagggcaacagcauuuuuuacaaaacaaucugauugacuugggaugccccaaugucccauuacuggguaaaauggccauauaugucugcaggaugucaaaccacccaaaaacuaccauggcauuucuguucugguucagcuuuggcuaugucauuacauguauaguaugcaggguacucuucuacuugcugauugccaucggaacaguagggaaaaagcuaaaacaguauagagagcugaaaccacaaacaugcauuguuugugaaucugucccuguuaaugcaauagaugcugaaaugcaugagcuuaauugcaguuacaacauaugcccauacugugcuucuagacugucuacagacgggcucaucaggcacguaacucagugucccaaacggagggagaagguggaagagacugagcuauucuugaacuuggaaagaauaccuuggcuggugagaaagcuccuucaaguaucagagucaacaggaauggcucuaaagagaagcuguuggaugaucacacuccucauucuacuauugguuucgaugucaccaguccaaucugcaccgguaggcaggaagccacucuuccuggauagcauagccaagggaaugaaaagccuguugaacuccacgagcuuagaaacuagucugucaauugaagcuccguggggagcaaucaauguucagucaacuuucaaaccaacaguuucagcugcuaacauagcacuuagcuggaguucaguugaacacaggggcaacaaaauuuugguuucagguagaucagagucaaucaugaaauuagaagaaagaacaggagucagcuggaaccuggguguagaagaugcuucugagucaaagacgcuuacuguuuccgucauggaccugucacaaauguacucuccuguuuuugaguacuugucaggugacagacaaguggaggaauggccaaaggcaacuugcacaggugacuguccagagagaugcggcugcacuucaucaaccugcuuacauaaagaguggccacauucaagaaacuggagauguaauccuacuugguguugggggguggggacuggcugcacuugcugugggcuggaugugaaggauuuuuuuacugacuacauguugguaaaauggaaaguggaauauauaaagacagaagcuauagugugugucgagcuaacuagucaagagaggcaguguaguuuaauugaagcaggcacaagauuuaaccuaggcccuguaacaauaacccuaucagagccaagaaauguccagcagaggcuuccucccgaaauuguaacacugcauccuaaaauagaggaagguuuuuuugauuugaugcauguacaaaaaauacugucugcaagcacaguuugcaagcuacagagcugcacacacggugugccgggcgauuuucaggucuaccaugucgguaaccugcugaggggagacaagguuaauggacacucaauucacaagauagaaccacauuuuaauacuucauggaugucaugggaugguugcgaucuggacuauuucugcaauaugggggacuggccuucaugcacauacacuggaguaacacagcauaaccgugcugcauuuaucaacaugcucaacauugagacugacuauacaaaaacuuuccacuuucauucgaagagggucacggcacauggagauacuccccagcuagaccuaaaagcgagaccggcauauggugcuggcgaagucacuguucuaguggagguugcagacuuggaguugcacacaaagaaacuugaagugucagguuugaaaauugcaaguuugaccugcucuggguguuaugcaugcagcucuggcaucuccugcaaaguuagaauccauguaaaugaaccagacgaauucacagugcauguaagaaguagcgacccagauguuguagcagcaggaucaagucuuauggcaaggaaaauagaguuuggggcugacaguacauucaaggccuuuucaucaaugcccaaggacuccuuaugcuuuuacauaguagaaaaggauuacugcagcagcugcaccgacgaugacacacaaaagugugucaacacgaagcuugaccauccacagagcauacucauugagcacaaaggaacaauaauuggcaagcaaaaugacacuuguucgaccaaaacaagcugcuggcuaaaaucauuuaaggguuucuucuaugggcucaaaaacaugcugaguggcaucuuuggaaauguuuuuuuaggcauccucuuauuccuugcuccuuuuguacuacugauauuuuuuuucuuuuuuggguggaggcuucuguuuugucucaaauguugcaaaaaaacuaaaggacuguugaaauauaagcaccuuaaggacaaggaggaggcuggauacaaaaaaaucauugaaaggcuaaauggcaaaaaagguaaaagucaauuguuugauggugaaaggcuugcaaacaggaaaauugcugagcuuuuuucuacuaaaauucacauaggu

SEQ ID NO: 3906 - RNA, 2916 nt, Artificial Sequence
  derived and/or modified CDS sequence (wt) from CCHFV(Oman_812956, Artificial)__KY362518.1__Gn-4aa-Gc
uccgaagagucuggugaagacuguauaucaaggacucagcuguugaggacagaaacugcagaaauccauggugauaacuauggugguccaggugacaaaauaaccaucugcaaugguucaaccauuguagaucaaaggcuggguagugaacugggguguuacacuaucaauagggugaagucauuuaagcuaugcgaaaacagugccacagguaaguccugugaaauagauaacacuccaguaaaaugcaagcaagguuuuugcuugaaaauaacccaagaaggaaggggccacgugaagcuuucaagagacucagaaguuguccuggacgccugcgauucaagcugugaaauaaugauaccaaagggcacuggagacauccugguugacugcucaggugggcagcagcacuucuuaaaagacaaccugauugaucugggaugccccaacaucccauuauuaggcaaaauggcaaucuacauuuguagaaugucaaaucauccuaaaacaacuauggcuuuucuuuuuugguuuagcuuugguuaugugauaaccugcauacuuuguaaagucauuuuuuaucuauugauaguuguuggaacuuuagggaaaaaguuuaaacaguauagagaguuaaaaccucagaccugcacaauaugugaaacaacuccugucaaugcaauagaugcugagaugcacgaucucaauuguaguuacaauauauguccuuauugugcaucuagguuaacuucagauggucuugccagacauguaaugcaguguccuaagcggaaggaaaaaauagaagaaaccgaauuauaccugaacuuagaaagaaucccuuggguugucagaaaacuacugcagguaucagaauccacugguguagcacuaaagaggagcaguuggcugauugugcuacuugugcuucucacaguuucauugucaccaguacaaucagcaccuaucgguagaaagcccuuauuuuuugacaguauugcuaaggguaugaagaaccugcugaauucaacaagcuuagaaacaagcuuaucaauugaggcaccauggggagcaauaaacguccaaucuacuuucaaaccuacugugucaacugcaaacauagcacuuaguuggagcucaguggaacacagagguaauaagaucuugguuucaggcagaucagagucaaucaugaagcuagaagaaagaacaggaaucagcugggauuugggaguagaagaugccucugaguccaaauuacuuacuguuuccgucauggacuuaucacagauguacucuccugucuuugaguaccuaucaggugacagacaaguagaggaauggccaaaggcaaccuguacaggcgauugcccggaaagauguggcugcacaucaucaaccugccuacacaaggaauggccucacucaagaaacuggagaugcaaccccacuugguguuggggagucggcaccggaugcaccuguuguggacuagauguaaaggaccuuuuuacagauuacauguuuguuaaauggaaggucgaauauauaaaaacagaggcuauaguguguguugagcuuacuagccaagaaagacaauguagcuugauugaggcaggcacaagauucaacuuagguccugugacuaucacauuaucagagccaagaaacauucagcaaaagcucccuccagaaauugucacauuacauccuagaauugaagaagguuuuuuugacuuaaugcauguacagaagguacuaucagcaagcacagugugcaagcuacagaguugcacacauggcguaccaggagacuuacaggucuaccacaucggaaacuuacuaaaaggagacaaagugaaugggcaucugauacauaaaguugaaccacauuucaacaccuccuggaugucuugggacggcugugaccuagauuacuacugcaauaugggggauuggcccucuugcacguauacuggaguuacccaacauaaucaugcugcauuuguaaaccuacuuaacauugaaacugauuacacaaagaacuuccacuuucacucuaagagagucacugcacauggggacacuccacaauuagauuuaaaagccagaccaaauuauggugcaggugaaaucacugugcugguggaaguugcugacauggaguuacacacaaagaaaauugagauaucagguuugaaguuugcaagccuaaccugcacagguuguuaugcuuguagcucuggcaucucauguaagguuaggauccauguagaugaaccagaugagcuuacaguacaugugaagagugaagacccagacauaguugcugcuagcucaagucucauggcaagaaagcuugaauucgggacggauaguacauucaaagccuucucagccaugccuaaaaccuccuugugcuuuuacauuguugagagagaauacuguaaaagcugcaguaaagaagacacacaaaaguguguuaacgcaaagcuugagcgaccacagagcauuuuaauugagcacaaaggaacgauaauuggaaagcagaacgacacuugcacagcuaaagcaagcugcuggcuagagucagucaagaguuucuuuuauggacuaaagaacaugcuuaguggcauuuuuggcaauguuuucauagggauuuucuuauuccuugcuccuuuuauccuguuaauacuuuucuuuauguuuggguggagaauccuauucugcuuuaagugcugcaggagaacuagaggccuauuuaaguacagacaccucaaagaugaugaagaaaccgguuauaggaaaaucauugagagacuaaacaacaaaaaagguaaaaacaagcugcuugacggugaaagauuagcugauagaaagaucgcugagcuguucucuacaaaaacacacauuggc

SEQ ID NO: 3907 - RNA, 2916 nt, Artificial Sequence
  derived and/or modified CDS sequence (wt) from CCHFV(UCCR4405, Artificial)__KY484029.1__Gn-4aa-Gc
ucugaagagccaggugacgacugcauaucaagaacucagcuauugaagacagaaacagcagagauccaugacgacaacuauggugguccaggugacaaaauaacuaucugcaaugguucaaccauuguggaucagagacugggcagugaacuaggguguuauaccaucaacagggugaagucauucaagcuaugcgaaaacagugccacagggaaaaccugugagauagacagcacuccggucaagugcaggcaagguuuuuguuugaaaaucacccaagagggaaggggccacguaaaauuauccaggggcucagagguuguuuuggaugcuugcgacucgagcugugaaguaaugauaccuaaaggcacuggagauauccuaguagacuguucagguggacagcagcauuucuuaaaagacaacuugauugaccuagggugcccucauaucccgcuauuggguaagauggccauuuacauuugcagaaugucaaaucaucccaggacaaccauggcuuuccucuucugguucaguuuuggcuauguaaucaccuguauauuuugcaaggcucuuuuuuacucauugauaauuauugggacacuagggaaaaaaaucaagcaauauagggagcugaaaccucaaacuugcaccauaugugagacagcuccugucaaugcaauagaugcugaaaugcaugaccucaaauguaguuacaauauaugcccuuauugugcaucaagauugaccucugaugggcuagcuaggcaugugacacaaugcccuaagcgaaaggagaaaguugaggagacugaacuguacuugaaccuggaaagaauuccuuggauagucagaaagcuauugcaagugucagaguccacugguguagcauugaaacgaagcaguuggcugauugugcugcuuguguuacucacagucucauugucaccgguucaaucagcaccuguugguaggaaaccucuuuucuuagacaguacaguuaaagguaugaaaaauuugcuaaacucaacaagcuuggaaacaagcuuaucaauugaggcaccauggggagcaauaaauguccagucaaccuuuaaaccaacaguaucgacugcaaacauagcacucaguuggagcucaguggagcacagaggcaacaagaucuuggucacaggcaggucugaaucaauuaugaaacuagaggaaaggacaggagucagcugggaucuaggcguagaagaugccucugaauccaaauuacuuaccgucuccaucauggauuugucacaaauguauuccccuguuuuugaguacuuaucaggagauagacagguugaagaauggcccaaggcaaccuguacaggugauugcccagaaagguguggcugcacaucaucaaccugcuugcauaaagaauggccucacucaagaaacuggagauguaaccccacuuggugcuggggaguaggaaccggcugcacaugcugcggaguggauguaaaagaccuuuuuacagaucacauguuugucaaauggaagguugaauauauaaaaaccgaagccauaguauguguugagcucaccagccaagaaagacagugcagucugauugaggcagguacuagauucaacuuggguccugugacuaucacccugucugagccaagaaacauucagcagaagcuucccccugagaucauuacgcugcaucccaaaauugaagaaggcuucuuugacuugaugcauguacaaaaaguguuaucugcaaguacaguguguaaacugcagaguugcacacaugguauaccaggagaucuacaaauuuaccacauuggcaacuuguugaaaggggauagaguaaacgggcaucuaauucacaaaauugaaccacauuuuaacaccucuuggauguccugggaugguugugaccuagacuacuauugcaacauggggaauuggccuucuugcacauacacaggagugacccaacauaaucaugcugcauuuguaaauuugcuuaacauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaagaaaguugagauaucaggcuugaaauuugcaagucugguuugcacggguugcuaugcuuguagcucuggcauuuccuguaaagucagaauucauguagaugaaccagaugagcucacagugcauguaaagagcagugauccagaugugguugcagcuagcacaagccuuauggcaaggaagcuugaauuugggacagauagcauauucaaggcauuuucagcuaugcccaaaaccucuuuaugcuuuuacauuguggagagggaauacugcaagagcugcagugaagaugauacaaaaaaauguguugacacaaaacuugagcagccacagagcauacuaauugagcacaaagggacgauaauuggaaagcagaaugauacuugcacagccaaggcaaguuguuggcuagagucagucaagaguuuuuuuuauggauugaagaauaugcuuggcaguguuuuugguaauuuuuucguaggcauuuuguuauuccuugccccuuuugucuuguuggugcuuuucuuuauguuuggauggaaaaucuuguuuugcuuuaaguguugcaggaggaccagaggcuuguuuaaguauagacaccucaaagacgaugaggaaacaggcuacagaaggauuauugaaagacugaauaguaaaaaaggaaaaaacagacugcuugauggugagagguuggcugauaggaaaauugcugagcuguucuccacaaaaacacacauuggc

SEQ ID NO: 3908 - RNA, 2916 nt, Artificial Sequence
  derived and/or modified CDS sequence (wt) from CCHFV(UCCR4401, Artificial)__KY484035.1__Gn-4aa-Gc
ucagaagaacccagugaugacuguauaucaagaacucaacuauuaaggacagagacugcagagauccacggcgacaacuaugguggcccgggugacaaaauaaccaucugcaauggcucaacuauuguagaccaaagacugggcagugaacuaggaugcuacaccaucaauagagugaggucauucaagcuaugcgaaaacagugccacagggaagaauugugaaauagacagugucccaguuaaaugcaggcaggguuauugccuaagaaucacucaggaagggaggggccacguaaaauuaucuaggggcucagagguugucuuagaugcaugcgauacaagcugugaaauaaugauaccuaagggcacuggugacauccuaguugacuguucaggugggcagcaacauuuucuaaaggacaauuugauagaucuaggaugccccaaaauuccauuauugggcaaaauggcuauuuacauuugcagaaugucaaaccaccccaaaacaaccauggcuuuccucuucugguucagcuuuggcuauguaauaaccugcauacuuugcaaggccauuuuuuacuuguuaauaauuguuggaacacuagggaaaaggcucaagcaguauagagaguugaaaccucagacuugcaccauaugugagacaacuccuguaaaugcaauagaugcugagaugcaugaccucaauugcaguuacaacauuugucccuacugugcaucuagacuaaccucagaugggcuugcuaggcaugugauacaaugcccuaagcggaaggagaaaguggaagaaacugaacuguacuugaacuuagaaagaauuccuuggguuguaagaaagcuguugcaggugucagagucaacugguguggcauugaaaagaagcaguuggcugauugugcugcuugugcuauucacuguuucauuaucaccaguucaaucagcacccauugguagaaagccuuuauuccuagauaguacagcuaaaggcaugaaaaaucugcuaaauucaacaaguuuagaaacgaguuuaucaauugaggcaccauggggagcaauaaauguucagucaaccuacaaaccaacugugucaacugcaaacauagcacucaguuggagcucaguggaacacagaggcaauaagaucuugguuucaggcagaucagaaucaauuaugaagcuggaagaaaggacaggaaucagcugggaucucgguguagaagaugccucugaaucuaaacugcuuacaguaucugucauggacuugucucagauguacucuccugucuucgaguacuuaucaggggacagacagguggaagaguggcccaaagcaacuugcacaggugacugcccagaaagauguggcugcacaucaucaaccuguuugcacaaagaauggccucacucaagaaauuggagaugcaaucccacuuggugcugggguguagggacuggcugcaccuguuguggauuagaugugaaagaccuuuuuacagauuauauguuugucaaguggaaaguugaauacaucaagacagaggccauaguguguguagaacuuacuagucaggaaaggcaguguagcuugauugaagcgggcacaagguucaauuuagguccugugaccaucacacugucagaaccaagaaacauccaacaaaaacucccuccugaaauaaucacacugcauccuaggaucgaagaagguuuuuuugaccugaugcaugugcaaaagguguuaucggcaagcacaguguguaaguugcagaguugcacacauggugugccaggagaccuacaggucuaccacaucggaaauuuauuaaaaggggauaagguaaauggacaucuaauucauaaaauugagccacacuucaacaccuccuggauguccugggaugguugugaccuagacuacuacugcaacaugggagauuggccuucuugcacauacacaggggucacccaacacaaucaugcuucauuuguaaacuuacucaacauugaaacugauuacacaaagaacuuccacuuucacucuaaaagggucacugcacacggagauacaccacaacuagaucuuaaggcaagaccaaccuauggugcaggcgagaucacuguucugguagaaguugcugacauggaguuacauacaaagaagauugaaauaucaggcuuaaaauuugcaagcuuagcuugcacagguuguuaugcuuguagcucuggcaucucaugcaaaguuagaauucauguggaugaaccagaugaacuuacaguacauguuaaaagugaugauccagaugugguugcagcuagcucaagucucauggcaaggaagcuugaauuuggaacagacaguacauuuaaagcuuucucggccaugccuaaaacuucucuauguuucuacauuguugaaagagaacacuguaagagcugcagugaagaagacacaaaaaaauguguuaacacaaaacuugagcaaccacaaagcauuuugaucgaacacaagggaacuauaaucggaaagcaaaacagcacuugcacggcuaaggcaaguugcugguuagagucagucaagaguuuuuuuuauggccuaaagaacaugcuuaguggcauuuuuggcaaugucuuuaugggcauuuucuuguuccuugcccccuucauccuguuaauacuauucuuuauguuuggguggaggauccuauucugcuuuaaauguuguagaagaaccagaggccuguucaaguauagacaccucaaagacgaugaagaaacugguuauagaaggauuauugaaaaacuaaacaauaaaaaaggaaaaaacaaacugcuugauggugaaagacuugcugauagaagaauugccgaacuguucucuacaaaaacacacauuggc

SEQ ID NO: 3909 - RNA, 2916 nt, Artificial Sequence
  derived and/or modified CDS sequence (wt) from CCHFV(UCCR4448, Artificial)__KY484042.1__Gn-4aa-Gc
uccgaagaaaccagugaugacugcauaucaagaacucaacuauugaggacagagacugcagagauccacggcgacaacuaugguggcccgggugacaaaauaaccaucugcaacggcucaacuauuguagaccaaagacuaggcagugagcuaggguguuacacuaucaacagagugaagucauucaagcuaugcgaaaauagugccacagggaagagcugugaaauagacagugucccaguuaaaugcaggcaggguuauugccuaagaaucacucaggaagggaggggccauguaaaauuaucuaggggcucagagguugucuuagaugcaugugauacaagcugugaaauaaugauaccuaagggcacuggugacaucuugguugacuguucaggugggcagcaacauuuucuaaaggacaauuugauagaucuaggaugccccaaaauuccauuauugggcaaaauggcuauuuacauuugcagaaugucgaaucaccccaaaacaaccauggcuuuccucuucugguucagcuuuggcuacgugauaacuuguauacuuugcaaggccaucuucuacuuguuaauaauuauuggaacacuagggaaaagguucaagcaguauagagaguuaaaaccccagaccugcaccauaugugagacaacuccuguaaaugcaauagaugcugagaugcacgaccucaauugcaguuacaacauuugucccuacugugcaucuagacuaaccucagaugggcuugcuaggcauguaacacaaugcccuaagcggaaggagaaaguggaagaaacugaacuguacuugaacuuagaaagaauuccuuggguuguaagaaagcuguugcagguaucagaguccacugguguggcauugaaaagaagcagcuggcugauugugcugcuugugcuguucacgauuucauugucaccaguucaaucagcacccauuaguagaaagccucuauuccuagauaguauaguuaaaggcaugaaaaaucugcuaaacucaacaaguuuagaaacaaguuuaucaauugaggcaccauggggggcaauaaauguucagucaaccuacaaaccaacugugucaacugcaaacauagcacucaguuggagcucuguggaacacagagguaauaagaucuugguuucaggcagaucagaaucaauuaugaagcuggaagaaaagacaggaaucagcugggaucucggcguagaagacgccucugagucuaaacugcuuacagucucugucauggacuugucucagauguacucuccugucuucgaguacuuaucaggagacagacagguggaagaguggcccaaagcaacuuguacaggugacugcccagaaagaugcggcugcacaucaucaacguguuugcacaaagaauggccccacucaagaaauuggagaugcaaucccacuuggugcugggguguagggacuggcugcaccuguuguggauuagaugugaaagaccuuuuuacagauuauauguuugucaaguggaaaguugaauauauuaagacagaggccauaguguguguagaacuuaccagucaggaaaggcaguguagcuugauugaagcgggcacaagguucaauuuagguccugugaccaucacacugucagaaccaagaaacauccaacagaagcucccuccugaaauaaucacacugcaucccaggaucgaagaagguuuuuuugaccugaugcauguacaaaaaguguuaucggcaagcacaguauguaaguugcagaguugcacacaugguguaccaggagaccuacaggucuaccacaucggaaauuuauugaaaggggauaagguaaauggacaucuaauucauaaaauugagccacacuucaacacuuccuggauguccugggaugguugugaccuggacuacuacugcaacaugggagauuggccuucuugcacauauacaggagucacccaacacaaucaugcuucauuuguaaaccugcucaacauugaaacugauuacacaaaaaacuuccacuuucacucuaaaagggucacugcacauggagacacaccacaacuagaucuuaaggcaagaccaaccuauggugcaggugagaucacuguacugguagaaguugcugacauggaauuacacacaaagaagauugaaauaucaggcuuaaaauuugcaagcuugacuugcacagguuguuaugcuuguagcucuggcaucucaugcaaaguuagaauucauguggaugaaccagaugaacuuacaguacauguuaaaagugaugauccagauguaguugcagcuagcucaagucucauggcaagaaagcuugaauuuggaacagacaguacauuuaaagcuuucucagccaugccuaaaacuucucuauguuucuacauuguugaaagagaacacuguaagagcugcagcgaagaagacacaaaaaaauguguuaacacaaaacuugagcaaccacaaagcauuuugaucgaacacaagggaacuauaaucggaaagcaaaacagcacuugcacagccaaggcgaguugcugguuagagucagucaaaaguuucuuuuauggucuaaagaacaugcuuagugguauuuuuggcaauguuuuuauagguauuuucuuguuccuugcccccuucauccuauuaauacuauucuuuauguuuggguggaagauccuauuuugcuuuaaauguuguagaagaacuagaggccuauucaaguauagacaccucaaggacgaugaagaaacugguuauagaaggauuauugaaagacuaaacaauaaaaaaggaaaaaacaaacugcuugauggugaaauacuugcugauagaagaauugccgaacuguucucuacaaaaacacacauuggc

SEQ ID NO: 3910 - RNA, 2916 nt, Artificial Sequence
  derived and/or modified CDS sequence (wt) from CCHFV(SPU 45/88, Artificial)__KJ682809.1__Gn-4aa-Gc
ucugaagagucuagugaugacuguuuaucaaggacucagcuauugaggacagagaauacggaaauucacagugacaacuauggugguccaggugacaagauaacuaucugcaacgguucaacuauuguagaucagagacugggcagugaacuaggguguuacacuaucaauagagugaaaucauuuaagcuuugcgagaacagugcuacagguaaaucuugugaaauagauagcaccccaguuagauguaggcaggguuuuugcuugaaaaucacucaggagggaaggggccacgugaagcuaucaagaggcucagaaguugucuuggacgccugugauucaagcugugaaauaaugauaccaaagggcacuggggacauccuaguugacuguucaggugggcagcaacauuucuuaaaagauaacuugguugaucuaggaugccccaacauuccacuauuaggcaaaauggccaucuacauuuguagaaugucaaaucaucccaagacaacuauggguuuucuuuuuugguuuagcuuugguuaugugauaaccuguauacuuuguaagguaaucuucuaucuauuaauaguuguagggacauuagggaaaaaguuuaaacaguacagagaguugaaaccucagaccuguaccauaugugaaacgacuccuguuaaugcaauagaugcugagaugcacgaccucaacugcaguuacaauauauguccuuauugugcaucuagguuaaccucagauggucuugccagacauguaaugcaaugccccaaacggaaggaaaaaauagaagaaaccgaauuauauuuaaacuuagaaagaauccccuggauuguuaggaaauuacugcaggugucagaauccaccgguguagcacuaaagaggaguaguugguugguuguacuacuugugcuacucacaguuucauugucaccaguacaaucagcaccuaucggcaggaaacccuuauuuuuggacaguauuguuaaaggcaagaagaacuugcuaaauucaacaagccuagaaacaagcuuaucaauugaggcaccauggggggcaauaaauguccagucaacuuucaaaccaacugugucagcugcaaacauagcacuuaguuggagcucaguagaacauagagguaacaagauuuugguuucaggcaggucagagucaaucaugaaauuagaggaaaggacaggaauuagcugggaucuggguguggaagacgccucugaauccaaauugcucacugucucuguuauggacuugucacagauguauucuccugucuuugaauaccuaucaggugauagacaaguggaggaauggcccaaggcaaccugcacaggagauugcccagaaagauguggcuguacgucgucaaccugccuacacaaggaauggccccauucaagaaacuggagaugcaacccuacuugguguuggggagucggcacuggaugcaccuguugugggcuggaugugaaagaccucuuuacagauuacauguuugucaaguggaaaguugacuacauuaaaacagaagcuauaguauguguugagcuuacuagccaggaaagacaauguagcuugauugaggcaggcacaagauucaacuuggguccugugacuaucacauugucagagccaagaaacauucagcaaaagcucccuccagaaauagucacauugcauccuaggauugaagaaggcuucuuugacuuaaugcauguacaaaaugugcuaucagcaaguacagugugcaagcuacaaaguuguacacauggugugccaggagaccuacagauuuaccacauuggaaacuuguuaaaaggagacaaggugaaugggcaccugauucacaagauugaaccacacuucaacacuuccuggaugucuugggacggcugugaccuagacuacuacuguaauaugggggauuggccaucuugcucauacacuggcguaacccaacacaaucaugcugcauuuguaaacaugcucaacaucgaaacugauuauacaaaaaacuuccacuuucacucuaagagaguuacagcacauggagacacaccacaauuagauuuaaaagccagaccaacuuauggugcaggugaaaucacugugcugguggagguugcugacauggaguugcauacaaagaaaauugagauaucagguuugaaguuugcaagcuuaacuugcacaggcuguuaugcuuguaguucugguaucuccuguaagguuagaauccauguggaugaaccagaugagcucacaguacaugugaagagugaggauccagacauaguugcugcuagcucaagucucauggcuaggaagcuugaauuugggacagauagcacauuuaaagccuuuucagccaugcccaaaaccuccuuaugcuuuuacauuguggagagggaauacugcaaaagcugcaguaaagaagacacacaaaaaugugucaacacaaagcuugagcaaccacaaagcauuuuaaucgagcacaaagggacgauaauugggaagcagaacgacacuuguacagccaaagcaaguugcuggcuagagucagucaagaguuuuuuuuauggacuaaagaauaugcuuaguggcauuuuuggcaauguuuucauagggauucucuuauuccucgcuccuuuuaucaugcuaauacuuuucuucauguuuggauggaggauccuguucugcuuuaaguguugcagaagaacuagaggccuauuuaaguauagacaccucaaagacgaugaagaaaucgguuacaggaaaaucauugagaggcuaaacaacaaaaaagggaaaaacaaacugcuugacggugaaaggcuagcugauaggaaaaucgcugagcuguucuccacaaaaacacacauuggc

SEQ ID NO: 3911 - RNA, 2916 nt, Artificial Sequence
  derived and/or modified CDS sequence (wt) from CCHFV(3010, Artificial)__DQ019222.1__Gn-4aa-Gc
gcagaaggagugagcaaugacuguguuucaaggacccagcuaaucaaaacagaaguugcagagauucaugaagauaguuauggugggccuggagaaaaaauaacaaucugcaacggcuccacaaucguggaccaaagacucgguagcgaacuaggcugcuacacaaucaaccgugugaagacuuauaagcuuugugagaauagugcuacagagaaggguugugagaucgauagugucccagucaaaugcaaacaaggguucugccucaaaguaacccaagagggcaggggccauguaaaacuguccagaggaacggaaauuguccuagauguaugugacaccaguugugaguugaugauacccaaaggcacuggggacauauugguggacugcucaggaggacagcagcacuuuuugcaggauaacuugauugacuuagguuguccaaauguaccauuauuaggcaagauggcaauauauaucugcaggaugucaaaucauccuaaaacuaccauggcuuuuuuguucugguuuagcuuuggcuaugucaucacaugcauaguauguaaagugcuuuucuaucugcuaauugucaucgggacacuaaguaagaaacuuaaacaguauagggaauuaaaaccucaaacaugcauugucugugaaucaaccccuguuaaugcaauagaugcugaaaugcacgagcucaauuguaauuacaacauaugcccauacugcgcguccagacuaacuucagauggacuagucagacaugugaaucaaugucccaaaaggaaagaaaaggucgaggagacugaacuauacuugaaccuggagaggauaccuuggcuaguaaggaggcuacuacaagugucagagucaacggggauggcucuaaagagaaguugcuggaugaccacacuccucauucugcuaguaguuucauuaucgccaguucaaucugcuccaguugguagaaggccccuauuucuagauaguauagucaaagguaugaaaaaucugcuaaacucaacaagucuagaaacaagcuuaucaauugaggcaccauggggagcaauuaauguucagucaaccuacaaaccaacuguaucaacugcaaacauagcacuuaguuggagcucaguggaacacagaggcaauaagguuuuggucucaggcagaucagaaucaauuaugaagcuggaagaaaggacaggaaucagcugggaucuuggcguggaagaugccucugagucuaagcuacuuacaguuucagucauggacuugucucagauguacucuccugucuucgaguacuuaucaggugacagacaaguggaagaguggccuaaagcaaccugcacaggugacugcccagaaagauguggcugcacaucaucaaccugcuuacacaaagaguggccccacucaaggaauuggagauguaauccuacuugguguugggguguagggacuggcugcaccuguugugguuuagaugugaaagaccuuuucacagauuacauguucgucaaguggaaaguugaguacauuaagacagaggccauaguauguguagaacuaaccagucaggaaagacaguguagcuugauugaggcgggcacaagauucaauuuagguucugugacuauuacauugucagaaccaaggaacauucaacaaaagcucccuccugaaauaaucacacugcaccccaagauugaggaagguuuuuuugaccuaaugcauguacaaaaagugcuaucggcaagcacaguguguaaguugcagaguugcacacauggugugccaggagaucugcaggucuaccacaucggaaaccuauuaaaaggggacagaguaaacggacaccugauucauaaaauugagcaacacuucaacacauccuggaugucuugggaugguugugaccuagacuacuacuguaacaugggagacuggccuuccugcacauauaccggagucacucagcauaaccaugcuucauuuguaaaccugcucaacauugaaacugauuauacaaaaaccuuucacuuucacucuaaaaggguuacugcacauggagacacaccacagcuagaucugaaggcaaggccaaccuauggugcaggugaggucaccgugcugguggaaguugcugacauggaguuacacacaaagaagauugaaauaucaggcuuaaaauuugcaggccuaacuugcacagguuguuaugcuuguaguucuggcaucucuuguaaaguuagaauucauguagaugaaccagaugaacuuacaguacauguuaaaagugaugacccagauguaguugcagcuagcucaagucucauggcgaggaagcuugaguuuggaacagacaguacauuuaaagcuuucucagccaugccuaaaaccucccuauguuucuacauuguggaaagagaauacuguaagagcugcaguaaagaagauacacaaaaauguguuaacacgaaacucgaacaaccacagagcauuuugaucgaacauaagggaacuauaauuggaaagcaaaacaauacuugcacggcuaaagcgaguugcugguuagagucaguuaagaguuuuuuuuauggucugaagaauaugcucgguggcauauuuggcaauguuuuuauaggcauuuucacauuucuuacccccuuuaucuuguuaauacucuucuuuauguuuggguggaggauccuguuuugcuucaaguguugcagaagaaccagaggccuauucaaguacagacaccucaaagacgaugaagaaacugguuacagaaagaucauugaaagacugaacaacaaaaagggaaaaaacaggcugcuugauggugaaagacuugcugacagaaagauugcugaacuguucuccacaaaaacacacauuggc

SEQ ID NO: 3912 - RNA, 972 nt, Artificial Sequence
  derived and/or modified CDS sequence (wt) from CCHFV(10200)__U39455.2__Gn
ucagaagaacccagugaugacuguguaucaagaacucaacuauuaaggacagagacugcagagauccacggcgacaacuaugguggcccgggugacaaaauaaccaucugcaauggcucaacuauuguagaccaaagacugggcagugaacuaggaugcuacaccaucaauagagugaggucauucaagcuaugcgaaaacagugccacagggaagaauugugaaauagacagugucccaguuaaaugcaggcaggguuauugccuaagaaucacucaggaagggaggggccacguaaaauuaucuaggggcucagagguugucuuagaugcaugcgauacaagcugugaaauaaugauaccuaagggcacuggugacauccuaguugacuguucaggugggcagcaacauuuucuaaaggacaauuugauagaucuaggaugccccaaaauuccauuauugggcaaaauggcuauuuacauuugcagaaugucaaaccaccccaaaacaaccauggcuuuccucuucugguucagcuuuggcuauguaauaaccugcauacuuugcaaggcuauuuuuuacuuguuaauaauuguuggaacacuagggagaaggcucaagcaguauagagaguugaaaccucagacuugcaccauaugugagacaacuccuguaaaugcaauagaugcugagaugcaugaccucaauugcaguuacaacauuugucccuacugugcaucuagacuaaccucagaugggcuugcuaggcaugugauacaaugcccuaagcggaaggagaaaguggaagaaacugaacuguacuugaacuuagaaagaauuccuuggguuguaagaaagcuguugcaggugucagagucaacugguguggcauugaaaagaagcaguuggcugauugugcugcuugugcuauucacuguuucauuaucaccaguucaaucagcacccauuggu

SEQ ID NO: 3913 - RNA, 972 nt, Artificial Sequence
  derived and/or modified CDS sequence (wt) from CCHFV(IbAr10200)__AF467768.2__Gn
ucagaagaacccagugaugacuguauaucaagaacucaacuauuaaggacagagacugcagagauccacggcgacaacuaugguggcccgggugacaaaauaaccaucugcaauggcucaacuauuguagaccaaagacugggcagugaacuaggaugcuacaccaucaauagagugaggucauucaagcuaugcgaaaacagugccacagggaagaauugugaaauagacagugucccaguuaaaugcaggcaggguuauugccuaagaaucacucaggaagggaggggccacguaaaauuaucuaggggcucagagguugucuuagaugcaugcgauacaagcugugaaauaaugauaccuaagggcacuggugacauccuaguugacuguucaggugggcagcaacauuuucuaaaggacaauuugauagaucuaggaugccccaaaauuccauuauugggcaaaauggcuauuuacauuugcagaaugucaaaccaccccaaaacaaccauggcuuuccucuucugguucagcuuuggcuauguaauaaccugcauacuuugcaaggccauuuuuuacuuguuaauaauuguuggaacacuagggaaaaggcucaagcaguauagagaguugaaaccucagacuugcaccauaugugagacaacuccuguaaaugcaauagaugcugagaugcaugaccucaauugcaguuacaacauuugucccuacugugcaucuagacuaaccucagaugggcuugcuaggcaugugauacaaugcccuaagcggaaggagaaaguggaagaaacugaacuguacuugaacuuagaaagaauuccuuggguuguaagaaagcuguugcaggugucagagucaacugguguggcauugaaaagaagcaguuggcugauugugcugcuugugcuauucacuguuucauuaucaccaguucaaucagcacccauuggu

SEQ ID NO: 3914 - RNA, 972 nt, Artificial Sequence
  derived and/or modified CDS sequence (wt) from CCHFV(Turkey-Kelkit06)__GQ337054.1__Gn
uccgaagagccaggugaugacugcauaucaagaacucagcuauugaggacagaaacagcagagauccaugaugacaacuauggugguccaggugauaaaauaacuaucugcaacgguucaaccauuguagaucagagacugggcagugaacuaggguguuauaccaucaacagggugaagucauucaagcuaugcaaaaacagcgccacagggaaaaccugugagguagacagcacuccgguuaagugcaggcaagguuuuuguuuaaaaaucacccaagagggaaggggccacguaaaauuaucuagaggcucagagguuguccuggaugcuugcgacucaagcugugaaguaaugauaccuaaaggcacuggggauauccuaguggacuguucaggugggcagcaacauuucuuaaaagacaacuuaauugaccuagggugcccccauaucccgcuauuggguaggauggcuauuuacauuugcagaaugucaaaucauccuagaacaaccauggcuuuucucuucugguucagcuuuggcuauguuaucacuuguauauuuugcaaggcucuuuuuuauucauugauaauuauuggaacacuaggaaaaaagaucaagcaauauagggaacugaaaccucaaaccugcaccauaugugagacagcuccugucaaugcaauagaugcugaaaugcaugaccucaacuguaguuacaauauaugcccuuauugugcaucaagauugaccuccgaugggcuagccaggcauguaacgcaaugccccaagcggaaagagaaaguugaggagacugaacuguaccugaaccuggaaagaauuccuuggauugucagaaagcuauugcaggugucagaguccacugguguggcauugaaacgaagcagcuggcugauuguacugcuuguguuacugacaguuucguugucgccgguucagucagcaccuguuggu

SEQ ID NO: 3915 - RNA, 972 nt, Artificial Sequence
  derived and/or modified CDS sequence (wt) from CCHFV(SR3)__AJ538199.1__Gn
uccgaagaaucuggugaugacugcauaucaagaacucagcuauugaggacagagacugcagagguccauggcgacaacuacggugguccaggugauaagauaaccaucuguaaugguucaacuguuguagaucaaagacuggguagugaacuaggguguuacacuaucaauagagugaggucauucaagcuaugcgaaaacagugccacagggaagagcugugaaauagacaguaucccagucaaguguaagcaggguuauugccuuaaaaucacucaggaaggaaggggccaugugaaguuaucuagaggcucagaaguugucuuggauguaugugauucaagcugugaagugaugauaccuaagggcacuggugacauucuaguagauuguucaggugggcagcaacauuuuuuaaaagacaaccugguugaccuagggugucccaaaauuccguuacugggcaaaauggcuauuuauaucugcaggaugucgaaucaccccaagacaaccauggccuuccucuuuugguucagcuuuggcuaugugauaacuuguauacuuugcaaggccauuuuuuucuuauuaauaauuuuuggaacacuagggaaaagguucaagcaguacagagaguugaaaccccagaccugcaccauaugugagacaacaccuguaaaugcaauagaugcugaaaugcaugaucucaacugcaguuacaauauaugucccuauugugcgucuagacugacuucagaugggcuugcuaggcauguaacacaauguccuagacggaaggagaaaguggaggaaaccgaauuauaccugaauuuagagagaauucccuggguuguaagaaagcuauugcaggugucagaguccacugguacaguauuaaaaaggagcagcuggcuaauuguauuacuugugcuguucacaguuucauugucaccaguucaaucagcacccauuggu

SEQ ID NO: 3916 - RNA, 972 nt, Artificial Sequence
  derived and/or modified CDS sequence (wt) from CCHFV(UCCR4413)__KY484038.1__Gn
ucagaaagcagcgcuagugguugcauuucaaggacccagaugaucaagucagaaacagcagagauccacgacgacaucuacggaggaccuggugagaagcuuaccaucuguaaugguaccacuguuguagaucaaagacugggcagugaacuagguugcuacacaaucaacagaauuaagaccuauaaauugugugaaaacagugucaaagaaaaaacuugugagauugacaguguaccagucaaguguagacaggggcuuuguuugaagauaacucaagaaggaagaggccauguuaagcuuuccagaggcucagagauuguccuggacauuugugacucuaguugugaauugaugauaccuaaaggcacuggggacauauugguagauuguucuggaggacagcaacauuuuuuacaggauaaccugguugacuuagguugcccuaacaucccccuacuugggaaaguggcuaucuacauaugcagaaugucaaaucaccccaagacuaccauggcauuucucuucugguucaguuuugguuaugugaucacaugcauauugugcaaaauacucuuuuaccuacucauaaucacuggcacacuagggaaaaaacuaaagcaguauagagagcucaagccacaaacauguaccauaugugaaucaacaccugugaaugcaauagaugcugagaugcaugaccucaacuguaguuacaacauaugcccuuauugugcaucuagacugacuucagaugggcucauaaggcaugugaaucugugccccaagaggaaggagaaaguugaagagacagaacuguauuugaacuuagaaagaauaccuugguuugugagaaagcuuuuacaggugucugaaucuacaggaguagcucucaaaagaagcaguuggcuauugauacuuguuauauugcucacaguuucuaugucaccaguucagucggcaccaauuaau

SEQ ID NO: 3917 - RNA, 972 nt, Artificial Sequence
  derived and/or modified CDS sequence (wt) from CCHFV(66019)__AB069669.1__Gn
uccgaagagucuggugacgacugcauaucuagaacucagcuauugaggacagagacugcagagguccauggugacaacuauggugguccaggugacaaaauaacuaucuguaaugguucaaccauuguggaucaaagacuuggcagugaacugggguguuauacuaucaauagagugaagucauucaagcuaugcgaaaauaguggcacgggaaaauccuguaagauagauaacaccccaguuaagugcaggcaggguuuuugcuuaaaaauuacucaggaaggaaggggccaugugaagcuaucgagaggcucagaaguugucuuagaugccugcgacucaagcugugaaauaaugauaccgaagggcacaggagacauccuaguagacuguucaggugggcaacaacauuucuuaaaagauaacuugguugaucuaggaugcccuaacauuccacuauuagguaaaauggcuaucuacauuugcaggaugucaaaucacccuaaaacaacuauggcuuuucucuuuugguuuaguuucggcuauguaauaacauguauauuuuguaaaaucauuuuuuacuuguugauagucguggggacauuggggaaaaaguucaaacaguaccgggagcugaaaccucagacuuguacuauaugugaaacaacuccuaccaaugcaauagaugcugaaaugcacgaucuuaaaugcaguuacaauauaugcccuuauugugcaucuagauuaaccucggacgggcuugccaggcaugugacacaaugcccuaagcgaaaagagaaaguagaagagacugaacuguacuugaacuuggaaagaauuccuuggauugucagaaaacuacugcaagugucagagucuaccgguguggcacugaaaaggagcaguuggcuaauuguguuacuugugcuacuuacaguuucauugucaccgguucaaucagcacccauugga

SEQ ID NO: 3918 - RNA, 972 nt, Artificial Sequence
  derived and/or modified CDS sequence (wt) from CCHFV(7001)__AB069670.1__Gn
gcagaaggaggaagcagugacugcauuucaagaacucagcuaguuaaaacggagguugcagaaauucaugaggacaguuacggugggccuggugagaaaauaacaaucugcaaugguuccacaauuguagaucaaaggcuugguagugaauugggcuguuauacaaucaacagaguaagauccuacaagcuaugcgagaacagugccucagggaaaagcugugaaauagauagcaucccagucaaaugcaaacaaggguuuugccucaaaauaacccaagaaggaagaggucauguaaaacuguccagagggacagaaauuguucuagaugucugugauuccagcugugagcugaugauacccaagggcacuggagacauuuuaguggauugcucaggagggcaacagcauuuuuuacaaaacaaucugauugacuugggaugccccaaugucccauuacuggguaaaauggccauauaugucugcagaaugucaaaccacccaaaaacuaccauggcauuucuguucugguucagcuuuggcuaugucauuacauguauagcaugcaggguacucuucuacuugcugauugccaucggaacaguagggaaaaagcuaaaacaguauagagagcugaaaccacaaacaugcauugucugugaaucugucccuguuaaugcaauagaugcugaaaugcaugagcuuaauugcaguuacaauauaugcccauacugugcaucuagacugucuacagacgggcucaucaggcacguaacucagugucccaaacggagggagaagguggaagagacugagcuauucuugaacuuggaaagaauaccuuggcuggugagaaagcuccuucaaguaucagagucaacaggaauggcucuaaagagaagcuguuggaugaucacacuccucauucuacuauugguuucgauaucaccaguccaaucugcaccgguaggc

SEQ ID NO: 3919 - RNA, 972 nt, Artificial Sequence
  derived and/or modified CDS sequence (wt) from CCHFV(75024)__AB069671.1__Gn
ucugaagaaucuggugaugacugcauaucaagaacucagcuauugaggacagagacugcagagauccauggugauaacuauggcgguccgggugacaagauuacuauuugcaaugguucgacaauuguagaucaaagacuggguagugagaugggguguuacacuaucaauagggugaagucauucaagcugugcgaaaacagugcaacagggaagagcugugaaauagacaguaucccaguuaagugcaggcaggguuauugccuaaaaaucacucaggaaggaaggggccaugugaaauuauccaggggcucagagguugucuuggaugcaugcgacucaagcugugaaguaaugauaccuaagggcacaggugacauccugguagacuguucaggugggcagcaacauuuuuugaaggacaacuuaauugaucuaggaugucccaguauuccauuacuggguaaaauggcuauuuauauuugcagaaugucgaaucacccuaagacaaccauggcuuuccucuuuugguucaguuuuggcuaugugauaacuuguauacucugcaaggcuauuuucuacuuauuaauaauuguuggaacgcuagggaagagguuuaagcaguacagagaguuaaaaccccagaccuguaccauaugugagacaacuccugcaaaugcaauagaugcugaaaugcaugaccuuaacugcaguuacaacauaugucccuauugugcaucuagacuaaccucagacgggcuugcuaggcaugugacacaaugcccuaagcggaaggagaaaguagaagaaacugaauuguacuugaacuuagagagaauucccuggguuguaagaaagcuguugcagguaucggaguccaccgguguugcauuaaaaagaagcagcuggcugauugugcugcuugugcuguucgcaauuucauuaucaccaguucaaucagcacccaucggu

SEQ ID NO: 3920 - RNA, 972 nt, Artificial Sequence
  derived and/or modified CDS sequence (wt) from CCHFV(7803)__AB069672.1__Gn
ucugaagaaucuggugaugacugcauaucaagaacucagcuauugaggacagagacugcagagauccauggugauaacuauggugguccgggugacaagauuacuauuugcaaugguucgacaauuguagaucaaagacuggguagugagaugggguguuacacuaucaauagggugaagucauucaagcugugcgaaaacagugcaacagggaagagcugugaaauagacaguaucccaguuaagugcaggcaggguuauugccuaaaaaucacucaggaaggaaggggccaugugaaauuauccaggggcucagagguuaucuuggaugcaugcgacucaagcugugaaguaaugauaccuaagggcacaggugacauccugguagacuguucaggugggcagcaacauuuuuugaaggacaacuuaauugaucuaggaugucccaguauuccauuauuggguaaaauggcuauuuauauuugcagaaugucgaaucacccuaagacaaccauggcuuuccucuuuugguucaguuuuggcuaugugauaacuuguauacucugcaaggcuauuuucuacuuauuaauaauuguuggaacgcuagggaagagguuuaagcaguacagagaguuaaaaccccagaccuguaccauaugugagacaacuccugcaaaugcaauagaugcugaaaugcaugaccuuaacugcaguuacaacauaugucccuauugugcaucuagacuaaccucagacgggcuugcuaggcaugugacacaaugcccuaagcggaaggagaaaguagaagaaacugaauuguacuugaacuuagagagaauucccuggguuguaagaaagcuguugcagguaucggaguccaccgguguugcauuaaaaagaagcagcuggcugauugugcugcuugugcuguucgcaauuucauuaucaccaguucaaucagcacccaucagu

SEQ ID NO: 3921 - RNA, 972 nt, Artificial Sequence
  derived and/or modified CDS sequence (wt) from CCHFV(79121)__AB069673.1__Gn
gcagaaggaggaagcagugacugcauuucaagaacucagcuaguuaaaacggagguugcagaaauucaugaggacaguuacggugggccuggugagaaaauaacaaucugcaaugguuccacaauuguagaucaagggcuugguagugaauugggcuguuauacaaucaacagaguaagauccuacaagcuaugcgagaacagugccucagggaaaagcugugaaauagauagcaucccagucaaaugcaaacaaggguuuugccucaaaauaacccaagaaggaagaggucauguaaaacuguccagagggacagaaauuguucuagaugucugugauuccagcugugagcugaugauacccaagggcacuggagacauuuuaguggauugcucaggagggcaacagcauuuuuuacaaaacaaucugauugacuugggaugccccaaugucccauuacuggguaaaauggccauauaugucugcagaaugucaaaccacccaaaaacuaccauggcauuucuguucugguucagcuuuggcuaugucauuacauguauagcaugcaggguacucuucuacuugcugauugccaucggaacaguagggaaaaagcuaaaacaguauagagagcugaaaccacaaacaugcauugucugugaaucugucccuguuaaugcaauagaugcugaaaugcaugagcuuaauugcaguuacaauauaugcccauacugugcaucuagacugucuacagacgggcucaucaggcacguaacucagugucccaaacggagggagaagguggaagagacugagcuauucuugaacuuggaaagaauaccuuggcuggugagaaagcuccuucaaguaucagagucaacaggaauggcucuaaagagaagcuguuggaugaucacacuccucauucuacuauugguuucgauaucaccaguccaaucugcaccgguaggc

SEQ ID NO: 3922 - RNA, 972 nt, Artificial Sequence
  derived and/or modified CDS sequence (wt) from CCHFV(8402)__AB069674.1__Gn
uccgaagagucuggugaugacugcauaucaagaacucagcuauugaggacagagacugcggaaauucacaaugauaacuauggugguccaggugacaagauaaccaucugcaaugguucaacuguuguggaucagagauugggcagugaacugggguguuacacuaucaauagaguaaagucauuuaagcuuugcgagaacagugccacaggcaaauccugugaaauagauagcaccccagucaaaugcaggcaggguuucuguuugaaaauuacucaggagggaaggggccacgugaagcuaucgagagguucagaaguuguccuggacgccugcgauucaagcugugaaauaaugauaccaaagggcaccggagacauccuaguugacuguucagguggacagcaacauuucuuaaaagauaacuugauugaucuaggaugcccaaacaucccacuauuaggcaagauggcuaucuacauuuguagaaugucaaaucauccuaaaacgacuauggcuuuucuuuuuugguuuagcuuugguuauguggugaccuguauacucuguaaggucaucuucuaucuauuaauaguuguggggacguuggggaaaaaguucaaacaguauagagaguugaaaccucagaccuguaccauaugcgaaacaacuccuguuaaugcaauagaugcugaaaugcacgaccucaacugcaguuacaauauauguccuuacugugcaucuagguuaaccucagauggucuugccagacauguaaugcagugcccuaagcggaaggaaaaaauagaagaaaccgaauuauacuuaaacuuggaaagaauccccuggguuguuaggaaauuacugcaggugucagaauccaccgguguggcacuaaagaggaguaguuggcugguugugcuacuuguguuacuuacaguuucauugucaccaguacaaucagcaccuaucggc

SEQ ID NO: 3923 - RNA, 972 nt, Artificial Sequence
  derived and/or modified CDS sequence (wt) from CCHFV(88166)__AB069675.1__Gn
uccgaagagucuggugaugacugcauaucaagaacucagcuauugaggacagagacugcggaaauucacagugauaacuauggugguccaggugacaagauaaccaucugcaaugguucaacuguuguggaucagagauugggcagugaacuaggguguuacacuaucaauagaguaaagucauuuaagcuuugcgagaacagugccacaggcaaauccugugaaauagauagcaccccagucaaaugcaggcaggguuucuguuugaaaauuacucaggagggaaggggccacgugaagcuaucgagagguucagaaguuguccuggacgccugcgauucaagcugugaaauaaugauaccaaagggcacuggagacauccuaguugacuguucagguggacagcaacauuucuuaaaagauaacuugauugaucuaggaugcccaaacaucccacuauuaggcaagauggcuaucuacauuuguagaaugucaaaucauccuaaaacgacuauggguuuucuuuuuugguuuagcuuugguuauguggugaccuguauacucuguaaggucaucuucuaucuauuaauaguuguggggacguuggggaaaaaguucaaacaguauagagaguugaaaccucagaccuguaccauaugcgaaacaacuccuguuaaugcaauagaugcugaaaugcacgaccucaacugcaguuacaauauauguccuuacugugcaucuagguuaaccucagauggccuugccagacauguaaugcagugcccuaagcggaaggaaaaaauagaagaaaccgaauuauacuuaaacuuggaaagaauccccuggguuguuaggaaauuacugcaggugucagaauccaccgguguggcacuaaagaggaguaguuggcugguugugcuacuuguguuacuuacaguuucauugucaccaguacaaucagcaccuaucggc

SEQ ID NO: 3924 - RNA, 972 nt, Artificial Sequence
  derived and/or modified CDS sequence (wt) from CCHFV(BA88166)__AF338470.1__Gn
uccgaagagucuggugaugacugcauaucaagaacucagcuauugaggacagagacugcggaaauucacagugauaacuauggugguccaggugacaagauaaccaucugcaaugguucaacuguuguggaucagagauugggcagugaacuaggguguuacacuaucaauagaguaaagucauuuaagcuuugcgagaacagugccacaggcaaauccugugaaauagauagcaccccagucaaaugcaggcaggguuucuguuugaaaauuacucaggagggaaggggccacgugaagcuaucgagagguucagaaguuguccuggacgccugcgauucaagcugugaaauaaugauaccaaagggcacuggagacauccuaguugacuguucagguggacagcaacauuucuuaaaagauaacuugauugaucuaggaugcccaaacaucccacuauuaggcaagauggcuaucuacauuuguagaaugucaaaucauccuaaaacgacuauggguuuucuuuuuugguuuagcuuugguuauguggugaccuguauacucuguaagggcaucuucuaucuauuaauaguuguggggacguuggggaaaaaguucaaacaguauagagaguugaaaccucagaccuguaccauaugcgaaacaacuccuguuaaugcaauagaugcugaaaugcacgaccucaacugcaguuacaauauauguccuuacugugcaucuagguuaaccucagauggccuugccagacauguaaugcagugcccuaagcggaaggaaaaaauagaagaaaccgaauuauacuuaaacuuggaaagaauccccuggguuguuaggaaauuacugcaggugucagaauccaccgguguggcacuaaagaggaguaguuggcugguugugcuacuuguguuacuuacaguuucauugucaccaguacaaucagcaccuaucggc

SEQ ID NO: 3925 - RNA, 972 nt, Artificial Sequence
  derived and/or modified CDS sequence (wt) from CCHFV(BA66019)__AF350448.1__Gn
uccgaagagucuggugacgacugcauaucuagaacucagcuauugaggacagagacugcagagguccauggugacaacuauggugguccaggugacaaaauaacuaucuguaaugguucaaccauuguggaucaaagacuuggcagugaacugggguguuauacuaucaauagagugaagucauucaagcuaugcgaaaauaguggcacgggaaaauccuguaagauagauaaacacccaguuaagugcaggcaggguuuuugcuuaaaaauuacucaggaaggaaggggccaugugaagcuaucgagaggcucagaaguugucuuagaugccugcgacucaagcugugaaauaaugauaccgaagggcacaggagacauccuaguagacuguucaggugggcaacaacauuucuuaaaagauaacuugguugaucuaggaugcccuaacauuccacuauuagguaaaauggcuaucuacauuugcaggaugucaaaucacccuaaaacaacuauggcuuuucucuuuugguuuaguuucggcuauguaauaacauguauauuuuguaaaaucauuuuuuacuuguugauagucguggggacauuggggaaaaaguucaaacaguaccgggagcugaaaccucagacuuguacuauaugugaaacaacuccuaccaaugcaauagaugcugaaaugcacgaucuuaaaugcaguuacaauauaugcccuuauugugcaucuagauuaaccucggacgggcuugccaggcaugugacacaaugcccuaagcgaaaagagaaaguagaagagacugaacuguacuugaacuuggaaagaauuccuuggauugucagaaaacuacugcaagugucagagucuaccgguguggcacugaaaaggagcaguuggcugauuguguuacuugugcuacuuacaguuucauugucaccgguucaaucagcacccauugga

SEQ ID NO: 3926 - RNA, 972 nt, Artificial Sequence
  derived and/or modified CDS sequence (wt) from CCHFV(BA8402)__AF350449.1__Gn
uccgaagagucuggugaugacugcauaucaagaacucagcuauugaggacagagacugcggaaauucacaaugauaacuauggugguccaggugacaagauaaccaucugcaaugguucaacuguuguggaucagagauugggcagugaacugggguguuacacuaucaauagaguaaacucuuuuaaccuuugcgaaaacacugccacgggcaaauccugugaaauagauagcaccccagucaaaugcaggcaggguuucuguuugaaaauuacucaggagggaaggggccacgugaagcuaucgagagguucagaaguuguccuggacgccugcgaaucaagcugugaaauaaugauaccaaagggcaccggagacauccuaguugacuguucagguggacagcaacauuucuuaaaagauaacuugauugaucuaggaugcccaaacaucccacuauuaggcaagauggcuaucuacauuuguagaaugucaaaucauccuaaaacgacuauggcuuuucuuuuuugguuuagcuuugguuauguggugaccuguauacucuguaaggucaucuucuaucuauuaauaguuguggggacguuggggaaaaaguucaaacaguauagagaguugaaaccucagaccuguaccauaugcgaaacaacuccuguuaaugcaauagaugcugaaaugcacgaccucaauugcaguuacaauauauguccauacugugcaucuaggccaaccucagauggucuugccagacauguuaugcagugcccuaagcggaaggaaaaaauugaagaaaccgcauuauacuuaaacuuggaaagaauccccuggguuguuaggaaauuacugcaggugucagaauccaccgguguggcacuaaagaggaguaguuggcugguugugcuacuugugcuacuuacaguuucauugucaccaguacaaucagcaccuaucggc

SEQ ID NO: 3927 - RNA, 972 nt, Artificial Sequence
  derived and/or modified CDS sequence (wt) from CCHFV(Matin)__AF467769.2__Gn
uccgaagagucuggugaugacuguauaucaagaacucagcuauugaggacagagacugcggaaauucacagugauagcuaugguggaccaggugauaagauaaccaucugcaaugguucaacuguuguagaucagagguugggcagugaacuaggguguuacacuauaaauagaguaaagucauuuaagcuuugcgagaacagugccacagguaaauccugugaaauagauagcaccccaguuaaaugcaggcaggguuuuugcuuaaaaauuacucaggagggaaggggccacgugaagcugucgagagguucagaaguugucuuggaugccugugacucaagcugugaaauaaugauaccaaagggcacuggagacauccuaguugacuguucaggugggcagcaacauuucuuaaaagauaaccugauugaucugggaugccccaacauuccacuauuaggcaaaauggccaucuacauuuguagaaugucaaaucaucccaaaacaacuaugguuuuucuuuuuugguuuagcuuugguuauguaauaaccuguauacucuguaaggucaucuucuaucuauuaauaguuguagggacauuagggaaaaaguucaaacaguauagagaguugaaaccucagaccuguaccauaugcgaaacaacuccuguuaaugcaauagaugcugaaaugcacgaccuuaacugcaguuacaauauauguccuuacugugcauccagguugacaucagauggucuugccagacauguaaugcagugccccaaacggaaggaaaaaauagaagaaaccgaauuauacuuaaacuuagaaaggaucccuuggguuguuaggaaauuacugcaggugucagaaucuaccgguguggcacuaaagaggaguagcuggcugguugugcuacuuguguuacuuacaguuucacuaucaccaguacaaucagcaccuaucggc

SEQ ID NO: 3928 - RNA, 972 nt, Artificial Sequence
  derived and/or modified CDS sequence (wt) from CCHFV(Baghdad 12)__AJ538197.2__Gn
ucugaagaaucuggugaugacugcauaucaagaacucggcuauugagaacagagacugcagagauccauggugacagcuauggugguccgggugacaaaauuacuauuugcaacgguucaacuauuguagaucaaagacugggaagugagaugggguguuacacuaucaauagagugaagucauucaagcugugcgaaaacagugcaacaggaaagagcuguaaaauagacaguaucccaguuaagugcagacaggguuauugccuaaaaaucacucaggaaggaaggggccaugugaaauuauccaggggcucagagguugucuuggaugcaugcgacucaagcugugaaguaaugauaccuaaaggcacaggugacaucuuaguagacuguucaggugggcagcaacauuuuuugaaggauaacuugauugaucuaggaugccccaacauuccauuauuagguaaaauggcuauuuauauuugcagaaugucaaaucacccuaagacaaccauggcuuuccucuuuugguucaguuuugguuaugugauaaccuguauacucugcaaggccaucuucuacuuauuaauaauuguugggacacuagggaaaagguuuaagcaguacagagaguuaaaaccccagaccuguacuauaugugagacaacuccuguaaaugcaauagaugcugaaaugcaugaccuuaacugcaguuacaauauaugucccuauugugcaucuagauuaaccucagaugggcuugcuaggcaugugacacaaugcccuaagcggaaggagaaaguggaagaaacugaauuguacuugaacuuagagaggauucccuggguuguaagaaagcuguugcagguaucagaguccacagguguugcauuaaagagaagcagcuggcugauugugcugcuugugcuacuugcaguuucaucaucaccaguucaaucagcacccaucggu

SEQ ID NO: 3929 - RNA, 972 nt, Artificial Sequence
  derived and/or modified CDS sequence (wt) from CCHFV(VLG/TI29414)__AY179961.1__Gn
uccgaggagccaggugaugacugcauaucaagaacucagcuauugagggcagaaccagcagagauccaugaugacaacuauggugguccaggugauaaaauaacuaucugcaaugguucaaccauuguagaucagagacugggcagugaacuaggguguuauaccaucaacagggugaagucauucaagcuaugcgaaaacagcgccacagggaaaaccugugagauagacagcacuccgguuaagugcaggcaagguuuuuguuuaaaaaucacccaagagggaaggggccacguaaaauuaucuagaggcucagagguuguuuuggaugcuugcgacucaagcugcgaaguaaugauaccuaaaggcacuggagauauccugguggacuguucagguggacagcaacauuucuuaaaagacaauuuaauugaccuagggugcccccauaucccgcuauuggguaaaauggccauuuacaucugcagaaugucaaaucauccuagaacaacuauggcuuuucucuucugguucagcuuuggcuaugugaucaccuguauauuuugcaaggcucuuuuuuauucauugauaauuauugggacacuagggaaaaagaucaagcaauauagggaauugaaaccucaaacuuguaccauaugugagacagccccugucaaugcaauagacgcugaaaugcaugaccuuaacugcaguuacaauauaugcccuuauugugcaucaagauugaccuccgaugggcuagcuaggcaugugccacaaugccccaagcggaaggaaaaaguugaagagacugagcuguacuugaaccuggaaagaauuccuuggaaugucagaaagcuauugcaagugucagaguccacugguguggcauugaaacgaagcagcuggcugauuguacugcuuguguuacucacaguuucauugucaccgguucaaucagcaccuguuggu

SEQ ID NO: 3930 - RNA, 972 nt, Artificial Sequence
  derived and/or modified CDS sequence (wt) from CCHFV(TADJ/HU8966)__AY179962.1__Gn
ucugaagaaucuggugacgacugcauaucaagaacucagcuacugaggacagagacugcagagauccauggugaugauuauggugguccgggugacaagauuaccauuugcaaugguucgacuauuguagaucaaagacuggguagugaacugggguguuacacuaucaauagagugaagucauucaagcugugcgaaaacagugcaacagggaagaacugcgaaauagacagcgucccaguuaaaugcaggcaggguuauugccuaaaaauuacucaggaaggaaggggccaugugaaauuauccaggggcucagagguuguuuuggaugcaugcgauucaagcugugaaguaaugauaccuaagggcacaggugacaucucaguagacuguucaggagggcagcaacauuuuuugaaagacaacuuaauugaucugggaugucccaagauuccauuauuggguaaaauggccauuuauauuugcagaaugucgaaucacccuaaaacaaccauggcuuuccucuuuugguucaguuuuggcuaugugauaacccguauacucugcaaggccauuuucuacuuauuaauaauuguuggaacacuagggaagagguuuaagcaauauagagaguuaaaaccccagaccuguaccauaugugagacaacuccugcaaaugcaauagaugcugaaaugcaugaccuuaacugcaguuacaacauaugucccuauugugcaucuagacugaccucagauggacucgcuaggcaugugacacaaugcccuaagcggaaggagagaguagaagaaacugaauuguacuugaacuuagaaagaauucccuggauuguaagaaagcuguugcagguaucggaguccacugguguugcauuaaaaagaagcagcuggcugauugugcuacuugugcuguucacaguuucauuaucaccaguucaaucagcacccauuggu

SEQ ID NO: 3931 - RNA, 972 nt, Artificial Sequence
  derived and/or modified CDS sequence (wt) from CCHFV(Hodzha)__AY223476.1__Gn
ucugaagaaucuggugacgacugcauaucaagaacucagcuacugaggacagagacugcagagauccauggugaugauuauggugguccgggcgacaagauuaccauuugcaaugguucaacuauuguagaucaaagacuagguagugaacugggguguuacacuaucaauagagugaagucauucaagcugugcaaaaacagugcaacagggaagagcugugaaauagacagcaccccaguuaaaugcaggcaggguuauugccuaaaaaucacucaggaaggaaggggccaugugaaauuauccaggggcucggagguugucuuggaugcaugcgauucaagcugugaaguaaugauaccuaagggcacaggugacauccuaguagacuguucaggugggcagcaacauuuuuugaaagacaacuuaauugaucuaggaugucccagaauuccauuauuagguaaaauggcuauuuauauuugcagaaugucgaaucacccuaagacaaccauggcuuuccucuuuugguucaguuuuggcuaugugauaaccuguauacucugcaaggccauuuucuacuuauuaauaauuguuggaacacuagggaagagguucaagcaguauagagaguuaaaaccccagaccuguaccauaugugagacaacuccugcaaaugcaauagaugcugaaaugcaugaccuuaacugcaguuacaacauaugucccuauugugcaucuagacuaaccucagaugggcuugcuaggcaugugacacaaugcccuaagcggaaggagaagguagaagaaacugaauuguacuugaacuuagagagaauucccuggauuguaagaaagcuguugcaggugucggaguccacugguguugcauuaaaaagaagcagcuggcugauugugcugcuugugcuguucgcaguuucauuaucaccuguucaaucagcacccauuggu

SEQ ID NO: 3932 - RNA, 972 nt, Artificial Sequence
  derived and/or modified CDS sequence (wt) from CCHFV(Kosovo/9553/2001)__AY675511.1__Gn
uccgaagagccaggugaugacugcauaucaaggacucagcuauugaggacagaaacagcagagauccaugacgauaacuauggugguccaggugacaaaauaacuaucugcaaugguucgaccauuguagaucagagacugggcagugaacuaggguguuauaccaucaacagggugaagucauucaagcuaugcgaaaacagcgccacagggaaaaccugugagauagacagcacuccaguuaagugcaggcaagguuuuuguuuaaaaaucacccaagagggaaggggccacguaaaauuaucuagaggcucagagguugucuuggacgcuugcgacucaagcugugaaguaaugauacccaaaggcacuggagauauccuaguagacugcucugguggacagcagcauuucuuaaaagacaacuugauugaccuagggugcccucauaucccacuauuggguaagauggccauuuacauugccagaaugucaaaucauccuaaaacaaccauggcuuuucucuucugguucaguuugggcuaugugaucaccuguauacuuugcaaggcucuuuuuuauucauugauaauuauugggacacuagggaaaaaaaucaagcaauauagggaacugaaaccucaaacuugcaccauaugugagacagcuccugucaaugcaauagaugcugaaaugcaugaccucaacuguaguuacaauauaugccccuauugugcaucaagauugaccucugaugggcuagcuaggcauguaaagcagugcccuaagcgaaaggagaaagucgaggagacugagcuguaccugaaccuggaaagaauuccuugggucgucagaaagcuauugcaagugucagaguccacugguguggcauugaaacgaagcaguuggcugauugugcugcuuguguuacucacaguuucauugucaccgguucaaucagcacccguuggu

SEQ ID NO: 3933 - RNA, 972 nt, Artificial Sequence
  derived and/or modified CDS sequence (wt) from CCHFV(SPU41/84)__AY900142.1__Gn
uccgaggagucuagcgacgacugcauaucaagaacucaacuauugaggacagagacugcagagauccacggcgauaacuaugguggcccaggugacaagauaaccaucugcaauggcucaacuguuguagaccagagacuggguagugagcugggguguuacacuaucaauagaguaaagacauucaaacuaugcgaaaacagugcuacagggaagaguugugagauagauagugucccaguuaaaugcaggcaggguuauugccuaaaaaucacucaggaaggaaggggccauguaaaauuaucuagaggcucagagguugucuuggaugcaugugauacaagcugugaaguaaugauacccaaaggcacuggugacauccuaguugacuguucaggugggcagcaacauuuucuaaaagacaaucuaauagaccuaggaugccccaaaauuccauuacuggguaaaauggcuauuuacauuugcagaaugucgaaucaccccaaaacaacuauggcuuuccucuucugguucagcuuuggcuaugugauaacuuguauaauuuguaaggucauuuuuuacuuguuaauaauuguuggaacacuaggaaaaagguucaagcaguacagagaguuaaaaccucagaccugcaccauaugugagacaacuccugugaaugcaauagaugcugagaugcaugaccucaauugcaguuacaacauaugucccuauugugcaucuagacuaaccucagacgggcuugcuaggcaugugacacagugcccuaagcggaaggaaaaaguggaggaaacugaauuguacuugaacuuggagagaauucccuggguugugagaaagcuguugcagguaucagaguccacugguguggcauugaaaaggagcagcuggcugguugugcugcuggugcuguugacgguuucauugucaccgguucagucagcgcccauuagu

SEQ ID NO: 3934 - RNA, 972 nt, Artificial Sequence
  derived and/or modified CDS sequence (wt) from CCHFV(UG3010)__AY900143.1__Gn
gcagaaggagugagcaaugacuguguuucaaggacccagcuaaucaaaacagaaguugcagagauucaugaagauaguuauggugggccuggagaaaaaauaacaaucugcaacggcuccacaaucguggaccaaagacucgguagcgaacuaggcugcuacacaaucaaccgugugaagacuuauaagcuuugugagaauagugcuacagagaaggguugugagaucgauagugucccagucaaaugcaaacaaggguucugccucaaaguaacccaagagggcaggggccauguaaaacuguccagaggaacggaaauuguccuagauguaugugacaccaguugugaguugaugauacccaagggcacuggggacauauugguggacugcucaggaggacagcagcacuuuuugcaggauaacuugauugacuuagguuguccaaauguaccauuauuaggcaagauggcaauauauaucugcaggaugucaaaucauccuaaaacuaccauggcuuuucuguucugguuuagcuuuggcuaugucaucacaugcauaguauguaaagugcuuuucuaucugcuaauugucaucgggacacuaaguaagaaacuuaaacaguauagggaauuaaaaccucaaacaugcauugucugugaaucaaccccuguuaaugcaauagaugcugaaaugcacgagcucaauuguaauuacaacauaugcccauacugcgcguccagacuaacuucagauggacuagucagacaugugaaucaaugucccaaaaggaaagaaaaggucgaggagacugaacuauacuugaaccuggagaggauaccuuggcuaguaaggaggcuacuacaagugucagagucaacggggauggcucuaaagagaaguugcuggaugaccacacuccucauucugcuaguaguuucauuaucgccaguucaaucugcuccaguuggu

SEQ ID NO: 3935 - RNA, 972 nt, Artificial Sequence
  derived and/or modified CDS sequence (wt) from CCHFV(Hy13)__AY900145.1__Gn
uccgaagagucuggugaugacugcauaucaagaacucagcuaucgaggacagagacugcggaaauucacagugauaacuauggugguccaggugacaagauaaccaucugcaaugguucaacuauuguagaucagagauugggcagugaacuaggguguuacacuaucaauagaguaaagucauuuaagcuuugcgagaacagugccacagguaaauccugugaaauagauagcaccccaauuaaaugcaggcaggguuuuuguuuaaaaauuacucaggagggaaggggccacgugaagcuaucaagagguucagaaguugucuuggacgccugugauucaagcugugagauaaugauaccaaagggcacuggagacauccuaguugacuguucagguggacagcaacauuucuuaaaagauaacuugauugaucugggaugcccaaacaucccacuauuagguaagauggcuaucuacauuuguagaaugucaaaucauccuaaaacgacuauggcuuuucuuuuuugguuuagcuuugguuaugugauaaccuguauacucuguaaggucaucuucuaccuauuaauaguuguggggacguugggaaaaaaguucaaacaguauagagaguugaaaccucagaccuguaccauaugcgaaacaacuccuguuaaugcaauagaugcugaaaugcacgaccucaacugcaguuacaauauauguccuuacugugcaucuagguuaaccucagacggucuugccagacauguaaugcagugcccuaagcggaaggaaaaaguagaagaaaccgaauuauacuuaaacuuagaaagaauccccuggguuguuaggaaauuacugcagguaucagaauccaccgguguggcacuaaagaggaguaguuggcugguugugcuacuuguguuacuuacaguuucauugucaccaguacaaucagcaccuaucggc

SEQ ID NO: 3936 - RNA, 972 nt, Artificial Sequence
  derived and/or modified CDS sequence (wt) from CCHFV(Semunya)__DQ094832.1__Gn
gcagaaggagugagcaaugacugcguuucaaggacccagcuaaucaaaacagaaguugcggagauucaugaagauagcuacggugggccuggagaaaaaauaacaaucugcaacggcuccacaaucguggaccaaaggcuugguagcgaacuagguugcuacacaauuaaccgcgugaagacuuauaagcuuugugagaacagugccacagaaaaggguugugagaucgauaguguuccagucaaaugcaaacaaggguucugccucaaaguaacccaagagggcaggggccaugugaaacuaucuagaggaacggaaauuguccuggaugugugugacaccaguugugaguugaugauaccuaaaggcacuggagacauauugguggacugcucaggaggacagcagcacuucuugcaggacaacuugauugacuuagguugcccaaauguaccauuacuaggcaagauggcaauauauaucugcaggaugucgaaccauccaaagaccaccauggcuuuuuuguucugguucaguuuuggcuaugucaucacaugcguaguaugcaaagugcucuucuaucugcuaauugucaucgggacacuaggaaagaaacuuaaacaguauagggaacuaaaaccucagacaugcauugucugugaaucaaucccugucaaugcaauagaugcugaaaugcacgagcucaauugcaauuacaauauaugcccauacugugcguccagacugacuucagauggacuaguuagacaugugacucaaugucccaaaaggaaggaaaaggucgaggagacugagcuguacuugaaccuggagaggauacccugguugguaagaagacuacugcaagugucagagucaacagggauggcucuaaagagaaguugcuggaugaccacacuccucauucugcuaguaguuucauugucuccaguucaaucugcuccaguaggu

SEQ ID NO: 3937 - RNA, 972 nt, Artificial Sequence
  derived and/or modified CDS sequence (wt) from CCHFV(SPU128/81/7)__DQ157174.1__Gn
uccgaagaacccagugaugacugcauaucaagaacucaacuauugaggacagagacugcagagauccacggcgacaacuaugguggcccgggugacaaaauaaccaucugcaacggcucaacuauuguagaccaaagacuaggcagugagcuaggguguuacacuaucaacagagugaagucauucaagcuaugcgaaaauagugccacagggaagagcugugaaauagaaagugucccaguuaaaugcaggcaggguuauugccugagaaucacucaggaagggaggggccauguaaaauuaucuaggggcucagagguugucuuagaugcaugugauacaagcugugaaauaaugauaccuaagggcacuggugacaucuugguugacuguucaggugggcagcaacauuuucuaaaggacaauuugauagaucuaggaugccccaaaauuccauuauugggcaaaauggcuauuuacauuugcagaaugucgaaucaccccaaaacaaccauggcuuuccucuucugguucagcuuuggcuacguaauaacuuguauacuuugcaaggccaucuucuacuuguuaauaauuauuggaacacuagggaaaagguucaagcaguauagagaguuaaaaccucagaccugcaccauaugugagacaacuccuguaaaugcaauagaugcugagaugcacgaccucaauugcaguuacaacauuugucccuacugugcaucuagacuaaccucagaugggcuugcuaggcaugugacacaaugcccuaagcggaaggagaaaguggaagaaacugaacuguacuugaacuuagaaagaauuccuuggguuguaagaaagcuguugcagguaucagaguccacugguguggcauugaaaagaagcagcuggcugauugugcugcuugugcuguucacgguuucauugucaccaguucaaucagcacccauuggu

SEQ ID NO: 3938 - RNA, 972 nt, Artificial Sequence
  derived and/or modified CDS sequence (wt) from CCHFV(ROS/HUVLV-100)__DQ206448.1__Gn
uccgaggagccaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauaccaucaacagggugaagucauucaagcuaugcgaaaacagcgccacagggaaaaccugugagauagacagcacuccgguuaagugcaggcaagguuuuuguuuaaaaaucacccaagagggaaggggccacguaaaauuaucuagaggcucagagguuguuuuggaugcuugcgacucaagcugcgaaguaaugauaccuaaaggcacuggagauauccugguggacuguucagguggacagcaacauuucuuaaaagacaacuuaauugaccuagggugcccccauaucccgcuauuggguaaaauggccauuuacaucugcagaaugucaaaucauccuagaacaacuauggcuuuucucuucugguucagcuuuggcuaugugaucaccuguauauuuugcaaggcucuuuuuuauucauugauaauuauugggacacuagggaaaaagaucaagcaauauagggaauugaaaccucaaacuuguaccauaugugagacagccccugucaaugcaauagacgcugaaaugcaugaccuuaacugcaguuacaauauaugcccuuauugugcaucaagauugaccuccgaugggcuagcuaggcaugugccacaaugccccaagcggaaggaaaaaguugaggagacugagcuguacuugaaccuggaaagaauuccuuggauugucagaaagcuauugcaagugucagaguccacugguguggcauugaaacgaagcagcuggcugauuguacugcuuguguuacucacaguuucauugucaccgguucaaucagcaccuguuggu

SEQ ID NO: 3939 - RNA, 972 nt, Artificial Sequence
  derived and/or modified CDS sequence (wt) from CCHFV(AP92)__DQ211625.1__Gn
ucagaagggggugauggaggcugcaucucaagaacucaacugauaaaaacagaaacugcggaggugcacggagacgauuacgguggaccuggcgagaaaauuaccaucugcaaugguucaaccaucguugaucagagguuagguagugaacugggguguuacacaauuaacagaauaaaaucuuucaaacuaugcgagaauagugcccagggcaagaacugugagauagacagugcaccaguacaaugcaggcaagguuauugcuugaaaauuagucaagagggaagaggacaugugaaacuuuccagggguucagaaauuguucuagauguuugugacacaagcugugagauaaugauuccuaagggcacaggugacaucuuaguagacugcucaggagggcagcagcauuuucuacagagcaacuuaguugaccuggguuguccgaacauuccgcugcugggcaagauggcuauuuauauuugcagaaugucaaaucacccuaaaacaaccauggcuuuccuuuuuugguucagcuuuggcuacgugaucacuuguauauugugcaagacacuuuuuuacauacuuauaauuauugggacauuagggaaaaaauuaaagcaguacagagagcugaaaccccaaacauguaccauaugugaaucaguaccgguuaaugcaauagaugcugaaaugcaugaccucaacugcagcuacaacauaugcccuuauugugccuccagacucaccucagaggggcucacuagacaugugaaccagugccccaaaaggaaagagaagguagaagagacagaguuauaccugaaccuggaaaggauccccuggauuguuaggaagcuccuacagguaucugagucaacagguguggccuuaaaaagaagcagcuggaugaucgugcuccucauauuacugauagucucuaugucaccgguucaaucugcaccaauaagu

SEQ ID NO: 3940 - RNA, 972 nt, Artificial Sequence
  derived and/or modified CDS sequence (wt) from CCHFV(ArD8194)__DQ211626.1__Gn
gcagagggggggagcaaugauuguguuucaagaacccagcuagucaaaacagagguugcagaaauucaugaagacaguuacggugguccuggcgaaaaaaucacaauuugcaacggcuccacaauaguggaucaaaggcuuggcagcgaauuagguugcuauacaauaaacagagugagaaccuauaagcucugugagaacagugccacagaaaagagcugugaaauagacaguguuccaguuaaaugcaaacagggguucugccucaaaauaacucaggaagguaggggccaugugaaauugucuagagggacagaaaucguuuuggaugucugugauacuagcugugaacugaugauacccaaaggcacuggggauauauugguggacugcucaggagggcagcaacacuuuuuacaggacaaucuaauugacuugggaugcccaaauauuccauugcuaggucgaacagcuauauauguuuguagaaugucaaaccaucccaagacaaccauggcuuuucuguuuugguucaguuuuggcuaugucaucacauguguagugugcaaggugcucuucuauuugcuaauugucaucgggacacuaggaaaaaggcugaaacaguacagagagcuaaagccucaaacauguauugucugugaaucuaucccugucaaugcaauagaugcugaaaugcacgaucuuaacugcaacuacaacauaugcccuuacugugcauccagacugaccucagauggucucgucaggcacguaacucaaugucccaaacggaaagagaaggucgaagaaacugaacuauacuuaaaccuggagagaauaccuugguuggugagaaaacuccuacaagugucggagucaacaggaguggcucuaaagagaagcugcuggaugaucacacuccuuauucugcugacuguuucaaugucaccaguucaguccgcaccaguaggc

SEQ ID NO: 3941 - RNA, 972 nt, Artificial Sequence
  derived and/or modified CDS sequence (wt) from CCHFV(ArD15786)__DQ211627.1__Gn
gcagagggggggagcaaugacuguguuucaagaacccagcuagucaaaacagagguuacagaaauucaugaagacaguuacggugguccuggcgaaaaaaucacaauuugcaacggcuccacaauaguggaucaaaggcuuggcagcgaauuagguugcuauacaauaaacagagugagaaccuauaagcucugugagaacagugccacagaaaagagcugugaaauagacaguguuccaguuaaaugcaaacagggguucugccucaaaauaacucaggaagguaggggucaugugaaauugucuagagggacagaaaucguucuggaugucugugauacuagcugugaacugaugauacccaaaggcacuggggauauauugguggacugcucaggagggcagcaacacuuuuuacaggacaaucuaauugacuugggaugcccaaauauuccauugcuaggucaaacggcuauauaugucuguagaaugucaaaccaucccaagacaaccauggcuuuucuguuuugguucaguuuuggcuaugucaucacauguguagugugcaaggugcucuucuauuugcuaauugucaucgggacacuaggaaaaaggcugaaacaguacagagagcuaaagccucaaacauguauugucugugaaucuaucccugucaaugcaauagaugcugaaaugcaugaucuuaacugcaacuacaacauaugcccuuacugugcauccagacugaccucagauggccucgucaggcacguaacucaaugucccaaacggaaagagaaggucgaagaaacugaacuauacuuaaacuuggagagaauaccuugguugguaagaaagcuccuacaagugucggagucaacaggaguggcucugaagagaagcugcuggauaaucacacuccuuauucugcugacuguuucaaugucaccaguucaguccgcaccgguaggc

SEQ ID NO: 3942 - RNA, 972 nt, Artificial Sequence
  derived and/or modified CDS sequence (wt) from CCHFV(ArD39554)__DQ211628.1__Gn
ucagaaagcaacaacaaugauugcguaucaaggacucagcugaucaagacagaaaaugcugaaauacauggugaugacuauggcgggcccggagagaaaauaaccaucugcaacggcucuacuauuguagaacaaagauuaggcagcgaauuaggaugcuacacuaucaacagaauaaaguccuucaaacuaugcgaaaauagugcuucaggaaaggguugugaaauugacaguacuccaguaaaauguaagcaaggcuucuguuugaaaauaacccaagaaggaaggggucauguuaaacuuuccagaggcucagagauaauucuagacguuugcgacucaagcugugaaaugaugauaccaaaagggucuggugauauccugguagauugcucuggaggacagcagcacuuccuacaggacaacuuggucgacuuaggaugcccaaacguuccccuacugggcaaaauggccauauacaucugcagaaugucaaaccaccccaagacaaccauggccuuccucuuuugguucagcuuuggcuaugucauaaccugcaucuuuugcaagguuaucuuuuaugugcuaauaauaauuggaacauuaggaaaaaggaucaaacaguacagagagcuuaagccucagaccugcacuauaugugaagcaacuccuguuaaugcaauagaugcugaaaugcaugaucuuaacuguagcuacaacauaugcccuuauugcgcaucuagauuaacuucagaaggucugguuaggcaugugacucaguguccuaagaggaaggaaaagauagaggaaacagagcuguacuuaaauuuggaaaggauacccugguuugucagaaagcucuugcagguaucagaaucaacagggguagcgcucaagagaagcagcuggcuggugacacuucuuguguugcuaacaguaucuuugucgccugugcaaucagcacccauuggu

SEQ ID NO: 3943 - RNA, 972 nt, Artificial Sequence
  derived and/or modified CDS sequence (wt) from CCHFV(Drosdov)__DQ211630.1__Gn
ucugaagagccaggugacgacugcauaucaagaacucagcuauugaagacagaaacagcagagauccaugacgacaacuauggugguccaggugacaaaauaacuaucugcaaugguucaaccauuguggaucagagacugggcagugaacuaggguguuauaccaucaacagggugaagucauucaagcuaugcgaaaacagugccacagggaaaaccugugagauagacagcacuccggucaagugcaggcaagguuuuuguuugaaaaucacccaagagggaaggggccacguaaaauuauccaggggcucagagguuguuuuggaugcuugcgacucgagcugugaaguaaugauaccuaaaggcacuggagauauccuaguagacuguucagguggacagcagcauuucuuaaaagacaacuugauugaccuagggugcccucauaucccgcuauuggguaagauggccauuuacauuugcagaaugucaaaucaucccaggacaaccauggcuuuccucuucugguucaguuuuggcuauguaaucaccuguauauuuugcaaggcucuuuuuuacucauugauaauuauugggacacuagggaaaaaaaucaagcaauauagggagcugaaaccucaaacuugcaccauaugugagacagcuccugucaaugcaauagaugcugaaaugcaugaccucaaauguaguuacaauauaugcccuuauugugcaucaagauugaccucugaugggcuagcuaggcaugugacacaaugcccuaagcgaaaggagaaaguugaggagacugaacuguacuugaaccuggaaagaauuccuuggauagucagaaagcuauugcaagugucagaguccacugguguagcauugaaacgaagcaguuggcugauugugcugcuuguguuacucacagucucauugucaccgguucaaucagcaccuguuggu

SEQ ID NO: 3944 - RNA, 972 nt, Artificial Sequence
  derived and/or modified CDS sequence (wt) from CCHFV(Oman)__DQ211632.1__Gn
uccgaagagucuggugaagacuguauaucaaggacucagcuauugaggacagaaacugcagaaauccauggugauaacuauggugguccaggugacaaaauaaccaucugcaaugguucaaccauuguagaucaaaggcuggguagugaacugggguguuacacuaucaauagggugaagucauuuaagcuaugcgaaaacagugccacagguaaguccugugaaauagauaacacuccaguaaaaugcaagcaagguuuuugcuugaaaauaacccaagaaggaaggggccacgugaagcuuucaagagacucagaaguuguccuggacgccugcgauucaagcugugaaauaaugauaccaaagggcacuggagacauccugguugacugcucaggugggcagcagcacuucuuaaaagacaaccugauugaucugggaugccccaacaucccauuauuaggcaaaauggcaaucuacauuuguagaaugucaaaucauccuaaaacaacuauggcuuuucuuuuuugguuuagcuuugguuaugugauaaccugcauacuuuguaaagucauuuuuuaucuauugauaguuguuggaacuuuagggaaaaaguuuaaacaguauagagaguuaaaaccucagaccugcacaauaugugaaacaacuccugucaaugcaauagaugcugagaugcacgaucucaauuguaguuacaauauauguccuuauugugcaucuagguuaacuucagauggucuugccagacauguaaugcaguguccuaagcggaaggaaaaaauagaagaaaccgaauuauaccugaacuuagaaagaaucccuuggguugucagaaaacuacugcaggugucagaauccacugguguagcacuaaagaggagcaguuggcugauugugcuacuugugcuucucacaguuucauugucaccaguacaaucagcaccuaucggu

SEQ ID NO: 3945 - RNA, 972 nt, Artificial Sequence
  derived and/or modified CDS sequence (wt) from CCHFV(SPU97/85)__DQ211633.1__Gn
uccgaggagucugauggugacuguauaucaagaacucaacuauugaggacagagacugcagaaauccacagugacaacuaugguggcccaggugacaaaauaacuaucugcaaugguucaacuauuguagaucaaagacuaggcagugaacugggguguuauacuaucaauaggguaaagucauuuaagcuuugcgaaaacagugccacaggaaaaucuugugaaauagauagcaccccaguuaagugcagacaagguuuuugcuugaaaaucacucaagaagggaggggccacgugaagcugucgagaggcucagaaauugucuuggacgccugcgauucaagcugugaaauaaugauaccaaagggcaccggagacaucuuaguugacuguucagguggacaacaacauuucuuaaaagauaauuugauugaucuuggaugucccaauaucccauuauuaggcagaauggccaucuacauuugcagaauguccaaucauccuaaaacaaccauggccuuucucuuuugguuuagcuuugguuaugugauaaccuguauccuuuguaaggugaucuuuuaccuauugauaguugcagggacaguagggaaaaaguucaaacaguauagagaguugagaccucagaccugcaccauaugugaaacaacuccugucaaugcaauagaugcugaaaugcaugaccucaacugcaguuacaauauauguccuuauugcgcaucuagauuaaccucagauggucuugccagacauguaaugcaaugccccaagcggaaggaaaaaauagaggaaacugaauuauacuuaaaccuagaaaggauucccuggguuguuaggaaauuauugcaaguuucagagucuaccgguguggcauugaagaggagcaguuggcugacagugcugcuuguguugcuuauaguuucauugucaccggugcagucagcaccuauuggu

SEQ ID NO: 3946 - RNA, 972 nt, Artificial Sequence
  derived and/or modified CDS sequence (wt) from CCHFV(SPU103/87)__DQ211634.1__Gn
uccgaggagucuagcgacgacuguauaucaagaacucaacuauugaggacagagacugcagagauccacggcgauaacuaugguggcccaggugacaagauaaccaucugcaauggcucaacuauuguagaccagagacuggguagugagcugggguguuacacuaucaauagaguaaagacauucaaacuaugcgaaaacagugcuacagggaagaguugugaaauagauagugucccaguuaaaugcaggcaggguuauugccuaaaaaucacucaggaaggaaggggucauguaaaauuaucuagaggcucagagguugucuuagaugcaugugacacaagcugugaaguaaugauacccaaaggcacuggugacauccuaguugacuguucaggugggcagcaacauuuucugaaagacaaucugauagaucuaggaugccccaaaauuccauugcuggguaaaauggcuauuuauauuugcagaaugucgaaucaccccaaaacaacuauggcuuuccucuucugguucagcuuuggcuaugugauaacuuguguacuuugcaaggccauuuuuuacuuguuaauaauuguuggaacacuaggaaaaaggcucaagcaguacagagaguuaaaaccucagaccugcaccauaugugagacaacuccugugaaugcaauagaugcugagaugcaugaccucaauugcaguuacaacauaugucccuauugugcaucuagacuaaccucagacgggcuugcuaggcaugugacacagugcccuaagcggaaggaaaaaguggaggaaacugaauuguacuugaacuuggaaagaauuccuuggguugugagaaggcuguugcagguaucagaguccacugguguggcauugaaaagaagcagcuggcugauugugcuacuggugcuguucacgguuucauugucaccgguucagucagcgcccauuagu

SEQ ID NO: 3947 - RNA, 972 nt, Artificial Sequence
  derived and/or modified CDS sequence (wt) from CCHFV(SPU415/85)__DQ211635.1__Gn
uccgaggagucugauggugacuguauaucaagaacucaacuauugaggacagagacuacagaaauccacagugacaacuaugguggcccaggugacaaaauaacuaucugcaaugguucaacuauuguagaucaaagacuaggcagugaacugggguguuauacuaucaauagggugaagucauuuaagcuuugcgaaaacagugccacaggaaaaucuugugaaauagauagcaccccaguuaagugcagacaagguuuuugcuugaaaaucacucaagaagggaggggccacgugaagcugucgagaggcucggaaauugucuuggacgcuugcgauucaaacugugaaauaaugauaccaaagggcaccggagacaucuuaguugacuguucagguggacaacaacauuucuuaaaagauaauuugauugaucuuggaugucccaauaucccauuauuaggcaaaauggccaucuacauuugcagaauguccaaucauccuaaaacaaccauggccuuucucuuuugguuuagcuuugguuaugugauaaccuguauacuuuguaaggugaucuuuuaccuauugauaguugcagggacaguaggaaaaaaguucaaacaguauagagaguugagaccucagaccugcaccauaugugaaacaauuccugucaaugcaauagaugcugaaaugcaugaccucaacugcaguuacaauauauguccguauugcgcaucuagauuaaccucagauggucuugccagacauguaaugcaaugcccuaagcggaaggaaaaaguagaggaaacugaauuauacuuaaaccuagaaaggauucccuggguuguuaggaaauuauugcaaguuucagagucuaccgguguggcauugaagaggagcaguuggcugacagugcugcuuguguugcuuauagucucauugucaccggugcagucagcaccuauuggu

SEQ ID NO: 3948 - RNA, 972 nt, Artificial Sequence
  derived and/or modified CDS sequence (wt) from CCHFV(Turkey200310849)__DQ211636.1__Gn
uccgaagagccaggugaugacugcauaucaagaacucagcuauugaggacagaaacagcagagauccaugaugacaacuauggugguccaggugauaaaauaacuaucugcaacgguucaaccauuguagaucagagacugggcagugaacuaggguguuauaccaucaacagggugaagucauucaagcuaugcgaaaacagcgccacagggaaaaccugugagguagacagcacuccgguuaagugcaggcaagguuuuuguuuaaaaaucacccaagagggaaggggccacguaaaauuaucuagaggcucagagguuguccuggaugcuugcgacucaagcugugaaguaaugauaccuaaaggcacuggggauauccuaguggacuguucaggugggcagcaacauuucuuaaaagacaacuuaauugaccuagggugcccccauaucccgcuauuggguaagauggcuauuuacauuugcagaaugucaaaucauccuagaacaaccauggcuuuucucuucugguucagcuuuggcuauguuaucaccuguauaucuugcaaggcucuuuuuuauucauugauaauuauuggaacacuaggaaaaaagaucaagcaauauagggaacugaaaccucaaaccugcaccauaugugagacagcuccugucaaugcaauagaugcugaaaugcaugaccucaacuguaguuacaauauaugcccuuauugugcaucaagauugaccuccgaugggcuagccaggcauguaacgcaaugccccaagcggaaagagaagguugaagagacugaacuguaccugaaccuggaaagaauuccuuggauugucagaaagcuauugcaggugucagaguccacugguguggcauuaaaacgaagcagcuggcugauuguacugcuuguguuacuaacaguuucauugucaccgguucaaucagcaccuguuggu

SEQ ID NO: 3949 - RNA, 972 nt, Artificial Sequence
  derived and/or modified CDS sequence (wt) from CCHFV(Kosova Hoti)__EU037902.1__Gn
uccgaagagccaggugaugauugcauaucaaggacucagcuauugaggacagaaacagcagagauccaugacgauaacuauggugguccaggugacaaaauaacuaucugcaaugguucaaccauuguagaucagagacugggcagugaacuaggguguuacaccaucaacagggugaagucauucaagcuaugcgaaaacagcgccacagggaaaaccugugagauagacagcacuccaguuaagugcaggcaagguuuuuguuuaaaaaucacccaaaagggaaggggccacguaaaauuaucuagaggcucagagguugucuuggacgcuugcgacucaaacugugaaguaaugauaccuaaaggcacuggagauauccuaguggacuguucagguggacagcagcauuucuuaaaagacaacuugauugaccuggggugcccucauaucccacuauuggguaagauggccauuuacauuugcagaaugucaaaucauccuaaaacaaccauggcuuuucucuucugguucagcuuugguuaugugaucaccuguauauuuugcaaggcucuuuuuuauucauugauaauuauugggacacuaggaaaaaagaucaagcaauauagggaacugaaaccucaaacuugcaccauaugugaaacagcuccugucaaugcaauagaugcugaaaugcaugaccucaacuguaguuacaauauaugcccuuauugugcaucaagauugaccuccgaugggcuagcuaggcauguaaagcaaugcccuaagcgaaaggagaaagucgaggagacugagcuguaccugaaccuggaaagaauuccuugggucgucagaaagcuauugcaagugucagaguccacugguguggcauugaaacgaagcaguuggcugauugugcugcuuguguuacucacaguuucauugucaccgguucaaucagcaccuguuggu

SEQ ID NO: 3950 - RNA, 972 nt, Artificial Sequence
  derived and/or modified CDS sequence (wt) from CCHFV(YL04057)__FJ562094.1__Gn
gcagaaggaggaagcagugacugcauuucaagaacucagcuaguuaaaacagagguugcagaaauucaugaggacaguuacggugggccuggugagaaaauaacaaucugcaaugguuccacaauuguagaucaaaggcuugguagggaauugggcuguuauacaaucaacagaguaagauccuacaagcuaugcgagaacagugccucagggaaaagcugugaaauagauagcaucccagucaaaugcaaacaaggguuuugccucaaaauaacccaagaaggaagaggucauguaaaacuguccagagggacagaaauuguucuagaugucugugauuccagcugugagcugaugauaccuaagggcacuggagacauuuuaguggauugcucaggagggcagcagcauuuuuuacaaaacaaucugauugacuugggaugccccaaugucccacuacuggguaaaauggccauauaugucugcaggaugucaaaccacccaaaaacuaccauggcauuucuguucugguucagcuuuggcuaugucauuacauguauagcaugcaggguacucuucuacuugcugauugccaucggaacaguagggaaaaagcuaaaacaguauagagagcugaaaccacaaacaugcauuguuugugaaucugucccuguuaaugcaauagaugcugaaaugcaugagcuuaauugcaguuacaauauaugcccauacugugcaucuagacugucuacagacgggcucaucaggcacguaacucagugucccaaacggagggagaagguggaagagacugagcuauucuugaacuuggaaagaauaccuuggcuggugagaaagcuccuucaaguaucagagucaacaggaauggcucuaaagaggagcuguuggaugaucacacuccucauucuacuauugguuucgauaucaccaguccaaucugcaccgguaggc

SEQ ID NO: 3951 - RNA, 972 nt, Artificial Sequence
  derived and/or modified CDS sequence (wt) from CCHFV(V42/81)__GU477490.1__Gn
uccaaagagccaggugaugacuguauaucaagaacucagcuaaugaggacagaaacagcagagauccaugaugacaacuauggugguccaggugauaaaauaacuaucugcaaugguucaaccauuguggaucagagacugggcagugaacuaggguguuauaccaucaacagggugaagucauucaagcuaugugaaaacagcgccacagggaaagccugugaaguggacagcacuccgguuaagugcaggcaggguuuuuguuuaaaaaucacccaagagggaaggggccauguaaaguuaucuagaggcucagagguugucuuggaugcuugcgacucaagcugugaaguaaugauaccuaaaggcacuggagauauccuaguggacuguucagguggacagcaacauuucuuaaaggacaacuuaauugaccuagagugcccucauaucccgcuauuagguaaguuggccauuuacauuugcagaaugucaaaucauccuagaacaacuauggcuuuucucuucugguucggcuuuggcuaugugaucaccuguauacucugcaaggcucuuuuuuauucauugauaauuauugggacacuagggaaaaagaucaagcaauauagggaacugaaaccucaaacuugcaccauaugugagacagcuccugucaaugcaauagaugcugaaaugcaugaccuuaacuguaguuacaauauaugcccuuauugugcaucaagauugaccuccgaugggcuagcuaggcauguaacgcaaugccccaagcgaaaagagaaaguugaggagacugaacuguacuugaaucuggagagaauuccuuggauugucaggaagcuccugcaagugucggaguccacuggcgugguauugaaacgaagcaguuggcugauugugcugcuuguguuacucacaguuucauugucaccaguucagucagcaccuguuggu

SEQ ID NO: 3952 - RNA, 972 nt, Artificial Sequence
  derived and/or modified CDS sequence (wt) from CCHFV(Afg09-2990)__HM452306.1__Gn
uccgaagaaucuggugaugacugcauaucaagaacucagcuauugaggacagagacugcagagguccauggcgauaacuauggugguccaggugauaagauaaccaucuguaaugguucaacuguuguagaucaaagacuggguagugaacugggguguuacacuaucaauagagugaggucauucaagcuaugcgaaaacagugccacagggaagagcugugaaauagacaguaucccagucaaguguaagcaggguuauugccuuaaaaucacucaggaaggaaggggccaugugaaguuaucuagaggcucagaaguugucuuggauguaugugauucaagcugugaagugaugauaccuaagggcacuggugacauucuaguagauuguucaggugggcagcaacauuauuuaaaagacaaccugguugaccuagggugucccaaaauuccguuacugggcaaaauggcuauuuauaucugcaggaugucgaaucaccccaagacaaccauggccuuccucuuuugguucagcuuuggcuaugugauaacuuguauacuuugcaaggccauuuuuuucuuauugauaauuuuuggaacacuagggaaaagguucaagcaguacagagaguugaaaccccagaccugcaccauaugugagacaacaccuguaaaugcaauagaugcugaaaugcaugaucucaacugcaguuacaauauaugucccuauugugcgucuagacugacuucagaugggcuugcuaggcauguaacacaauguccuagacggaaggagaaaguggaggaaaccgaauuauaccugaauuuagagagaauucccuggguuguaagaaagcuauugcaggugucagaguccacugguacaguauuaaaaaggagcagcuggcuaauuguauuacuugugcuguucacaguuucauugucaccaguucaaucagcacccauuggu

SEQ ID NO: 3953 - RNA, 972 nt, Artificial Sequence
  derived and/or modified CDS sequence (wt) from CCHFV(Sudan Al-Fulah 3-2008)__HQ378184.1__Gn
uccgaagaacccagugaugacugcauaucaagaacucaacuauugaggacagagacugcagaaauccacggcgacaacuaugguggcccgggugacaaaauaaccaucugcaacggcucaacuauuguagaccaaagacugggcagugaguuaggguguuacacuaucaauagagugaagucauucaagcuaugugaaaauagugccacugggaagagcugugugauagacagugucccaguuaaaugcaggcaggguuauugccuaaggauuacucaagaaggaaggggccauguaaaauuaucuaggggcucagagguugucuuagaugcaugcgauacaagcugugaaauaaugauaccuaagggcaccggugacauccuaguugacuguucaggugggcagcaacauuuucuaaaggacaauuugguagaucuaggaugccccaaaaucccauuacugggcaaaauggcuaucuacauuugcagaaugucgaaucaccccaaaacaaccauggcuuuccucuucugguucagcuuuggcuauguaauaacuuguauacuuugcaaggccaucuuuuacuuguuaauaauuauuggaacacuagggaaaagguucaggcaguauagagaguuaaagccucagaccugcaccauaugugagacaacuccuguaaaugcaauagaugcugagaugcaugaccucaauugcaguuacaacauuugucccuacugugcaucuagacuaaccucggaugggcuugcuaggcaugugacacagugcccuaagcggaaggagaaaguggaagaaacugaacuguacuugaacuuagaaagaauuccuuggguugugagaaagcuguugcagguaucagaguccaccgguguggcauugaaaagaagcagcuggcugauugugcugcuugugcuguucacgguuucauugucgccaguucaaucagcacccauuggu

SEQ ID NO: 3954 - RNA, 972 nt, Artificial Sequence
  derived and/or modified CDS sequence (wt) from CCHFV(Sudan AB1-2009)__HQ378187.1__Gn
ucugaagaacccagugaugacuguauaucaagaacucaacuacugaggacagagacugcagagauccacggcgauaacuaugguggcccgggugacaaaauaaccaucugcaauggcucaacuauuguagaccaaagacugggcagugaacuaggguguuacaccaucaauagaguaaagucauucaagcuaugcgaaaacagugccacagggaagaauugugaaauagacagugucccaguuaaaugcaggcaggguuauugccuaagaaucacucaggaagggaggggccacguaaaauuaucuaggggcucagagguugucuuagaugcaugcgacacaagcugugaaauaaugauaccuaagggcacuggugacauccuaguugacuguucaggcgggcagcaacauuuucuaaaggacaauuugauagaucuaggaugccccaaaauuccauuauugggcaaaauggcuauuuacauuugcagaaugucgaaccaccccaaaacaaccauggcuuuccucuucugguucagcuuuggcuauuuaauaaccugcauacuuugcaaggccauuuuuuacuuguugauaauuauuggaacacuagggaaaaggcucaagcaguauagagaguugaaaccucagaccugcaccauaugugagacaacuccuguaaaugcaauagaugcugagaugcaugaccucaauugcaguuacaacauuugccccuacugugcaucuagacuaaccucagaugggcuugcuaggcaugugauacaaugcccuaagcggaaggagaaaguggaagaaacugaacuguacuugaaccuagaaagaauuccuuggguuguaagaaagcuguugcaggugucagagucaacugguguagcauugaaaagaagcaguuggcugauugugcugcuugugcuauucacuguuucauugucaccaguucaaucagcacccauuggu

SEQ ID NO: 3955 - RNA, 972 nt, Artificial Sequence
  derived and/or modified CDS sequence (wt) from CCHFV(NIVA 118595)__JN572083.1__Gn
uccgaagaaucuggugaugacugcauaucaagaacucagcuauuaaggacagagacugcagagguccauggcgacaacuauggugguccgggugauaagauaaccaucugcaaugguucaacuguuguagaucaaagacuggguagugaacugggguguuacacuaucaauagagugaaguccuuuaagcuaugcgaaaacagugccacagggaagagcugugaaauagacaguaucccaguuaaguguaggcaggguuauugccuaaaaaucacucaggaaggaaggggccauguuaaauuaucuagggguucagaaguugucuuggaugcaugugacucaagcugugaagugaugauaccuaagggcacuggugacauucuaguagauuguucaggugggcagcaacauuuuuuaaaggacaaccugauugaucuaggaugucccaaaauuccauuauugggcaaaauggcuauuuauaucugcagaaugucgaaucaccccaaaacaaccauggccuuucucuuuugguucagcuucggcuaugugauaacuuguauacuuugcaagguaauuuuuuacuuauuaauaauuuuuggaacacuagggaaaagguucaagcaguacagagaguugaaaccccagaccugcaccauaugugagacaacaccugugaaugcaauagaugcugaaaugcaugaucuuaacugcaguuacaauauaugucccuauugugcgucuaggcuaacuucagaugggcucgcuaggcauguaacacaaugcccuaagcggaaggagaagguggaagagaccgaauuguacuugaacuuagagagaauuccuuggguuguaagaaagcuauugcaggugucagaguccacuggcauagcauuaaaaaggagcagcuggcuaauugugcugcuuguguuauucacaguaucaauaacaccgguucaaucagcgcccauuggu

SEQ ID NO: 3956 - RNA, 972 nt, Artificial Sequence
  derived and/or modified CDS sequence (wt) from CCHFV(SCT ex Afghanistan)__KC344856.1__Gn
ucugaagagucuggugacgacuguauaucgaggacucagcuauugaggacagagacugcagagguccauaaugauaacuauggugguccaggugacaaaauuaccaucugcaacgguucaaccauuguagaucagagacuuggcagugaacugggguguuauacuaucaacagagugaagucauucaagcuaugcgaaaauagcgccacgggaaaguccuguaaaauagacagcaccccgguuaagugcaggcaagguuuuugcuuaaaaaucacucaggaaggaaggggccaugugaagcuaucgagaggcucagaaguugucuuagaugccugcgauucaagcugugaaauaaugauaccgaagggcacuggagacauccuaguggacuguucaggugggcagcaacauuucuuaaaagauaauuugauugaucuaggaugcccuaacauuccacuauuagguaaaauggcuaucuauauuuguagaaugucaaaucaucccaaaacaacuauggcuuuucucuuuugguucaguuuugguuauguaauaacauguauauuuugcaaagucauuuuuuauuuauugauaguuguggggacauugggaaaaaaguucaaacaguaucgagagcugaaaccucagacuuguacaauaugugaaacaacuccuaccaaugcaauagaugcugaaaugcacgaucuuaacugcaguuacaauauauguccuuauugugcaucuagauuaaccucggacgggcuugccaggcaugugacacaaugcccuaagcgaaaggaaaaaguagaagagacugaguuguacuugaacuuggaaagaauuccuuggauugucagaaaacuacugcaggugucagagucuacagguguggcacugaagaggagcaguuggcuaauuguguuacuugugcuacuuacaguuucauugucaccgguucaaucggcacccaucggg

SEQ ID NO: 3957 - RNA, 972 nt, Artificial Sequence
  derived and/or modified CDS sequence (wt) from CCHFV(Zahedan 2007)__KC867273.1__Gn
uccgaagaaucuggugaugacugcauaucaagaacucagcuauugaggacagagacugcagagguccauggcgauaacuauggugguccaggugauaagauaaccaucuguaaugguucaacuguuguagaucaaagacuggguagugaacugggguguuacacuaucaauagagugaggucauucaagcuaugcgaaaacagugccacagggaagagcugugaaauagacaguaucccagucaaguguaagcaggguuuuugccuaaaaaucacucaggaaggaaggggccaugugaaguuaucuagaggcucagaaguugucuuggauguaugugauucaagcugugaagugaugauaccuaagggcacuggugacauucuaguggauuguucaggugggcagcaacauuuuuuaaaagacaaccugguugaccuagggugucccaaaauuccguuacugggcaaaauggcuauuuauaucugcaggaugucgaaucaucccaagacaaccauggccuuccucuuuugguucagcuuuggcuaugugauaacuuguauacuuugcaaggccauuuuuuucuuauuaauaauuuuuggaacacuagggaaaagguucaagcaguacagagaguugaaaccccagaccugcaccauaugugagacaacaccuguaaaugcaauagaugcugaaaugcaugaucucaacugcaguuacaauauaugucccuauugugcgucuagacugacuucagauggacuugcuaggcaugugacacaauguccuagacggaaggagaaaguggaggaaaccgaauuauaccugaauuuagaaagaauucccuggguuguaagaaagcuauugcaggugucagaguccacugguacaguauuaaaaaggagcagcuggcuaauuguauuacuugugcuguucacaguuucauugucaccaguucaaucagcacccauuggu

SEQ ID NO: 3958 - RNA, 972 nt, Artificial Sequence
  derived and/or modified CDS sequence (wt) from CCHFV(SPU 44/08)__KJ682805.1__Gn
ucugaagagucuaaugaugacuguuuaucaaggacucagcuauugaggacagagaaugcggaaauucacagugacaacuauggugguccaggugacaagauaacuaucugcaacgguucaacuauuguagaucagagauugggcagugaacuaggguguuacacuaucaauagagugaaaucauuuaagcucugcgaaaacagugcuacagguaaaucuugugaaauagauagcaccccagucagauguaggcaggguuuuugcuugaaaauuacucaggagggaaggggccacgugaagcuaucaagaggcucagaaguugucuuggacgccugugacucaagcugugaaauaaugauaccaaagggcacuggggacauccuaguugacugcucaggugggcagcaacauuuccuaaaagauaaccugguugauuuaggaugccccaacaucccacuguuaggcaaaauggccaucuacauuuguagaaugucaaaucaucccaagacaacuauggcuuuccuuuuuugguuuagcuuugguuaugugauaaccuguauacuuuguaaagcaaucuucuaucuauuaauaguuguagggacauuaggaaaaaaguucaaacaguacagagaguuaaaaccucagaccuguaccauaugugaaacaaauccuguuaaugcaauagaugcugagaugcacgaccucaacugcaguuacaauauauguccuuauugugcaucuagguuaaccucagauggucuugccagacauguaaugcaaugccccaaacggaaggaaaaaauagaagaaaccgaauuauauuuaaacuuagaaagaaucccuuggguuguuaggaaauuacugcaggugucagaauccaccgguguagcacuaaagaggaguaguuggcugguuauacuacuugugcugcucacaguuucauugucaccaguacaaucagcacccaucagc

SEQ ID NO: 3959 - RNA, 972 nt, Artificial Sequence
  derived and/or modified CDS sequence (wt) from CCHFV(SPU 383/87)__KJ682806.1__Gn
ucugaagagucuaaugaugacuguuuaucaaggacucagcuauugaggacagagaaugcggaaauucacagugacaacuauggugguccaggugacaagauaacuaucugcaacgguucaacuauuguagaucagagauugggcagugaacuaggguguuacacuaucaauagagugaaaucauuuaagcucugcgaaaacagugcuacagguaaaucuugugaaauagauagcaccccagucagauguaggcaggguuucugcuugaaaauuacucaggagggaaggggccacgugaagcuaucaagaggcucagaaguugucuuggacgccugcgacucaagcugugaaauaaugauaccaaagggcacuggggacauccuaguugacuguucaggugggcagcaacauuuccuaaaagauaaccugguugauuuaggaugccccaacaucccacuguuaggcaaaauggcaaucuacauuuguagaaugucaaaucaucccaagacaacuauggcuuuccuuuuuugguuuagcuuugguuaugugauaaccuguauacuuuguaaaguaaucuucuaucuauuaguaguuguagggacauuagggaaaaaguucaaacaguacagagaguuaaaaccucagaccuguaccauaugugaaacgaauccuguuaaugcaauagaugcugagaugcacgaccucaacugcaguuacaauauauguccuuauugugcaucuagguuaaccucagauggucuugccagacauguaauacaaugccccaaacggaaggaaaaaauagaagaaaccgaauuauauuuaaacuuggaaagaaucccuuggguuguuaggaaauuacugcaggugucagaauccaccgguguagcacuaaagaggaguaguuggcugguuauacuacuugugcuacucacaguuucauugucaccaguacaaucagcaccuaucagc

SEQ ID NO: 3960 - RNA, 972 nt, Artificial Sequence
  derived and/or modified CDS sequence (wt) from CCHFV(SPU 130/89)__KJ682807.1__Gn
ucugaagagccuaauuaugacuguuuaucaaggacucagcuauugaggacagagaaugcggaaauucacagugacaacuauggugguccaggugacaagauaacuaucugcaacgguucaacuauuguagaucagagauugggcagugaacuaggguguuacacuaucaauagggugaaaucauuuaagcucugcgaaaacagugcuacagguaaaucuugugaaauagauagcaccccagucagauguaggcaggguuuuugcuugaaaauuacucaggagggaaggggccacgugaagcuaucaagaggcucagaaguugucuuggacgccugugacucaagcugugaaauaaugauaccaaagggcacuggggacauccuaguugacuguucaggugggcagcaacauuuccuaaaagauaaccugguugauuuaggaugccccaacaucccacuguuaggcaaaauggccaucuacauuuguagaaugucaaaucaucccaagacaaccauggcuuuccuuuuuugguuuagcuuugguuaugugauaaccugcauacuuuguaaaguaaucuucuaucuauuaauaguuguagggacauuaggaaaaaaguucaaacaguacagagaguuaaaaccucagaccuguaccauaugugaaacgaauccuguuaaugcaauagaugcugagaugcaugaccucaacugcaguuacaauauauguccuuauugugcaucuagguuaaccucagauggucuugccagacauguaaugcaaugccccaaacggaaggaaaaaauagaagaaaccgaauuauauuugaacuuagaaagaaucccuuggguuguuaggaaauuacugcaggugucagaauccaccgguguagcacuaaagaggaguaguuggcugguuguacuacuugugcuacucacaguuucauugucaccaguacaaucagcaccuaucagc

SEQ ID NO: 3961 - RNA, 972 nt, Artificial Sequence
  derived and/or modified CDS sequence (wt) from CCHFV(SPU 497/88)__KJ682808.1__Gn
ucugaagagucuaacgaugacuguuuaucaaggacucagcuauugaggacagagaaugcggaaauucacagugacaacuauggugguccaggugacaagauaacuaucugcaacgguucaacuauuguagaucagagacugggcagugaacuaggguguuacaccaucaauagagugaaaucauuuaagcucugcgaaaacagugcuacagguaaaucuugugaaauagauagcaccccagucagauguaggcaggguuuuugcuugaaaauuacucaggagggaaagggccacgugaagcuaucaagaggcucagagguuguccuggacgccugugauucaagcugugaaauaaugauaccaaagggcacaggggacauccuaguugacuguucaggugggcagcaacauuuccuaaaagauaaccugguugaucuaggaugccccaacaucccacuguuaggcaaaauggccaucuacauuuguagaaugucaaaucaucccaagacaacuaugguuuuccuuuuuugguuuagcuuuggcuaugugauaaccuguauacuuuguaaaguaaucuucuaucuauuaauaguuguagggacguuaggaaaaaaguucaaacaguacagagaguuaaaaccucagaccuguaccauaugugaaacaaacccuguuaaugcaauagaugcugagaugcacgaccucaacugcaguuacaauauauguccuuauugugcaucuagguuaaccucagauggucuugccagacauguaaugcaaugccccaaacggaaggaaaaaauagaagaaaccgaauuauauuuaaacuuagaaagaaucccuuggguuguuaggaaauuacugcaggugucagaauccaccgguguagcacuaaagaggaguaguuggcugguuauacuacuugugcuacucacaguuucauugucaccaguacaaucagcaccuaucagc

SEQ ID NO: 3962 - RNA, 972 nt, Artificial Sequence
  derived and/or modified CDS sequence (wt) from CCHFV(SPU 18/88)__KJ682810.1__Gn
ucugaagagucuaaugaugacuguuuaucaaggacucagcuauugaggacagaaaaugcggaaauucacagugacaacuauggugguccaggugacaagauaacuaucugcaacgguucaacuauuguagaucagagacugggcagugaacuaggauguuacacuaucaauagagugaaaucauuuaagcucugugaaaacagugcuacagguaaaucuugugaaauagauagcaccccagucagauguaggcaggguuuuugcuugaaaauuacucaggagggaaggggccacgugaagcuaucaagaggcucagaaguugucuuggacgccugugauucaagcugugaaauaaugauaccaaagggcacuggggacauccuaguugacuguucaggugggcagcaacauuuccuaaaagauaaccugguugaucuaggaugccccaacaucccacuguuaggcaaaauggccaucuacauuuguagaaugucaaaucaucccaagacaacuauggguuuccuuuuuugguuuagcuuugguuaugugauaaccuguauacuuuguaaaguaaucuucuaucuauuaauaguuguagggacauuagggaaaaaguucaaacaguacagagaguuaaaaccucagaccuguaccauaugugaaacgaauccuguuaaugcaauagaugcugagaugcacgaccucaacuguaguuacaauauauguccuuauugugcaucuaggcugaccucagauggucuugccagacauguaaugcaaugccccaaacggaaggaaaaaauagaagaaaccgaauuauauuuaaacuuagaaagaauccccuggguuguuaggaaauuacugcaggugucagaauccaccgguguagcacuaaagaggaguaguuggcugguuauacuacuugugcuacucacaguuucauugucaccaguacaaucagcaccuaucagc

SEQ ID NO: 3963 - RNA, 972 nt, Artificial Sequence
  derived and/or modified CDS sequence (wt) from CCHFV(SPU 48/90)__KJ682813.1__Gn
uccgaagaacccagugaugacugcauaucaagaacucagcuauugaggacagagacugcagagauccacggcgacaacuaugguggcccgggugacaaaauaacuaucugcaauggcucaacuauuguagaccaaagacugggcagugagcuaggguguuacacuaucaacagagugaagucauucaagcuaugcgaaaauagugccacagggaagagcuguguaauagacagugucccaguuaaaugcaggcaagguuauugucuaagaaucacucaggaaggaaggggccauguaaaauuaucuaggggcucagagguugucuuagaugcaugcgauacaagcugugaaauaaugauaccuaagggcaccggugacauccuaguugacuguucaggugggcagcaacauuuucuaaaggacaauuugauagaucuaggaugccccaaaauuccauuauugggcaaaauggcuaucuacauuugcagaaugucgaaucaccccacaacaaccauggcuuuccucuucugguucagcuuuggcuauguaauaacuuguauacuuugcaaggccaucuuuuacuuguuaauaauuauuggaacacuagggaaaagguucaggcaguauagagaguuaaaaccucagaccugcaccauaugugagacaacuccuguaaaugcaauagaugcugagaugcaugaccucaauugcaguuacaacauuugucccuacugugcaucuagacuaaccucagaugggcuugcuaggcaugugacacagugcccuaagcggaaggagaaaguggaagaaacugaacuguacuugaacuuagaaagaauuccuuggguuguaagaaagcuauugcagguaucagaguccaccgguguggcauugaaaagaagcagcuggcugauugugcugcuugugcuguucacgguuucauugucgccaguucaaucagcacccauuggu

SEQ ID NO: 3964 - RNA, 972 nt, Artificial Sequence
  derived and/or modified CDS sequence (wt) from CCHFV(SPU 187/90)__KJ682814.1__Gn
uccgaagaaccuagugaugacugcauaucgagaacucaacuauugaggacagagacugcagagauccacggcgacaacuaugguggcccgggugacaaaauaaccaucugcaacggcucaacuauuguagaccaaagacugggcagugagcuaggguguuacacuaucaauagagugaagucauucaagcuaugcgaaaauagugccacagggaagagcugugaaauagacagugucccaguuaaaugcaggcaggguuauugccuaagaaucacucaggaagggaggggccauguaaaauuaucuaggggcucagagguugucuuagaugcaugcgauacaagcugugaaauaaugauaccuaagggcacuggugacauccuaguugacuguucaggugggcagcaacauuuucuaaaggacaauuugauagaucuaggaugccccaaaauuccauuauugggcaaaauggcuauuuacauuugcagaaugucgaaucaccccaaaacaaccauggcuuuccuuuucugguucagcuuuggcuacguaauaacuuguauacuuugcaaggccaucuuuuacuuguuaauaauuauuggaacgcuagggaagagguucaagcaguauagagaguuaaaaccucagaccugcaccauaugugagacaacuccuguaaaugcaauagaugcugagaugcaugaccucaacugcaguuacaacauuugucccuacugugcaucuagacuaaccucagaugggcuugcuaggcaugugacacaaugcccuaagcggaaggagaaaguggaagaaacugaacuauacuugaacuuagaaagaauuccuuggguuguaagaaagcuguugcagguaucagaguccacugguguggcauugaaaagaagcagcuggcugauugugcugcuugugcuguucacgguuucauugucaccaguucaaucagcacccauuggu

SEQ ID NO: 3965 - RNA, 972 nt, Artificial Sequence
  derived and/or modified CDS sequence (wt) from CCHFV(Haskovo-V46/13)__KR092379.1__Gn
uccgaagagcuaggugaugacuguauaucaagaacucagcuauugaggacagaaacagcagagauacaugaugacaacuauggugguccaggugauaaaauaacuaucugcaaugguucaaccauuguagaucagagacugggcagugaacuaggauguuauaccaucaacagggggaagucauucaagcuaugcgaaaacagcgcuacagggaaaaccugugagauagacagcacuccgguuaagugcaggcaagguuuuuguuuaaaaaucacccaagagggaaggggccacguaaaauuaucuagaggcucagagguuguccuggaugcuugcgacucaagcugugaaguaaugauaccuaaaggcacuggagauauccuaguggacuguucaggugggcagcaacauuucuuaaaagacaacuuaauugaccuagggugcccccauaucccgcuauuggguaagauggcuauuuacauuugcagaaugucuaaucauccuagaacaaccauggcuuuucucuucugguuuagcuuuggcuaugugaucacuuguauauuuugcaaggcucuuuuuuauucauugauaauuauugggacacuagggaaaaaaaucaagcaauauagggaacugaaaccucaaaccugcaccauaugugagacaacuccugucaaugcaauagaugcugaaaugcaugaccucaacuguaguuacaauauaugcccuuauugugcaucaagauugaccuccgaugggcuagccaggcauguaacacaaugccccaagcggaaagagaaaguugaggagacugaacuguaccugaaccuggaaagaauuccuuggauugucagaaagcuauugcaggugucagaguccaccgguguggcauugaaacgaagcagcuggcugauuguacugcuuguguuacucccaguuucauugucgccgguucaaucagcaccuguuggu

SEQ ID NO: 3966 - RNA, 972 nt, Artificial Sequence
  derived and/or modified CDS sequence (wt) from CCHFV(24-R-2012)__KR814856.1__Gn
uccgaggagccaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauaccaucaacagggugaagucauucaagcuaugcgaaaacagcgccacagggaaaaccugugagauagacagcacuccgguuaagugcaggcaagguuuuuguuuaaaaaucacccaagagggaaggggccacguaaaauuaucuagaggcucagagguuguuuuggaugcuugcgacacaagcugcgaaguaaugauaccuaaaggcacuggagauauccugguggacuguucagguggacagcaacauuucuuaaaagacaauuuaauugaccuagggugcccccauaucccgcuauuggguaaaauggccauuuacaucugcagaaugucaaaucauccuagaacaacuauggcuuuucucuucugguucagcuuuggcuaugugaucaccuguauauuuugcaaggcucuuuuuuauucauugauaauuauugggacacuagggaaaaagaucaagcaauauagggaauugaaaccucaaacuuguaccauaugugagacagcuccugucaaugcaauagacgcugaaaugcaugaccuuaacugcaguuacaauauaugcccuuauugugcaucaagauugaccuccgaugggcuagcuaggcaugugccacaaugccccaagcggaaggaaaaaguugaggagacugagcuguacuugaaccuggaaagaauuccuuggauugucagaaagcuauugcaagugucagaguccacugguguggcauugaaacgaagcagcuggcugauuguacugcuuguguuacucacaguuucauugucaccgguucaaucagcaccuguuggu

SEQ ID NO: 3967 - RNA, 972 nt, Artificial Sequence
  derived and/or modified CDS sequence (wt) from CCHFV(36-ST-2014)__KR814857.1__Gn
uccgaagagccaggugacgacugcauaucaagaacucagcuauugaagacagaaacagcagagauccaugacgacaacuauggugguccaggugacaaaauaacuaucugcaaugguucaaccauuguagaucagagacugggcagugaacuaggguguuauaccaucaacaggguaaagucauucaagcuaugcgaaaacagugccacagggaaaaccugugagauagacagcacuccggucaagugcaggcaagguuuuuguuugaaaaucacccaagaggggaggggccacguaaaauuauccaggggcucagagguuguuuuggaugcuugcgacucgagcugugaaauaaugauaccuaaaggcacuggagauauccuaguagacuguucagguggacagcaacauuucuuaaaagacaacuugauugaccuagggugcccucauaucccgcuauuggguaagauggccauuuacauuugcagaaugucaaaucaucccaggacaaccauggcuuuccucuucugguucaguuuuggcuauguaaucaccuguauauuuugcaaagcucuuuuuuauucauugauaauuauugggacacuaggaaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuagcuaggcaugugacacaaugcccuaagcgaaaggagaaaguugaggagacugaacuguauuugaaccuggaaagaauuccauggauagucagaaagcuguugcaagugucagaguccacugguguggcauugaaacgaagcagcuggcugauugugcugcuuguguuacucacagucucauugucaccgguucaaucagcaccuguuggu

SEQ ID NO: 3968 - RNA, 972 nt, Artificial Sequence
  derived and/or modified CDS sequence (wt) from CCHFV(44-ST-2010)__KR814859.1__Gn
uccgaagagccaggugacgacugcauaucaagaacucagcuauugaagacagaaacagcagagauccaugacgacaacuauggugguccaggugacaaaauaacuaucugcaaugguucaaccauuguagaucagagacugggcagugaacuaggguguuauaccaucaacaggguaaagucauucaagcuaugcgaaaacagugccacagggaaaaccugugagauagacagcacuccggucaagugcaggcaagguuuuuguuugaaaaucacccaagaggggaggggccacguaaaauuauccaggggcucagagguuguuuuggaugcuugcgacucgagcugugaaauaaugauaccuaaaggcacuggagauauccuaguagacuguucagguggacagcaacauuucuuaaaagacaacuugauugaccuagggugcccucauaucccgcuauuggguaagauggccauuuacauuugcagaaugucaaaucaucccaggacaaccauggcuuuccuccucugguucaguuuuggcuauguaaucaccuguauauuuugcaaagcucuuuuuuauucauugauaauuauugggacacuaggaaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuagcuaggcaugugacacaaugcccuaagcgaaaggagaaaguugaggagacugaacuguauuugaaccuggaaagaauuccauggauagucagaaagcuguugcaagugucagaguccacugguguggcauugaaacgaagcagcuggcugauugugcugcuuguguuacucacagucucauugucaccgguucaaucagcaccuguuggu

SEQ ID NO: 3969 - RNA, 972 nt, Artificial Sequence
  derived and/or modified CDS sequence (wt) from CCHFV(47-ST-2013)__KR814861.1__Gn
uccgaagagccaggugacgacugcauaucaagaacucagcuguugaagacagaaacagcagagauccaugacgacaacuauggugguccaggugacaaaauaacuaucugcaaugguucaaccauuguagaucagagacuggguagugaacuaggguguuauaccaucaacagggugaagucauucaagcuaugcaaaaacagugccacagggaaaaccugugagauagacagcacuccggucaagugcaggcaagguuuuuguuugaaaaucacccaagagggaaggggccacguuaaauuauccaggggcucagagguuguuuuggaugcuugcgacucgagcugugaaauaaugauaccuaaaggcacuggagauauccuaguagacugcucagguggacagcaacauuucuuaaaagacaacuugauugaccuagggugcccucauaucccgcuauuggguaagauggccauuuacauuugcagaaugucaaaucaucccaggacaaccauggcuuuccucuucugguucaguuuuggcuauguaaucaccuguauauuuugcaaggcucuuuuuuauucauugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagauugaccucugaugggcuagcuagacaugugacacaaugcccuaagcgaaaggagaaaguugaggagacugaacuguauuugaaccuggaaagaauuccuuggauagucagaaaguuauugcaagugucagaguccacugguguggcauugaaacgaagcaguuggcugauugugcugcuuguguuacucacagucucauugucaccgguucaaucagcaccuguuggu

SEQ ID NO: 3970 - RNA, 972 nt, Artificial Sequence
  derived and/or modified CDS sequence (wt) from CCHFV(52-R-2014)__KR814862.1__Gn
uccgaggagccaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauacuaucaacagggugaagucauucaagcuaugcgaaaacagcgccacagggaaaaccugugagauagacagcacuccgguuaagugcaggcaagguuuuuguuuaaaaaucacccaagagggaagaggccacguaaaauuaucuagaggcucagagguuguuuuggaugcuugcgacacaagcugcgaaguaaugauaccuaaaggcacuggagauauccugguggacuguucagguggacagcaacauuucuuaaaagacaauuuaauugaccuagggugcccccaugucccgcuauuggguaaaauggccauuuacaucugcagaaugucaaaucauccuagaacaacuauggcuuuucucuucugguucagcuuuggcuaugugaucaccuguauauuuugcaaggcucuuuuuuauucauugauaauuauugggacacuagggaaaaagaucaagcaauauagggaauugaaaccucaaacuuguaccauaugugagacagcuccugucaaugcaauagacgcugaaaugcaugaccuuaacugcaguuacaauauaugcccuuauugugcaucaagauugaccuccgaugggcuagcuaggcaugugccacaaugccccaagcggaaggaaaaaguugaggagacugagcuguacuugaaccuggaaagaauuccuuggauugucagaaagcuauugcaagugucagaguccacugguguggcauugaaacgaagcagcuggcugauuguacugcuuguguuacucacaguuucauugucaccgguucaaucagcaccuguuggu

SEQ ID NO: 3971 - RNA, 972 nt, Artificial Sequence
  derived and/or modified CDS sequence (wt) from CCHFV(75-R-2012)__KR814863.1__Gn
uccgaggagccaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauaccaucaacagggugaagucauucaagcuaugcgaaaacagcgccacagggaaaaccugugagauagacagcgcuccgguuaagugcaggcaagguuuuuguuuaaaaaucacccaagagggaaggggccacguaaaauuaucuagaggcucagagguuguuuuggaugcuugcgacucaagcugcgaaguaaugauaccuaaaggcacuggagauauccugguggacuguucagguggacagcaacauuucuuaaaagacaacuuaauugaccuagggugcccacauaucccgcuauuggguaaaauggccauuuacaucugcagaaugucaaaucauccuagaacaacuauggcuuuucucuucugguucagcuuuggcuaugugaucaccuguauauuuugcaaggcucuuuuuuauucauugauaauuauugggacacuagggaaaaagaucaagcaauauagggaauugaaaccucaaacuuguaccauaugugagacagccccugucaaugcaauagacgcugaaaugcaugaccuuaacugcaguuacaauauaugcccuuauugugcaucaagauugaccuccgaugggcuagcuaggcaugugccacaaugccccaagcggaaggaaaaaguugaggagacugagcuguacuugaaccuagaaagaauuccuuggauugucagaaagcuauugcaagugucagaguccacugguguggcauugaagcgaagcagcuggcugauuguacugcuuguguuacucacaguuucauugucaccgguucaaucagcaccuguuggu

SEQ ID NO: 3972 - RNA, 972 nt, Artificial Sequence
  derived and/or modified CDS sequence (wt) from CCHFV(75-ST-2010)__KR814864.1__Gn
uccgaagagucaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauaccaucaacagggugaagucauucaagcuaugcgaaaacagcgccacagggaaaaccugugagauagacagcacuccgguuaagugcaggcaagguuuuuguuuaaaaaucacccaagaaggaaggggccacguaaaauuaucuagaggcucagagguuguuuuggaugcuugcgacucaagcugcgaaguaaugauaccuaaaggcacuggagauaucuugguggacuguucagguggacagcaacauuucuuaaaagacaacuuaauugaccuagggugcccccauaucccgcuauuggguaaaauggccauuuacaucugcagaaugucaaaucacccuagaacaacuauggcuuuucucuucugguucagcuuuggcuaugugaucaccuguuuauuuugcaaggcucuuuuuuauucauugauaaucauugggacacuagggaaaaagaucaagcaauauagggaauugagaccucaaaccuguaccauaugugagacagcuccugucaaugcaauagaugcugaaaugcaugaccuuaacugcaguuacaauauauguccuuauugugcaucaagauugaccuccgaugggcuagcuaggcaugugccacaaugccccaagcggaaggaaaaaguugaggagacugagcuguacuugaaccuggaaagaauaccuuggauugucagaaagcuauugcaagugucagaguccacugguguggcauugaaacgaagcagcuggcugauuguacugcuuguguuacucacaguuucauugucaccgguucaaucagcaccuguuggu

SEQ ID NO: 3973 - RNA, 972 nt, Artificial Sequence
  derived and/or modified CDS sequence (wt) from CCHFV(3820-ST-2007)__KR814868.1__Gn
uccgaagagccaggugacgacugcauaucaagaacucagcuauugaagacagaaacagcagagauccaugacgacaacuaugguaguccaggugacaaaaucacuaucugcaaugguucaaccauuguagaucagagacugggcagugaacuaggguguuauaccaucaacagggugaagucauucaagcuaugcgaaaacagugccacagggaaaaccugugagauagacagcacuccggucaagugcaggcaagguuuuuguuugaaaaucacccaagagggaaggggccacguaaaauuauccaggggcucagagguuguuuuggaugcuugcgacucgagcugugaaauaaugauaccuaaaggcacuggagauauccuaguagacuguucagguggacagcaacauuucuuaaaagacaacuugauugaccuagggugcccucauaucccgcuauuggguaaaauggccauuuacauuugcagaaugucaaaucaucccaggacaaccauggcuuuccucuucugguucaguuuuggcuauguaaucaccuguauauuuugcaaggcucuuuuuuauucacugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuggcuaggcaugugacacaaugcccuaagcgaaaggagaaaguugaggagacugaacuguauuugaaccuggaaagaauuccuuggauagucagaaagcuauugcaagugucagaguccacugguguggcauugaaacgaagcaguuggcugauugugcugcuuguguuacucgcagucucauugucaccgguccaaucagcaccuguuggu

SEQ ID NO: 3974 - RNA, 972 nt, Artificial Sequence
  derived and/or modified CDS sequence (wt) from CCHFV(4701-ST-2009)__KR814872.1__Gn
uccgaagagccaggugacgacugcauaucaagaacucagcuauugaagacagaaacagcagagauccaugacgacaacuauggugguccaggugacaaaauaacuaucugcaaugguucaaccguuguagaucagagacugggcagugaacuaggguguuauaccaucaacagggugaagucauucaagcuaugcgaaaacagugccacagggaaaaccugugagauagacagcacuccgguuaagugcaggcaaggguuuuguuugaaaaucacccaagagggaaggggccacguaaaauuauccaggggcucagagguuguuuuggaugcuugcgacucaagcugugaaauaaugauaccuaaaggcacuggagauauccuaguagacuguucagguggacagcaacauuucuuaaaagacaacuugauugaccuagggugcccucauaucccgcuauuggguaaaauggccauuuacauuugcagaaugucaaaucaucccaggacaaccauggcuuuccucuucugguucaguuuuggcuauguaaucaccuguauauuuugcaaggcucuuuuuuauucauugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuggcuaggcaugugacacaaugcccuaagcgaaaagagaaaguugaggagacugaacuguauuugaaccuggaaagaauuccuuggauagucagaaagcuauugcaagugucagaguccacugguguggcauugaaacgaagcaguuggcugauugugcugcuuguguuacucacagucucauugucaccgguccaaucagcaccuguuggu

SEQ ID NO: 3975 - RNA, 972 nt, Artificial Sequence
  derived and/or modified CDS sequence (wt) from CCHFV(5170-R-2011)__KR814873.1__Gn
uccgaagagccaggugacgacugcauaucaagaacucagcuauugaagacagaaacagcagaaauccaugacgacaacuauggugguccaggugacaaaauaacuaucugcaaugguucaaccauuguagaucagagacugggcagugaacuaggguguuauaccaucaacagggugaagucauucaagcuaugcgaaaacagugccacagggaaaaccugugagauagacagcacuccggucaagugcaggcaagguuuuuguuugaaaaucacccaagagggaaggggccacguaaaauuauccaggggcucagagguuguuuuggauguuugcgacucgagcugugaaauaaugauaccuaaaggcacuggagauauccuaguagacuguucagguggacagcaacauuucuuaaaagacaacuugauugaccuagggugcccucauaucccgcuauuggguaaaauggccauuuacauuugcagaaugucaaaucaucccaggacaaccauggcuuuccucuucugguucaguuuuggcuauguaaucaccuguauauuuugcaaggcucuuuuuuauucauugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaagggcuagcuaggcaugugacacaaugcccuaagcgaaaggagaaaguugaggagacugaacuguauuugaaccuggaaagaauuccuuggauagucagaaagcuauugcaagugucagaguccacugguguggcauugaaacgaagcaguuggcugauugugcugcuuguguuacucacagucucauugucaccgguccaaucagcaccuguuggu

SEQ ID NO: 3976 - RNA, 972 nt, Artificial Sequence
  derived and/or modified CDS sequence (wt) from CCHFV(200406546-Turkey)__KR864902.1__Gn
uccgaagagccaggugaugacugcauaucaagaacucagcuauugaggacagaaacagcagagauucaugaugauaacuaugguggcccaggugauaaaauaacuaucugcaacgguucaacuauuguagaucagagacugggcagugaacuaggguguuauacuaucaacagggugaagucauucaagcuaugcgaaaacagcgccacagggaaaaccugugagauagacagcacuccaguuaagugcaggcaagguuuuuguuuaaaaaucacccaagagggaaggggccacguaaaauuaucuagaggcucagagguugucuuggacguuugcgacucaagcugugaaguaaugauaccuaaaggcacuggagauauccugguggacuguucagguggacagcaacauuucuuaaaagacaaccuaauugaccuagggugcccccaugucccgcuauuggguaggauggccauuuacauuugcagaaugucaaaucauccuagaacaacuauggcuuuucucuucugguucagcuuuggcuaugugaucaccuguauauuuugcaaggcucuuuuuuauucauugauaauuauugggacacuagggaaaaaguucaagcaguauagggaacugaaaccucaaacuuguaccauaugugagacggcuccugucaaugcaauagaugcugaaaugcaugaccuuaacugcaguuacaauauaugcccuuauugugcaucaagauugaccuccgacgggcuagcuaggcaugugccacaaugccccaagcggaaagaaaaaguugaggagacugaacuguacuugaaccuggagagaauuccuuggauugucagaaagcuauugcaggugucagaguccacugguguggcauugaaacgaagcagcuggcugauuguacugcuuguguuacucacaguuucguugucaccgguucaaucggcaccuguuggu

SEQ ID NO: 3977 - RNA, 972 nt, Artificial Sequence
  derived and/or modified CDS sequence (wt) from CCHFV(1-CR/HU-2015)__KU161584.1__Gn
uccgaagagccaggugaugacugcauaucaagaacucagcuauugaggacagaaacagcagagauccaugacgacaacuacggcgguccaggugacaaaauaacuaucugcaaugguucaaccaucguagaucagagacugggcagugaacuaggguguuauaccaucaacagggugaagucauucaagcuaugcgaaaacagcgcuacagggaaaaccugugagauagacagcacuccggucaagugcaggcaagguuucuguuuaaaaaucacccaagagggaaggggccacguaaaauuaucuagaggcucagagguugucuuggaugcuugcgacucaagcugugaagugaugauaccuaaaggcaccggagauauccuaguagacuguucagguggacagcagcauuuuuuaaaagacaacuugauugaccuagggugcccccacaucccgcuauuggguaagauggccauuuacauuugcagaaugucaaaucauccuaggacaaccauggcuuuucucuucugguucagcuuuggcuaugugaucaccuguauauuuugcaaggcucuuuuuuauucauuaauaauuauugggacacuagggaaaaagaucaagcaguauagagaacuaaaaccucaaacuuguacuauaugugagacagcuccugucaaugcaauagaugcugaaaugcaugaccucaacuguaguuacaauauaugcccuuauugugcaucaagacugaccucugaugggcuagcuaggcauguaacgcaaugcccuaagcgaaaggagaaaguugaggagacugaacuguacuugaaccuagaaagaauuccuuggaucgucagaaagcuauugcaagugucagaguccacugguguggccuugaaacgaagcaguugguugauugugcugcuuguguuacucacaguuucauugucaccgguucaaucagcaccuguuggu

SEQ ID NO: 3978 - RNA, 972 nt, Artificial Sequence
  derived and/or modified CDS sequence (wt) from CCHFV(Gaib)__KX013445.1__Gn
uccgaagaauccagugaugacugcauaucaagaacucagcuauuaaggacagagacugcagaaauccauaaugauaauuauggagggccaggugacaaaauaacuauuuguaaugguucaacuauuguagaucaaaggcuaggcagugaacugggauguuacacuaucaauagaguaaagucauuuaagcuaugcgaaaacagugcuacagggaaauccugugaaauagauagcaucccuguaaagugcaggcaaggguuuuguuuaaaaauuacucaggagggaagaggccaugugaaguugucaagagguucagaaguugucuuagaugccugugauucaagcugugaaauaaugauaccaaaaggcaccggagacauccuaguggacuguucaggugggcaacaacauuuuuuaaaggauaacuugauugacuuagggugucccaauaucccacuguuaggcaaaauggcuaucuacauuuguagaaugucuaaucaucccaaaacaaccauggccuuucucuuuugguuuaguuuugguuaugugauaaccuguauauuuugcaaagccaucuuuuauuuguugauaaucguggggacacuuggaaaaaaguucaaacaguauagagaguuaaaaccucagaccuguaccauaugugaaacaacuccugucaacgcaauagacgcugaaaugcaugaucuuaacugcaguuacaauauaugcccuuauugugcaucuagauuaaccucagauggacuugccagacacguugugcacugcccuaagcggaaggagaaaauagaagagacugaacuguacuuaaacuuagaaagaguuccuuggguuguuagaaaacuacuucaggugucugaaucaacugguguggcacugaagaggagcaguuggcuaauugugcuacuugugcuacuuacagucucauugucaccaguucaaucagcacccaucggu

SEQ ID NO: 3979 - RNA, 972 nt, Artificial Sequence
  derived and/or modified CDS sequence (wt) from CCHFV(Hodzha)__KX013448.1__Gn
ucugaagaaucuggugacgacugcauaucaagaacucagcuacugaggacagagacugcagagauccauggugaugauuauggugguccgggcgacaagauuaccauuugcaaugguucaacuauuguagaucaaagacuagguagugaacugggguguuacacuaucaauagagugaagucauucaagcugugcgaaaacagugcaacagggaagagcugugaaauagacagcaccccaguuaaaugcaggcaggguuauugccuaaaaaucacucaggaaggaaggggccaugugaaauuauccaggggcucggagguugucuuggaugcaugcgauucaagcugugaaguaaugauaccuaagggcacaggugacauccuaguagacuguucaggugggcagcaacauuuuuugaaagacaacuuaauugaucuaggaugucccagaauuccauuauuagguaaaauggcuauuuauauuugcagaaugucgaaucacccugagacaaccauggcuuuccucuuuugguucaguuucggcuaugugauaaccuguauacucugcaaggccauuuucuacuuauuaauaauuguuggaacacuagggaagagguucaagcaguauagagaguuaaaaccccagaccuguaccauaugugagacaacuccugcaaaugcaauagaugcugaaaugcaugaccuuaacugcaguuacaacauaugucccuauugugcaucuagacuaaccucagaugggcuugcuaggcaugugacacaaugcccuaagcggaaggagaagguagaagaaacugaauuguacuugaacuuagagagaauucccuggauuguaagaaagcuguugcaggugucggaguccacugguguugcauuaaaaagaagcagcuggcugauugugcugcuugugcuguucgcaguuucauuaucaccuguucaaucagcacccauuggu

SEQ ID NO: 3980 - RNA, 972 nt, Artificial Sequence
  derived and/or modified CDS sequence (wt) from CCHFV(IbAn7620)__KX013451.1__Gn
uccgaagaacccagugaugacuguauaucaagaacucaacuauugaggacagagacugcagagauccacggcgacaacuaugguggcccgggugauaaaauaaccaucugcaauggcucaacuauuguagaccaaagacugggcagugaacuaggguguuacaccaucaauagagugaagucauucaagcuaugcgaaaacagugccacagggaagaauugugaaauagacagugucccaguuaaaugcaggcaggguuauugccuaagaaucacucaagaagggaggggccacguaaaauuaucuaggggcucagagauugucuuagaugcaugcgauacaagcugugaaauaaugauaccuaagggcacuggugacauccuaguugacuguucaggugggcagcaacauuuucuaaaggacaauuugauagaucuaggaugcccuaaaauuccauuauugggcaaaauggcuauuuacauuugcagaaugucgaaccaccccaaaacaaccauggcuuuccucuucugguucagcuuugguuauguaauaaccuguauacuuugcaaggccauuuuuuacuuguuaauaauuauuggaacacuagggaaaaggcucaagcaguauagagaguugaaaccucagaccugcaccauaugugagacaacuccuguaaaugcaauagaugcugagaugcaugaccucaauugcaguuacaacauuugucccuacugugcaucuagacuaaccucagaugggcuugcuaggcaugugauacaaugcccuaagcggaaggagaaaguggaagaaacugaacuguacuugaacuuagaaagaauuccuuggguuguaagaaagcuguugcaggugucagagucaacugguguggcauugaaaagaagcaguuggcugauugugcugcuugugcuauucacuguuucauuaucaccaguucaaucagcacccauuggu

SEQ ID NO: 3981 - RNA, 972 nt, Artificial Sequence
  derived and/or modified CDS sequence (wt) from CCHFV(K128_76)__KX013454.1__Gn
ucugaugaaucuggugaugacugcauaucaaggacucagcuguugagaacagagacugcagagauccauggugacaauuauggugguccgggugacaagauuaccauuugcaaugguucaacuauuguagaccaaagacuggguagugaacugggguguuacacuaucaauagagugaagucauucaagcugugcgaaaacagugccacagggaagagcugugaaauagacaguaucccaguuaagugcaggcaggguuauugccuaaaaaucacucaagaaggaaggggccaugugaaauuauccaggggcucagagguugucuuggaugcaugcgacucaagcugugaaguaaugauaccuaagggcacaggugacauucuaguagacuguucaggugggcagcaacauuuuuugaaggacaacuugauugaccuaggaugucccaaaauuccauuguugggcaaaauggcuauuuauauuuguagaaugucgaaucaccccaaaacgaccauggcuuuccucuuuugguucaguuuuggcuaugugauaacuuguauagucugcaaagccauuuuuuacuuauuaauaauuguuggaacacuagggaagagguuuaagcaguauagagaguuaaaaccccagaccuguaccaucugugagacaacuccuacaaaugcaauagaugcugaaaugcaugaccuuaacugcaguuacaacauaugucccuauugugcaucuagacuaaccucagaugggcuugcuaggcauguaacucauugcccuaagcggaaggagaaaguagaagaaacugaauuguacuugaacuuagaaagaauuccauggguuguaagaaagcuauugcagguaucagaguccaccgguguagcauuaaaaagaagcagcuggcugauugugcugcuugugcuguuugcaguuucauuaucaccaguucaaucagcacccauuagu

SEQ ID NO: 3982 - RNA, 972 nt, Artificial Sequence
  derived and/or modified CDS sequence (wt) from CCHFV(K168_40)__KX013457.1__Gn
ucugaugagucuggugaugacugcauaucaaggacucagcuacugagaacagagacugcagagauccauggugacaauuauggugguccgggugacaagauuaccauuugcaaugguucaacuauuguagaccaaagacugggcagugaacugggguguuacacuaucaauagagugaagucauucaagcugugcgaaaacagugccacagggaagagcugugaaguagacaguaucccaguaaaaugcaggcaggguuauugccuaaaaaucacucaggaaggaaggggccacgugaaauuauccagagguucagagguugucuuggaugcaugcgauucaagcugugaaguaaugauaccuaagggcacaggugacauccuaguggacuguucaggugggcagcaacauuucuugaaggacaacuuaauugaccuaggaugucccaaaauuccauuguugggcaaaauggcuauuuauauuugcagaaugucgaaucaccccaagacaaccauggcuuuccucuuuugguucaguuuuggcuaugugauaacuuguauagucugcaaggccauuuuuuacuuauuaauaauuguuggaacacuagggaagagguuuaagcaguauagagaguuaaaaccccagaccugcaccaucugugagacaacuccuacaaaugcaauagaugcugaaaugcaugaccuuaacugcaguuacaacauaugucccuauugugcaucuagacuaaccucagaugggcuugcuaggcauguaacucauugcccuaagcggaaagagaaaguagaagaaacugaauuguacuugaacuuagagagaauucccuggguuguaagaaagcuguugcagguaucagaguccaccgguguagcauuaaaaagaagcagcuggcugauugugcugcuugugcuguuugcaguuucauuaucaccaguucaaucagcaccuauuggu

SEQ ID NO: 3983 - RNA, 972 nt, Artificial Sequence
  derived and/or modified CDS sequence (wt) from CCHFV(K168_125)__KX013460.1__Gn
ucugaugagucuggugaugacugcauaucaaggacucagcuacugagaacagagacugcagagauccauggugacaauuauggugguccgggugacaagauuaccauuugcaaugguucaacuauuguagaccaaagacugggcagugaacugggguguuacacuaucaauagagugaagucauucaagcugugcgaaaacagugccacagggaagagcugugaaguagacaguaucccaguaaaaugcaggcaggguuauugccuaaaaaucacucaggaaggaaggggccacgugaaauuauccagagguucagagguugucuuggaugcaugcgauucaagcugugaaguaaugauaccuaagggcacaggugacauccuaguggacuguucaggugggcagcaacauuucuugaaggacaacuuaauugaccuaggaugucccaaaguuccauuguugggcaaaauggcuauuuauauuugcagaaugucgaaucaccccaagacaaccauggcuuuccucuuuugguucaguuuuggcuaugugauaacuuguauagucugcaaggccauuuuuuacuuauuaauaauuguuggaacacuagggaagagguuuaagcaguauagagaguuaaaaccccagaccugcaccaucugugagacaacuccuacaaaugcaauagaugcugaaaugcaugaccuuaacugcaguuacaacauaugucccuauugugcaucuagacuaaccucagaugggcuugcuaggcauguaacucauugcccuaagcggaaagagaaaguagaagaaacugaauuguacuugaacuuagagagaauucccuggguuguaagaaagcuguugcagguaucagaguccaccgguguagcauuaaaaagaagcagcuggcugauugugcugcuugugcuguuugcaguuucauuaucaccaguucaaucagcaccuauuggu

SEQ ID NO: 3984 - RNA, 972 nt, Artificial Sequence
  derived and/or modified CDS sequence (wt) from CCHFV(K229_194)__KX013463.1__Gn
uccgaagagccaggugacgacugcauaucaagaacucagcuauugaagacagaaacagcagagauccaugacgacaacuauggugguccaggugacaaaauaacuaucugcaaugguucaaccauuguagaucagagacugggcagugaacuaggguguuauaccaucaacagggugaagucauucaagcuaugcgaaaacagugccacagggaaaaccugugagauagacagcacuccggucaagugcaggcaagguuuuuguuugaaaaucacccaagagggaaggggccacguaaaauuauccaggggcucagagguuguuuuggaugcuugcgacucgagcugugaaauaaugauaccuaaaggcacuggagauauccuaguagacuguucagguggacagcaacauuucuuaaaaggcaacuugauugaccuagggugcccucauaucccgcuauuggguaagauggccauuuacauuugcagaaugucaaaucaucccaggacaaccauggcuuuccucuucugguucaguuuuggcuauguaaucaccuguauauuuugcaaggcucuuuuuuauucauugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuagcuaggcaugugacacaaugcccuaagcgaaaggagaaaguugaggagacugaacuguauuugaaccuggaaagaauuccauggauagucagaaagcuguugcaaguaucagaguccacugguguggcauugaaacgaagcagcuggcugauugugcugcuuguguuacucacagucucauugucaccgguucaaucagcaccuguuggu

SEQ ID NO: 3985 - RNA, 972 nt, Artificial Sequence
  derived and/or modified CDS sequence (wt) from CCHFV(K315_14)__KX013469.1__Gn
uccgaagagccaggugacgacugcauaucaagaacucagcuauugaagacagaaacagcagaaauccaugacgacaacuauggugguccaggugacaaaauaacuaucugcaaugguucaaccguuguggaucagagacugggcagugaacuaggguguuauaccaucaacagggugaagucauucaagcuaugcaaaaacagugccacagggaaaaccugugagauagacagcacuccggucaagugcaggcaagguuuuuguuugaaaaucacccaagagggaaggggccacguaaaauuauccaggggcucagagguuguuuuggauguuugcgacucgagcugugaaauaaugauaccuaaaggcacuggagauauccuaguagacuguucagguggacagcaacauuucuuaaaagacaacuugauugaccuagggugcccucauaucccgcuauuggguaaaauggccauuuacauuugcagaaugucaaaucaucccaggacaaccauggcuuuccucuucugguucaguuuuggcuauguaaucaccuguauauuuugcaaggcucuuuuuuauucauugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaagggcuagcuaggcaugugacacaaugcccuaagcgaaaggagaaaguugaggagacugaacuguauuugaaccuggaaagaauuccuuggauagucagaaagcuauugcaagugucagaguccacugguguggcauugaaacgaagcaguuggcugauugugcugcuuguguuacucacagucucauugucaccgguccaaucagcaccuguuggu

SEQ ID NO: 3986 - RNA, 972 nt, Artificial Sequence
  derived and/or modified CDS sequence (wt) from CCHFV(K323_27)__KX013472.1__Gn
uccgaagagccaggugacgacugcauaucaagaacucagcuauugaagacagaaacagcagagauccaugacgacaacuauggugguccaggugacaaaauaacuaucugcaaugguucaaccauuguagaucagagacugggcagugaacuaggguguuauaccaucaacagggugaagucauucaagcuaugcgaaaacagugccacagggaaaaccugugagauagacagcacuccggucaagugcaggcaagguuuuuguuugaaaaucacccaagagggaaggggccacguaaaauuauccaggggcucagagguuguuuuggaugcuugcgacucgagcugugaaauaaugauaccuaaaggcacuggagauauccuaguagacuguucagguggacagcaacauuucuuaaaagacaacuugauugaccuagggugcccucauaucccgcuauuggguaaaauggccauuuacauuugcagaaugucaaaucaucccaggacaaccauggcuuuccucuucugguucaguuuuggcuauguaaucaccuguauauuuugcaaagcucuuuuuuauuuauugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuagcuaggcaugugacacaaugcccuaagcgaaaggagaaaguugaggagacugaacuguauuugaaccuggaaagaauuccuuggauagucagaaagcuauugcaagugucagaguccacugguguggcauugaaacgaagcaguuggcugacugugcugcuuguguuacucacagucucauugucaccgguccaaucagcaccuguuggc

SEQ ID NO: 3987 - RNA, 972 nt, Artificial Sequence
  derived and/or modified CDS sequence (wt) from CCHFV(K340_6)__KX013475.1__Gn
uccgaagagccaggugacgacugcauaucaagaacucagcuauugaagacagaaacagcagagauccaugacgacaacuauggugguccaggugacaaaauaacuaucugcaaugguucaaccauuguagaucagagacugggcagugaacuaggguguuauaccaucaacagggugaagucuuucaagcuaugcgaaaacaguaccacagggaaaaccugugagauagacagcacuccggucaagugcaggcaaggcuuuuguuugaaaaucacccaagagggaaggggccacguaaaauuauccaggggcucagagguuguuuuggaugcuugcgacucgagcugugaaauaaugauaccuaaaggcacuggagauauccuaguagacuguucagguggacagcaacauuucuuaaaagacaacuugauugaccuagggugcccucauaucccgccauuggguaaaauggccauuuacauuugcagaaugucaaaucaucccaggacaaccauggcuuuccucuucugguucaguuuuggcuauguaaucaccuguauauuuugcaaggcucuuuuuuauucauugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuggcuaggcaugugacacaaugcccuaagcgaaaggagaaaguugaggagacugaacuguauuugaaccuggaaagaauuccuuggauagucagaaagcuauugcaagugucagaguccacugguguggcauugaaacgaagcaguuggcugauugugcugcuuguguuacucacagucucauugucaccgguccaaucagcaccuguuggu

SEQ ID NO: 3988 - RNA, 972 nt, Artificial Sequence
  derived and/or modified CDS sequence (wt) from CCHFV(Mamon)__KX013478.1__Gn
uccgaggagccaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauaccaucaacagggugaagucauucaagcuaugcgaaaacagcgccacagggaaaaccugugagauagacagcacuccgguuaagugcaggcaagguuuuuguuuaaaaaucacccaagagggaaggggccacguaaaauuaucuagaggcucagagguuguuucggaugcuugcgacucaagcugcgaaguaaugauaccuaaaggcacuggagauauccugguggacuguucagguggacagcaacauuucuuaaaagacaacuuaauugaccuagggugcccccauaucccgcuauuggguaaaauggccauuuacaucugcagaaugucaaaucauccuagaacaacuguggcuuuucucuucugguucagcuuuggcuaugugaucaccuguauauuuugcaaggcucuuuuuuauucauugauaauuauugggacacuagggaaaaagaucaagcaauauagggaauugaaaccucaaacuuguaccauaugugagacagcuccugucaaugcaauagacgcugaaaugcaugaccuuaacugcaguuacaauauaugcccuuauugugcaucaagauugaccuccgaugggcuagcuaggcaugugccacaaugccccaagcggaaggaaaaaguugaggagacugagcuguacuugaaccuggaaagaauuccuuggauugucagaaagcuauugcaagugucagaguccacugguguggcauuaaaacgaagcagcuggcugauuguacugcuuguguuacucacaguuucauugucaccgguucaaucagcaccuguuggu

SEQ ID NO: 3989 - RNA, 972 nt, Artificial Sequence
  derived and/or modified CDS sequence (wt) from CCHFV(Nakiwogo)__KX013484.1__Gn
gcagaaggagugagcaaugacugcguuucaaggacccagcuaaucaaaacagaaguugcagagauucacgaagauagcuacggugggccuggagaaaaaauaacaaucugcaacggcuccacaaucguggaccaaaggcuugguagcgaacuagguugcuacacaauuaaccgcgugaagacuuauaagcuuugugagaacagugccacagaaaaggguugugagaucgauaguguuccagucaaaugcaaacaaggguucugccucaaaguaacccaagagggcaggggccaugugaaacuaucuagaggaacggaaauuguccuggaugugugugacaccaguugugaguugaugauaccuaaaggcacuggagacauauugguggauugcucaggaggacagcagcacuucuugcaggacaacuugauugacuuagguugcccaaauguaccauuacuaggcaagauggcaauauauaucugcaggaugucgaaccauccuaagaccaccauggcuuuuuuguucugguucaguuuuggcuaugucaucacaugcguaguaugcaaagugcucuucuaucugcuaauugucauugggacacuaggaaagaaacuuaaacaguauagggaacuaaaaccucagacaugcauugucugugaaucaaucccugucaauguaauagaugcugaaaugcacgagcucaauugcaauuacaauauaugcccauacugugcguccagacugacuucagauggacuaguuagacaugugacucaaugucccaaaaggaaggaaaaggucgaggagacugagcuguacuugaaccuggagaggauaccuugguugguaagaagacuacugcaagugucagagucaacagggauggcucuaaagagaaguugcuggaugaccacacuccucauucugcuaguaguuucauugucuccaguucaaucugcuccaguuggu

SEQ ID NO: 3990 - RNA, 972 nt, Artificial Sequence
  derived and/or modified CDS sequence (wt) from CCHFV(Saf)__KX013487.1__Gn
uccgaggagccaggugaugacugcauaucaagaacucagcuauugaggacagaaacagcagagauccaugaugacaacuauggugguccaggugauaaaauaacuaucugcaaugguucaaccauuguagaucagagacugggcagugaacuaggguguuauaccaucaacagggugaagucauucaagcuaugcgaaaacagcgccacagggaaaaccugugagauagacagcacuccgguuaagugcaggcaagguuuuuguuuaaaaaucacccaagagggaaggggccacguaaaauuaucuagaggcucagagguuguuuuggaugcuugcgacucaagcugcgaaguaaugauaccuaaaggcacuggagauauccugguggacuguucagguggacagcaacauuacuuaaaagacaacuuaauugaccuagggugcccccauaucccgcuauuggguaaaauggccauuuacaucugcagaaugucaaaucauccuagaacaacuauggcuuuucucuucugguucagcuuuggcuaugugaucaccuguauauuuugcaaggcucuuuuuuauucauugauaauuauugggacacuagggaaaaagaucaagcaauauagggaauugaaaccucaaacuuguaccauaugugagacggcuccugucaaugcaauagacgcugaaaugcaugaccuuaacugcaguuacaauauaugcccuuauugugcaucaagauugaccuccgaugggcuagcuaggcaugugccacaaugccccaagcggaaggaaaaaguugaggagacugagcuguacuugaaccuggaaagaauuccuuggauugucagaaagcuauugcaagugucagaguccacugguguggcauugaaacgaagcagcuggcugauuguacugcuuguguuacucacaguuucauugucaccgguucaaucagcaccuguuggu

SEQ ID NO: 3991 - RNA, 972 nt, Artificial Sequence
  derived and/or modified CDS sequence (wt) from CCHFV(Ast199)__KX056051.1__Gn
uccgaagagccaggugacgacugcauaucaagaacucagcuauugaagacagaaacagcagagauccaugacgacaacuauggugguccaggugacaaaauaacuaucugcaaugguucaaccauuguagaucagagacugggcagugaacuaggguguuacaccaucaacagggugaagucauucaagcuaugcgaaaacagugccacagggaaaaccugugagauagacagcacuccggucaagugcaggcaagguuuuuguuugaaaaucacccaagagggaaggggccacguaaaauuauccaggggcucagagguuguuuuggaugcuugcgacucgagcugcgaaauaaugauaccuaaaggcacuggagauauccuaguagacuguucagguggacagcaacauuucuuaaaagacaacuugauugaccuagggugcccucauaucccgcuauuggguaagauggccauuuacauuugcagaaugucaaaucaucccaggacaaccauggcuuuccucuucugguucaguuuuggcuauguaaucaccuguauauuuugcaaggcucuuuuuuauucauugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuagcuaggcaugugacacaaugcccuaagcgaaaggagaaaguugaggagacugaacuguauuugaaccuggaaagaauuccauggauagucagaaagcuguugcaagugucagaguccacugguguggcauugaaacgaugcagcuggcugauugugcugcuuguguuacucacagucucauugucaccgguucaaucagcaccuguuggu

SEQ ID NO: 3992 - RNA, 972 nt, Artificial Sequence
  derived and/or modified CDS sequence (wt) from CCHFV(Ast137)__KX056057.1__Gn
uccgaagagccaggugacgacugcauaucaagaacucagcuauugaagacagaaacagcagagauccaugacgacaacuauggugguccaggugacaaaauaacuaucugcaaugguucaaccauuguggaucagagacugggcagugaacuaggguguuauaccaucaacagggugaagucauucaagcuaugcgaaaacagugccacagggaaaaccugugagauagacagcacuccggucaagugcaggcaaggguuuuguuugaaaaucacccaagagggaaggggccacguaaaauuauccaggggcucagagguuguuuuggaugcuugcgacucgagcugugaaauaaugauaccuaaaggcacuggagauauccuaguagacuguucagguggacagcaacauuucuuaaaagacaacuugauugaccuagggugcccucauaucccgcuauuggguaagauggccauucacauuugcagaaugucaaaucaucccaggacaaccauggcuuuccucuucugguucaguuuuggcuauguaaucaccuguauauuuugcaaggcucuuuuuuauucauugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuagcuaggcaugugacacaaugcccuaagcgaaaggagaaaguugaggagacugaacuguauuugaaccuggaaagaauuccauggauagucagaaagcuguugcaagugucagaguccacugguguggcauugaaacgaagcagcuggcugauugugcugcuuguguuacucacagucucauugucaccgguucaaucagcaccuguuggu

SEQ ID NO: 3993 - RNA, 972 nt, Artificial Sequence
  derived and/or modified CDS sequence (wt) from CCHFV(Ast133)__KX056060.1__Gn
uccgaagagccagaugacgacugcauaucaagaacucagcuauugaagacagaaacagcagagauccaugacgacaacuauggugguccaggugacaaaauaacuaucugcaaugguucaaccauuguagaucagagacugggcagugaacuaggguguuauaccaucaacagggugaagucauucaagcuaugcgaaaacagugccacagggaaaacuugugagauagacagcacuccggucaagugcagacaagguuuuuguuugaaaaucacccaagagggaaggggccacguaaaauuauccaggggcucagagguuguuuuggaugcuugcgacucgagcugugaaauaaugauaccuaaaggcacuggagauauccuaguagacuguucagguggacagcaacauuucuuaaaagacaacuugauugaccuagggugcccucauaucccgcuauuggguaaaauggccauuuacauuugcagaaugucaaaucaucccaggacaaccauggcuuuccucuucugguucaguuuuggcuauguaaucaccuguauauuuugcaaggcucuuuuuuauuuauugauaauuauugggacacuagggaaaaaaaucaagcaauauagggagcuaaaaccucaaacuugcaccauaugugagacagcuccugucaaugcaauagaugcugaaaugcaugaccucaacuguaguuacaauauaugcccuuauugugcaucaagacugaccucugaugggcuagcuaggcaugugacacaaugcccuaagcgaaaggagaaaguugaggagacugaacuguauuugaaccuggaaagaauuccuuggauagucagaaagcuauugcaagugucagaguccacugguguggcauugaaacgaagcaguuggcugauugugcugcuuguguuacucacagucucauugucaccgguccaaucagcaccuguuggu

SEQ ID NO: 3994 - RNA, 972 nt, Artificial Sequence
  derived and/or modified CDS sequence (wt) from CCHFV(SK/2015/human)__KX458183.1__Gn
ucugaagaaucuggugaugacugcauaucaagaacucgccuauugagaacagagacugcagagauccauggugauagcuauggugguccaggugacaagauuacuauuugcaaugguucaacuauuguagaucaaagacuggguagugagaugggguguuacacuaucaauagagugaagucauucaagcugugcgaaaacagugcaacagggaagagcugugaaauagacaguaucccaguuaggugcaggcaggguuauugccuaaaaaucacucaggagggaaggggccaugugaaauuauccaggggcucagagguugucuuggaugcaugcgacucaagcugugaaguaaugauaccuaagggcacaggugacauccuuguagacuguucaggugggcagcaacauuuuuugaaggacaacuuaauugaucuaggaugucccaauauuccauuauuagguaaaauggcuauuuauauuugcagaaugucgaaucacccuaagacaaccauggcuuuucucuuuugguucaguuuuggcuaugugauaaccuguauacucugcaaggcuauuuucuacuuauuaauaauuguuggaacacuagggaagagguuuaagcaguacagagaguuaaaaccccagaccugcaccauaugugagacaacuccugcaaaugcaauagaugcugaaaugcaugaccuuaacugcaguuacaccauaugccccuauugugcaucuagacuaaccucagaugggcuugcuaggcaugugacacaaugcccuaagcggaaggagaaaguagaagaaacugaauuguaccugaacuuagagagaauucccuggguuguaagaaagcuguugcagguaucggaguccacugguguugcauuaaaaagaaguagcuggcugauugugcugcuuguguuguucacaguuucauuaucaccaguucaaucagcacccaucggu

SEQ ID NO: 3995 - RNA, 972 nt, Artificial Sequence
  derived and/or modified CDS sequence (wt) from CCHFV(YL16070)__KY354081.1__Gn
gcagaaggaggaagcagugacugcauuucaagaacucagcuaguuaaaacagagguugcagaaauucaugaggacaguuacggugggccuggugagaaaauaacaaucugcaaugguuccacaauuguagaucaaaggcuugguagugaauugggcugcuauacaaucaacagaguaaaauccuacaagcuaugcgagaacagugccucagggaaaagcugugaaauagauagcaucccagucaaaugcaaacaaggguuuugccucaaaauaacccaagaaggaagaggucauguaaaacuguccagagggacagaaauuguucuagaugucugugauuccagcugugagcugaugauaccuaagggcacuggagacauuuuaguggauugcucaggagggcaacagcauuuuuuacaaaacaaucugauugacuugggaugccccaaugucccauuacuggguaaaauggccauauaugucugcaggaugucaaaccacccaaaaacuaccauggcauuucuguucugguucagcuuuggcuaugucauuacauguauaguaugcaggguacucuucuacuugcugauugccaucggaacaguagggaaaaagcuaaaacaguauagagagcugaaaccacaaacaugcauuguuugugaaucugucccuguuaaugcaauagaugcugaaaugcaugagcuuaauugcaguuacaacauaugcccauacugugcuucuagacugucuacagacgggcucaucaggcacguaacucagugucccaaacggagggagaagguggaagagacugagcuauucuugaacuuggaaagaauaccuuggcuggugagaaagcuccuucaaguaucagagucaacaggaauggcucuaaagagaagcuguuggaugaucacacuccucauucuacuauugguuucgaugucaccaguccaaucugcaccgguaggc

SEQ ID NO: 3996 - RNA, 972 nt, Artificial Sequence
  derived and/or modified CDS sequence (wt) from CCHFV(UCCR4448)__KY484042.1__Gn
uccgaagaaaccagugaugacugcauaucaagaacucaacuauugaggacagagacugcagagauccacggcgacaacuaugguggcccgggugacaaaauaaccaucugcaacggcucaacuauuguagaccaaagacuaggcagugagcuaggguguuacacuaucaacagagugaagucauucaagcuaugcgaaaauagugccacagggaagagcugugaaauagacagugucccaguuaaaugcaggcaggguuauugccuaagaaucacucaggaagggaggggccauguaaaauuaucuaggggcucagagguugucuuagaugcaugugauacaagcugugaaauaaugauaccuaagggcacuggugacaucuugguugacuguucaggugggcagcaacauuuucuaaaggacaauuugauagaucuaggaugccccaaaauuccauuauugggcaaaauggcuauuuacauuugcagaaugucgaaucaccccaaaacaaccauggcuuuccucuucugguucagcuuuggcuacgugauaacuuguauacuuugcaaggccaucuucuacuuguuaauaauuauuggaacacuagggaaaagguucaagcaguauagagaguuaaaaccccagaccugcaccauaugugagacaacuccuguaaaugcaauagaugcugagaugcacgaccucaauugcaguuacaacauuugucccuacugugcaucuagacuaaccucagaugggcuugcuaggcauguaacacaaugcccuaagcggaaggagaaaguggaagaaacugaacuguacuugaacuuagaaagaauuccuuggguuguaagaaagcuguugcagguaucagaguccacugguguggcauugaaaagaagcagcuggcugauugugcugcuugugcuguucacgauuucauugucaccaguucaaucagcacccauuagu

SEQ ID NO: 3997 - RNA, 972 nt, Artificial Sequence
  derived and/or modified CDS sequence (wt) from CCHFV(SPU 45/88)__KJ682809.1__Gn
ucugaagagucuagugaugacuguuuaucaaggacucagcuauugaggacagagaauacggaaauucacagugacaacuauggugguccaggugacaagauaacuaucugcaacgguucaacuauuguagaucagagacugggcagugaacuaggguguuacacuaucaauagagugaaaucauuuaagcuuugcgagaacagugcuacagguaaaucuugugaaauagauagcaccccaguuagauguaggcaggguuuuugcuugaaaaucacucaggagggaaggggccacgugaagcuaucaagaggcucagaaguugucuuggacgccugugauucaagcugugaaauaaugauaccaaagggcacuggggacauccuaguugacuguucaggugggcagcaacauuucuuaaaagauaacuugguugaucuaggaugccccaacauuccacuauuaggcaaaauggccaucuacauuuguagaaugucaaaucaucccaagacaacuauggguuuucuuuuuugguuuagcuuugguuaugugauaaccuguauacuuuguaagguaaucuucuaucuauuaauaguuguagggacauuagggaaaaaguuuaaacaguacagagaguugaaaccucagaccuguaccauaugugaaacgacuccuguuaaugcaauagaugcugagaugcacgaccucaacugcaguuacaauauauguccuuauugugcaucuagguuaaccucagauggucuugccagacauguaaugcaaugccccaaacggaaggaaaaaauagaagaaaccgaauuauauuuaaacuuagaaagaauccccuggauuguuaggaaauuacugcaggugucagaauccaccgguguagcacuaaagaggaguaguugguugguuguacuacuugugcuacucacaguuucauugucaccaguacaaucagcaccuaucggc

SEQ ID NO: 3998 - RNA, 1932 nt, Artificial Sequence
  derived and/or modified CDS sequence (wt) from CCHFV(10200)__U39455.2__Gc
uuccuagauaguacagcuaaaggcaugaaaaaucugcuaaauucaacaaguuuagaaacgaguuuaucaauugaggcaccauggggagcaauaaauguucagucaaccuacaaaccaacugugucaacugcaaacauagcacucaguuggagcucaguggaacacagaggcaauaagaucuugguuucaggcagaucagaaucaauuaugaagcuggaagaaaggacaggaaucagcugggaucucgguguagaagaugccucugaaucuaaacugcuuacaguaucugucauggacuugucucagauguacucuccugucuucgaguacuuaucaggggacagacagguggaagaguggcccaaagcaacuugcacaggugacugcccagaaagauguggcugcacaucaucaaccuguuugcacaaagaauggccucacucaagaaauuggagaugcaaucccacuuggugcugggguguagggacuggcugcaccuguuguggauuagaugugaaagaccuuuuuacagauuauauguuugucaaguggaaaguugaauacaucaagacagaggccauaguguguguagaacuuacuagucaggaaaggcaguguagcuugauugaagcgggcacaagguucaauuuagguccugugaccaucacacugucagaaccaagaaacauccaacaaaaacucccuccugaaauaaucacacugcauccuaggaucgaagaagguuuuuuugaccugaugcaugugcaaaagguguuaucggcaagcacaguguguaaguugcagaguugcacacauggugugccaggagaccuacaggucuaccacaucggaaauuuauuaaaaggggauaagguaaauggacaucuaauucauaaaauugagccacacuucaacaccuccuggauguccugggaugguugugaccuagacuacuacugcaacaugggagauuggccuucuugcacauacacaggggucacccaacacaaucaugcuucauuuguaaacuuacucaacauugaaacugauuacacaaagaacuuccacuuucacucuaaaagggucacugcacacggagauacaccacaacuagaucuuaaggcaagaccaaccuauggugcaggcgagaucacuguucugguagaaguugcugacauggaguuacauacaaagaagauugaaauaucaggcuuaaaauuugcaagcuuagcuugcacagguuguuaugcuuguagcucuagcaucucaugcaaaguuagaauucauguggaugaaccagaugaacuuacaguacauguuaaaagugaugauccagaugugguugcagcuagcucaagucucauggcaaggaagcuugaauuuggaacagacaguacauuuaaagcuuucucggccaugccuaaaacuucucuauguuucuacauuguugaaagagaacacuguaagagcugcagugaagaagacacaaaaaaauguguuaacacaaaacuugagcaaccacaaagcauuuugaucgaacacaagggaacuauaaucggaaagcaaaacagcacuugcacggcuaaggcaaguugcugguuagagucagucaagaguuuuuuuuauggccuaaagaacaugcuuaguggcauuuuuggcaaugucuuuaugggcauuuucuuguuccuugcccccuucauccuguuaauacuauucuuuauguuuggguggaggauccuauucugcuuuaaauguuguagaagaaccagaggccuguucaaguauagacaccucaaagacgaugaagaaacugguuauagaaggauuauugaaaaacuaaacaauaaaaaaggaaaaaacaaacugcuugauggugaaagacuugcugauggaagaauugccgaacuguucucuacaaaaacacacauuggc

SEQ ID NO: 3999 - RNA, 1932 nt, Artificial Sequence
  derived and/or modified CDS sequence (wt) from CCHFV(IbAr10200)__AF467768.2__Gc
uuccuagauaguacagcuaaaggcaugaaaaaucugcuaaauucaacaaguuuagaaacgaguuuaucaauugaggcaccauggggagcaauaaauguucagucaaccuacaaaccaacugugucaacugcaaacauagcacucaguuggagcucaguggaacacagaggcaauaagaucuugguuucaggcagaucagaaucaauuaugaagcuggaagaaaggacaggaaucagcugggaucucgguguagaagaugccucugaaucuaaacugcuuacaguaucugucauggacuugucucagauguacucuccugucuucgaguacuuaucaggggacagacaggugggagaguggcccaaagcaacuugcacaggugacugcccagaaagauguggcugcacaucaucaaccuguuugcacaaagaauggccucacucaagaaauuggagaugcaaucccacuuggugcugggguguagggacuggcugcaccuguuguggauuagaugugaaagaccuuuuuacagauuauauguuugucaaguggaaaguugaauacaucaagacagaggccauaguguguguagaacuuacuagucaggaaaggcaguguagcuugauugaagcgggcacaagguucaauuuagguccugugaccaucacacugucagaaccaagaaacauccaacaaaaacucccuccugaaauaaucacacugcauccuaggaucgaagaagguuuuuuugaccugaugcaugugcaaaagguguuaucggcaagcacaguguguaaguugcagaguugcacacauggugugccaggagaccuacaggucuaccacaucggaaauuuauuaaaaggggauaagguaaauggacaucuaauucauaaaauugagccacacuucaacaccuccuggauguccugggaugguugugaccuagacuacuacugcaacaugggagauuggccuucuugcacauacacaggggucacccaacacaaucaugcuucauuuguaaacuuacucaacauugaaacugauuacacaaagaacuuccacuuucacucuaaaagggucacugcacacggagauacaccacaacuagaucuuaaggcaagaccaaccuauggugcaggcgagaucacuguucugguagaaguugcugacauggaguuacauacaaagaagauugaaauaucaggcuuaaaauuugcaagcuuagcuugcacagguuguuaugcuuguagcucuggcaucucaugcaaaguuagaauucauguggaugaaccagaugaacuuacaguacauguuaaaagugaugauccagaugugguugcagcuagcucaagucucauggcaaggaagcuugaauuuggaacagacaguacauuuaaagcuuucucggccaugccuaaaacuucucuauguuucuacauuguugaaagagaacacuguaagagcugcagugaagaagacacaaaaaaauguguuaacacaaaacuugagcaaccacaaagcauuuugaucgaacacaagggaacuauaaucggaaagcaaaacagcacuugcacggcuaaggcaaguugcugguuagagucagucaagaguuuuuuuuauggccuaaagaacaugcuuaguggcauuuuuggcaaugucuuuaugggcauuuucuuguuccuugcccccuucauccuguuaauacuauucuuuauguuuggguggaggauccuauucugcuuuaaauguuguagaagaaccagaggccuguucaaguauagacaccucaaagacgaugaagaaacugguuauagaaggauuauugaaaaacuaaacaauaaaaaaggaaaaaacaaacugcuugauggugaaagacuugcugauagaagaauugccgaacuguucucuacaaaaacacacauuggc

SEQ ID NO: 4000 - RNA, 1932 nt, Artificial Sequence
  derived and/or modified CDS sequence (wt) from CCHFV(Turkey-Kelkit06)__GQ337054.1__Gc
uucuuggacaguauaguuaaagguaugaaaaauuugcuaaacucaacaagcuuggaaacaagcuuaucaauugaggcaccauggggagcaauaaauguccaaucaaccuuuaaaccaacuguaucgacugcaaacauagcacucaguuggagcucaguggugcacagaggcaacaagaucuuggucacaggcaggucugaaucaauuaugaaacuggaggaaaggacaggagucagcugggaucuaggcguagaagaugccucugaauccaaauuacuuaccguuucuaucauggauuugucacaaauguauucuccuguuuuugaguacuugucaggagacagacagguugaagaauggcccaaagcaacuuguacaggugauugcccggaaaggugugguugcacaucaucaaccugcuuacauaaagaauggucucacucaagaaacuggagauguaaucccacuuggugcuggggaguaggaaccggcugcaccugcugcgggguggauguaaaagaucuuuuuaccgaucacauguuugucaaauggaaaguugaauacauaaaaacugaagcuauaguauguguugcgcucaccagccaagaaagacagugcagucugauugaggcagguacuagauucaacuugggcccugugacuauuacccugucugagccaagaaacauucagcagaagcuuccuccugagauuaucacguugcaucccaaaauugaagaaggcuucuuugacuugaugcauguacaaaaaguguugucugcaaguacaguguguaaacugcagaguugcacacaugguauaccaggagaucuacaaguuuaccacauuggcaacuuguugaaaggggauagaguaaacgggcaucuaauucacaaaauugaaucacauuucaacaccucuuggauguccugggaugguugugacuuagacuacuacugcaacaugggggauuggccaucuugcacauacacaggagugacccagcauaaccaugcugcauuuguaaacuugcuuaacauugaaacugauuacacgaaaaccuuccacuuccacucuaaaagagucacagcacauggugacacaccacaauuggacuuaaaagcaaggccgaccuacggugcaggugggaucacugugcugguugagguugcugacauggaguugcauaccaagaaaguugaaauaucaggcuugaaauuugcaagucuggcuugcacggguugcuaugcuuguagcucuggcaucuccuguaaaguuaggauucauguagaugaaccagaugagcucacaguacauguaaagagcagugauccagaugugguugcagcuagcacaagucucauggcgaggaagcuugaauuugggacagacagcacauucaaggccuuuucagcuaugcccaaaaccucucuauguuuuuacauuguggagagagaauacugcaagagcugcagugaagaugauacacaaaaauguguugacacaagacuugagcagccacagagcauacuaauugagcacaaaggaacgauaauuggaaagcagaaugauacuugcacagccaaggcaagcuguuggcuagagucagucaagaguuuuuuuuauggauugaagaauaugcuuggcaguguuuuugguaaucuuuucauaggcauuuuguuauuccuugccccuuuuguccuguuggugcuuuucuuuauguuuggguggaaaaucuuguuuugcuuuaaauguugcaggaggaccagaggcuuauuuaaguauagacaccucaaagacgaugaggaaacaggcuacagaaggauuauugaaagacugaacagcaaaaaagggaaaaacaggcugcuugauggugauagacuggcugauaggaaaauugcugagcuguucuccacaaaaacacacauuggc

SEQ ID NO: 4001 - RNA, 1935 nt, Artificial Sequence
  derived and/or modified CDS sequence (wt) from CCHFV(SR3)__AJ538199.1__Gc
cuauuucuagauaguauagucaaagguaugaaaaaucugcuaaacucaacaagucuagaaacaagcuuaucaauugaggcaccguggggagcaaucaauguucagucaaccuacaaaccaacugucucaacugcaaacauagcacuuaguuggagcucaguggaacacagaggcaauaagguuuuggucucaggcagaucagaaucaauuaugaagcuggaagaaaggacaggaaucagcugggaucuuggcguggaagaugccucugagucuaagcuacuuacaguuucaguuauggacuugucucagauguacucuccugucuucgaguacuuaucaggugacagacaaguggaagaguggccuaaagcaaccugcacaggugacugcccagaaagauguggcugcacaucaucaaccugcuuacacaaagaguggccccacucaaggaauuggagauguaauccuacuuggugcugggguguagggacuggcugcaccuguugugguuuagaugugaaagaccuuuucacagauuacauguucgucaaguggaaaguugaguacauuaagacagaggccauaguauguguagaacuaaccagucaggaaagacaguguagcuugauugaggcgggcacaagauucaauuuagguucugugacuauuacauugucagaaccaaggaacauucaacaaaagcucccuccugaaauaaucacacugcaccccaagauugaggaagguuuuuuugaccuaaugcauguacaaaaagugcuaucggcaagcacaguguguaaguugcagaguugcacacauggugugccaggagaucugcaggucuaccacaucggaaaccuauuaaaaggggacagaguaaacggacaccugauucauaaaauugagcaacacuucaacacauccuggaugucuugggaugguugugaccuagacuacuacuguaacaugggagacuggccuuccugcacauauaccggagucacucagcauaaccaugcuucauuuguaaaccugcucaacauugaaacugauuauacaaaaaccuuucacuuucacucuaaaaggguuacugcacauggagacacaccacaacuagaucugaaggcaaggccaaccuauggugcaggugagaucaccgugcugguggaaguugcugacauggaguuacacacaaagaagauugaaauaucaggcuuaaaauuugcaggccuaacuugcacagguuguuaugcuuguaguucuggcaucucuuguaaaguuagaauucauguagaugaaccagaugaacuuacaguacauguuaaaagugaugacccagauguaguugcagcuagcucaagucucauggcgaggaagcuugaauuuggaacagacaguacauuuaaagcuuucucagccaugccuaaaaccucccuauguuucuacauuguggaaagggaauacuguaaaagcugcaauaaagaagauacacaaaaauguguuaacacgaaacucgaacaaccacagagcauuuugaucgaacauaagggaacuauaauuggaaagcaaaacaauacuugcacggcuaaagcgaguugcugguuagagucaguuaagaguuucuuuuauggucugaagaauaugcucgguggcauauuuggcaauguuuuuauaggcauuuucacauuucuuacccccuuuaucuuguuaauacuuuucuuuauguuuggguggaggauccuguuuugcuucaaguguugcagaaggaccagaggccuauucaaguacagacaccucaaagacgaugaagaaacugguuacagaaagaucauugaaagacugaacaacaaaaaaggaaaaaacaggcugcuugauggugaaagacuugcugacagaaagauugcugaacuguucuccacaaaaacacacauuggc

SEQ ID NO: 4002 - RNA, 1935 nt, Artificial Sequence
  derived and/or modified CDS sequence (wt) from CCHFV(UCCR4413)__KY484038.1__Gc
uuccugaguaguauagucaaggguaagaagaaucugcuaaacucagcaaguuuagaaacaagccugucaauugaggcaccauggggagccauaaaugcucaguccaccuuuaaacccaccauaucaacugcaaauauagcacucagcuggagcucaguggagcauagaggcaauaaaguuuugguuucagguagaucagagucuaucaugaaacucgaggagcgaacaggaaucaguuggaaccuagggguagaggacgcaucagagucaagaaugcuaacggucucugucauggacuugucacagauguacuuaccaguauuugaauaucugucuggugacaggcaaguggaagaguggccaaaagcaaccuguacaggugacuguccagaaagaugcggcugcacaucaucaaccugcuugcauaaagaauggccgcacucaagaaacuggagaugcaaucccacuugguguugggggguuggaacaggaugcacaugcugcggauuagacgugaaagaccuguucacugauuauauguuuguuaaguggaagguugaguauauuaagacugaagccauaguuuguguugaguuaaccagccaagagagacagugcagcuuaauugaggccggcacaagauucaacuuaggucccgugacaauaacauuaucagaaccaaggaacauccaacaaaagcucccuucagagauagucacacugcaucccaaaauagaagaaggcuucuuugaccucaugcaugugcaaaagguacuaucugcuagcacggugugcaagcugcagagcugcacgcacggaguggcgggagaccugcaggucuaucauguuggcaauuuauuaaaaggggacaaaauaaauggacauucgauucacaagauugaaccacaucucaacacaucauggaugucuugggauggcugugaucuagacuauuacugcaauaugggagauuggcccucuugcacauacacaggggugacacaacacaaucaugcagcauuugucaaccuacuaaacauugaaacugauuacaccaaaagcuuccacuuucacucaaaaagaguaacagcacauggagacacuccccaacuggaccugaaggcgcggcccauguauggugcaggcgaaauaacugucuugguggagguugcugacauggaauugcacucaaagaacauugagaucucaggucuaaaauuugcaagcuugaccugcucaggcuguuaugccugcagcucagguauuucaugcaaagucagaauccauguagacgagcccgaugagcuagcaguacauguaaagagugaugaucuggauguuguggcagcuaguucaagucuuauggcaagaaaaauagaauucggaacagauagcacauuuaaagcuuucucaucuaugccaaaagaaucuuuaugcuucuacauuguugaaagagacuucuguaaaaguugugcagcagaagacacacaaaaaugugugaaagcaaaacuugaacagccacaaagcauacuuauugaacacaaagggacaauaauugggaaacaaaaugacacuugcucaaccaaaacaagcuguugguuggagucauucaaaagcuucuuuuaugggcuaaaaaacaugcuaagcggcguuuuuggcagugcuauuaugggcauucucuuguuccuugcccccuuuaucuuguuaauacuuuucuucuuuuuuggauggagaaucuuauucugccuaagauguuguagaaggaccagagggcuguuuaaguacaagcauaucaaggaugaugaggaagcaggcuacaaaaaaaucauugagaagcuuaacaacaaaaaagggggaacaaguaaauuguuagauggugagagacuugcggacagaaagauugccgaacuuuucucaacaaaagcacacaucggc

SEQ ID NO: 4003 - RNA, 1932 nt, Artificial Sequence
  derived and/or modified CDS sequence (wt) from CCHFV(66019)__AB069669.1__Gc
uucucagacaguauagucaagggcaugaaaaaccugcuaaauucaacuagcuuggaaacaagcuuaucaauugaagcaccauggggagcaauaaacguccagucaaccuuuaaacccaccguuucaacugcaaacauagcacuuagcuggaguucaguagaacacagagguaacaaaauuuuggucucaggcagaucagaaucaauuaugaagcuagaagaaaggacaggaaucagcugggaucugggcguagaagaugccucugagucuaaguugcuuacuguuucugucauggauuugucacagauguauucuccugucuuugaguacuuaucaggugacagacagguagaggaguggcccaaagcaaccugcacagguaauugcccagauagguguggcugcacaucaucaaccugcuuacacaaggaauggccccauucaaggaauuggagaugcaaccccacuugguguuggggagucggcacuggaugcaccugcuguggacuagaugugaaagaucuuuuuacagauuauauguuugucaaguggaaaguugaauacauaaagaccgaggccauagugugcguugagcucaauagccaagaaaggcagugcagcuugauugaggcaggcacaagauucaacuuggguccugugaccaucacguugucagaaccaagaaacauucagcagaagcuuccuucugaaauaaucacauugcauccuagaauugaggaaggcuucuucgaucugaugcauguucaaaaggugcugucugcaaguacaguaugcaagcuacaaagcugcacacauggugugccaggagacuuacagaucuaccacauuggcaacuuguuaaaaggggauaggguaaaugggcaucugauucacaaaauugagccacacuucaacacuucuuggauguccugggauggcugugaccuagauuacuacuguaacaugggggauuggcccucuugcacauauacuggagugacccaacauaaccaugcugcuuuuguaaacuuacuuaacaucgaaacugauuacacaaagaacuuccauuuucauucuaagagaguuacugcacauggagacacaccacagcuggauuugaaagcuagaccaacuuacggugcgggugaaaucacuguacuaguggagguugcugacauggaguuacacacaaaaaagauugcgauaucaggucugaaauuugcaaguuugacuugcacagguugcuaugcuuguagcucuggcaucuccuguaaagucaggauucauguggaugaaccagaugagcuuacaguacaugugaaaagugaagauccggacauuguugcagccagcucaagccucauggcaaggaagcuugaauuugggacagacagcacauucaaggccuucucagccaugcccaaaaccuccuugugcuucuacauuguagagagagaauacugugagagcugcagcaaagaagacacacagaaauguguuaacacaaagcuugagcaaccacaaagcauuuuaauugagcacaaaggaacaauaaucggaaagcaaaaugacacuugcacagccaaagcaagcugcugguuagagucaguaaagaguuuuuuuuauggauugaagaacaugcuuagcggcaucuucggcaacguuuuuauaggcauuuucuuauuccuugcuccuuuuauucuguuaauacucuucuuuauguuuggguggagaauccuguuuugcuuuaaguguugcagaaggaccagaggcuuauucaaguacagauaucucaaggacgacgaagagucugguuacagaagaaucauugaaagauuaaacaacaaaaaaggaaaaaacaaguuacuugacggugaaagacuagcugacaggaggaucgcugaguuguucucuaccaaaacacacauuggu

SEQ ID NO: 4004 - RNA, 1932 nt, Artificial Sequence
  derived and/or modified CDS sequence (wt) from CCHFV(7001)__AB069670.1__Gc
uuccuggauaacauagccaagggaaugaaaagccuguugaacuccacgagcuuagaaacuagucugucaauugaagcuccguggggagcaaucaauguccagucaacuuucaaaccaacaguuucagcugcuaacauagcacuuagcuggaguucaguugaacacaggggcaacaaaauuuuaguuucagguagaucagagucaaucaugaaauuagaagaaagaacaggagucagcuggaaucuggguguagaagaugcuucugagucaaagacgcuuacuguuuccgucauggaccugucacaaauguacucuccuguuuuugaguacuugucaggugacagacaaguggaggaauggccaaaggcaacuugcacaggugacuguccagagagaugcggcugcacuucgucaaccugcuuacauaaagaguggccacauucaagaaacuggcgauguaauccuaccugguguugggggguggggacuggcugcacuugcugugggcuggauguaaaggauuuuuuuacugacuacaugcugguaaaauggaaaguggaauauauaaagacagaagcuauagugugugucgagcugacuagucaagagaggcaguguaguuuaauugaagcaggcacaagauuuaaccuaggcccuguaacaauaacccuaucagagccaagaaauguccagcagaggcuuccucccgaaauuguaacacugcauccuaaaauagaggaagguuuuuuugauuugaugcauguacaaaaaauacugucugcaagcacaguuugcaagcuacagagcugcacacacggugugccgggcgauuuucaggucuaccaugucgguaaccugcugaggggagacaagguuaauggacacucaauucacaagauagaaccacauuuuaauacuucauggaugucaugggaugguugcgaucuggacuauuucugcaauaugggggacuggccuucaugcacauacacuggagugacacagcauaaccgugcugcauuuaucaacaugcucaacauugagacugacuauacaaaaacuuuccacuuucauucgaagagggucacggcacauggagauacuccccagcuagaccuaaaagcgagaccggcauauggugcuggcgaggucacuguucuaguggagguugcagacuuggaguugcacacaaagaaacuugaagugucagguuugaaaauugcaaguuugaccugcucuggguguuaugccugcagcucuggcaucuccugcaaaguuagaauccauguaaaugaaccagaugaauuuacaguacauguaagaaguagcgacccagauguuguagcagcaggaucaagucuuauggcaaggaaaauagaguuuggggcugacaguacauucaaggccuuuucaucaaugcccaaggacuccuuaugcuuuuacauaguagaaaaggauuacugcagcagcugcaccgacgaugacacacaaaagugugucaacacgaagcuugaccauccacagagcauacucauugagcacaaaggaacaauaauuggcaagcaaaaugacacuuguucgaccaagacaagcugcuggcuagaaucaguuaaggguuuuuucuaugggcuaaaaaacaugcuaaguggcaucuuuggaaauguuuuuuuaggcaucuucuuauuccuugcuccuuuugugcuacugauauuuuuuuucuuuuuuggguggaggcuucuguuuugucucaaauguugcagaagaacuagaggacuguugaaauacaagcaccuuaaggaugaagaggaggcuggauacaaaaaaaucauugaaaggcuaaauggcaaaaaagguaaaagucaauuguuugauggugaaaggcuugcagacaggaagauugcugagcuuuuuucuacuaaaauucacauaggu

SEQ ID NO: 4005 - RNA, 1932 nt, Artificial Sequence
  derived and/or modified CDS sequence (wt) from CCHFV(75024)__AB069671.1__Gc
uuccuggacaguauaguuagaggcaugaaaaaucagcuaaacucaacaaguuuagaaacaagcuuaucgauugaggcaccauggggagcaauaaauguucagucaaccuacaaaccaacugugucaacugcaaacauagcacuuaguuggagcucaguugaacacagagguaauaagauuuugguuucaggcagaucagaaucaauuaugaagcuggaagaaaggacaggaaucagcugggaccuuggcguagaagaugccucugaaucuaagcuacuuacagucucugucauggacuugucucagauguacucuccugucuucgaguacuuaucaggugacagacaaguagaagaguggcccaaggcaaccuguacaggagacugcccagaaagauguggcugcacaacaucaaccugcuugcauaaagaauggccccauucaagaaacuggagauguaaucccacuuggugcugggggguggggacuggcugcacuuguuguggauuagaugugaaagaccuuuuuacagauuauaugauugucaaguggaaaguugaauacauuaaaacagaggccauaguguguguggaacucaccagucaggaaaggcaguguagcuugauugaggcaggcacaagguucaauuuagguucugugaccaucacauugucagaaccgaggaacauucaacaaaagcucccuccugaaauaaucacauugcauccuaggauugaagaagguuuuuuugaccugaugcauguacaaaaaguguugucagcuagcacaguguguaaguugcagaguugcacacacggugugccaggugaucuacaggucuaccaugucggaaauuuauuaaaaggagauaaggugaauggacaccuaauucauaaaauugagccacacuuaaacacuuccuggauguccugggauggcugugaucuagacuacuauugcaacaugggagacuggccuucuuguacauauaccggaguuacccaacacaaucaugcuucauuuguaaaccugcucaacauugaaacugacuauacaaaaagcuuccacuuucacucuaaaaggguuacugcacacggagacacaccacaauuagaucugaaggcaagaccaaccuacggcgcaggagaaaucacuguacugguagaaguugcugacauggaguucacaccgaagaagauugaaauaucaggccuaaaauuugcaagccugacuugcacaggcuguuaugcuuguaguucuggcauuuccugcaaaguuaggauucauguggaugaaccagaugaacuuacaguacauguuaagagugaugauccagauguaguagcagcuagcucaagucucauggcaaggaagcuugaguuuggaacagacaguacauuuaaagcuuucucagcuaugcccaaaacuuccuuauguuucuacauugucgaaagggaguacuguaagagcugcaguaaagaagacacacaaaaauguguuaacacaaaacuugagcaaccacagagcauuuugaucgaacauaagggaacuauaauuggaaagcaaaacaauaccugcacagccaaagcaaguugcugguuagagucgguuaaaaguuucuuuuauggucuaaagaacaugcuuaguggcauuuuuggcaaucuuuuuaugggcaucuucuuauuucuugcccccuucaucuuguuaauacuuuucuuuauguuuggauggaggauccuguuuugcuuuaaguguugcagaagaaccaggggccuguucaaguauagacaucucaaagacgaugaagaaacugguuacaggaggaucauugaaagacugaacaacaagaaggggaagaacaagcugcuugauggugaaagacuugccgauagaagaauugccgaacuauucuccacaaaaacacacauuggc

SEQ ID NO: 4006 - RNA, 1932 nt, Artificial Sequence
  derived and/or modified CDS sequence (wt) from CCHFV(7803)__AB069672.1__Gc
uuccuggacaguauaguuagaggcaugaaaaauccgcuaaacucaacaaguuuagaaacaagcuuaucgauugaggcaccauggggagcaauaaauguucagucaaccuacaaaccaacugugucaacugcaaacauagcacuuaguuggagcucaguugaacacagagguaauaagauuuugguuucaggcagaucagaaucaauuaugaagcuggaagaaaggacaggaaucagcugggaccuuggcguagaagaugccucugaaucuaagcuacuuacagucucugucauggacuugucucagauguacucuccugucuucgaguacuuaucaggugacagacaaguagaagaguggcccaaggcaaccuguacaggagacugcccagaaagauguggcugcacaacaucaaccugcuugcauaaagaauggccccauucaagaaacuggagauguaaucccacuuggugcugggggguggggacuggcugcacuuguuguggauuagaugugaaagaccuuuuuacagauuauaugauugucaaguggaaaguugaauacauuaaaaccagaggcauaguguguguggaacucaccagucaggaaaggcaguguagcuugauugaggcgggcacaagguucaauuuagguucugugaccaucacauugucagaaccgaggaacauucaacaaaagcucccuccugaaauaaucacauugcauccuaggauugaagaagguuuuuuugaccugaugcauguacaaaaaguguugucagcuagcacaguguguaaguugcagaguugcacacacggugugccaggugaucuacaggucuaccaugucggaaauuuauuaaaaggagauaaggugaauggacaccuaauucauaaaauugagccacacuuaaacacuuccuggauguccugggauggcugugaccuagacuacuacugcaacaugggagacuggccuucuuguacauauaccggaguuacccaacacaaucaugcuucguuuguaaaccugcucaacauugaaacugacuauacaaaaagcuuccacuuucacucuaaaaggguuacugcacacggagacacaccacaauuagaucugaaggcaagaccaaccuacggcgcaggagaaaucacuguacugguagaaguugcugacauggaguucacaccgaagaagauugaaauaucgggccuaaaauuugcaagccugacuugcacaggcuguuaugcuuguaguucuggcauuuccugcaaaguuaggauucauguggaugaaccagaugaacuuacaguacauguuaagagugaugauccagauguaguagcagcuagcucaagucucauggcaaggaagcuugaguuuggaacagacaguacauuuaaagcuuucucagcuaugcccaaaacuuccuuauguuucuacauugucgaaagggaguacuguaagagcugcaguaaagaagacacacaaaaauguguuaacacaaaacuugagcaaccacagagcauuuugaucgaacauaagggaacuauaauuggaaagcaaaacaauaccugcacagccaaagcaaguugcugguuagagucgguuaaaaguuucuuuuauggucuaaagaacaugcuuaguggcauuuuuggcaauuuuuuuaugggcaucuucuuauuucuugcccccuucaucuuguuaauacuuuucuuuauguuuggauggaggauccuguuuugcuuuaaguguugcagaagaaccaggggccuguucaaguauagacaucucaaagacgaugaagaaacugguuacaggaggaucauugaaagacugaacaauaagaaggggaagaacaagcugcuugauggugaaagacuugccgauagaagaauugccgaacuauucuccacaaaaacacacauuggc

SEQ ID NO: 4007 - RNA, 1932 nt, Artificial Sequence
  derived and/or modified CDS sequence (wt) from CCHFV(79121)__AB069673.1__Gc
uuccuggauagcacagccaagggaaugaaaagccuguugaacuccacgagcuuagaaacuagucugucaauugaagcuccguggggagcaaucaauguccagucaacuuucaaaccaacaguuucagcugcuaacauagcacuuagcuggaguucaguugaacacaggggcaacaaaauuuuaguuucagguagaucagagucaaucaugaaauuagaagaaagaacaggagucagcuggaaucuggguguagaagaugcuucugagucaaagacgcuuacuguuuccgucauggaccugucacaaauguacucuccuguuuuugaguacuugucaggugacagacaaguggaggaauggccaaaggcaacuugcacaggugacuguccagagagaugcggcugcacuucgucaaccugcuuacauaaagaguggccacauucaagaaacuggcgauguaauccuaccugguguugggggguggggacuggcugcacuugcugugggcuggauguaaaggauuuuuuuacugacuacaugcugguaaaauggaaaguggaauauauaaagacagaagcuauagugugugucgagcugacuagucaagagaggcaguguaguuuaauugaagcaggcacaagauuuaaccuaggcccuguaacaauaacccuaucagagccaagaaauguccagcagaggcuuccucccgaaauuguaacacugcauccuaaaauagaggaagguuuuuuugauuugaugcauguacaaaaaauacugucugcaagcacaguuugcaagcuacagagcugcacacacggugugccgggcgauuuucagaucuaccaugucgguaaccugcugaggggagacaagguuaauggacacucaauucacaagauagaaccacauuuuaauacuucauggaugucaugggaugguugcgaucuggacuauuucugcaauaugggggacuggccuucaugcacauacacuggagugacacagcauaaccgugcugcauuuaucaacaugcucaacauugagacugacuauacaaaaacuuuccacuuucauucgaagagggucacggcacauggagauacuccccagcuagaccuaaaagcgagaccggcauauggugcuggcgaggucacuguucuaguggagguugcagacuuggaguugcacacaaagaaccuugaagugucagguuugaaaauugcaaguuugaccugcucuggguguuaugccugcagcucuggcaucuccugcaaaguuagaauccauguaaaugaaccagaugaauuuacaguacauguaagaaguagcgacccagauguuguagcagcaggaucaagucuuauggcaaggaaaauagaguuuggggcugacaguacauucaaggccuuuucaucaaugcccaaggacuccuuaugcuuuuacauaguagaaaaggauuacugcagcagcugcaccgacgaugacacacaaaagugugucaacacgaagcuugaccauccacagagcauacucauugagcacaaaggaacaauaauuggcaagcaaaaugacacuuguucgaccaagacaagcugcuggcuagaaucaguuaaggguuuuuucuaugggcuaaaaaacaugcuaaguggcaucuuuggaaauguuuuuuuaggcaucuucuuauuccuugcuccuuuugugcuacugauauuuuuuuucuuuuuuggguggaggcuucuguuuugucucaaauguugcagaagaacuagaggacuguugaaauacaagcaccuuaaggaugaagaggaggcuggauacaaaaaaaucauugaaaggcuaaauggcaaaaaagguaaaagucaauuguuugauggugaaaggcuugcagacaggaagauugcugagcuuuuuucuacuaaaauucacauaggu

SEQ ID NO: 4008 - RNA, 1932 nt, Artificial Sequence
  derived and/or modified CDS sequence (wt) from CCHFV(8402)__AB069674.1__Gc
uuuucagacagcauugucaaaggcaugaagaacuugcuaaauucaacaagcuuagaaacaagcuuaucaauugaggcaccauggggagcaauaaauguccaaucaaccuucaaaccuacugugucagcugcgaauauagcucuuaguuggagcucaguggaacacagggguaauaagauuuugguuucagguagaucagagucaaucaugaagcuagaggaaaggacaggaaucagcugggaucuagggguagaagaugcuucugagucuaaauugcuuacugucucuguuauggacuugucacagauguacucuccugucuuugaguaccuaucaggugacagacaaguggaggaauggcccaaggcaaccugcacaggagauugcccagaaagauguggcugcacaucaucaaccugccuacacaaagaauggccccauucaagaaacuggagaugcaaccccaccugguguuggggagucggcacuggauguaccugcugugggcuggauguaaaagaccuuuuuacagauuacauguuuaucaaguggaaaguugaguacauuaaaacagaagcuauaguguguguugagcuuacuagccaagagagacaauguaccuugauugaggcaggcacaagauucaacuuagguccugugaccaucacauugucagagccaagaaacauucagcaaaagcucccuccagagauaguuacauugcaccccagaauugaagaagguuucuuugauuuaaugcauguacaaaaggugcuaucagcaaguacaguguguaagcuacagaguugcacacauggugugccaggggaccuacaggucuaucacauaggaaacuuguuaaaaggagacaaggugaaugggcaccugauucacaaaauugaaccacacuucaacacuuccuggaugucuugggacggcugugaccuagacuacuacuguaauaugggggauuggccaucuugcacauauacuggaguaacccagcacaaucaugcugcauuuguaaacaugcucaacaucgaaacugauuauacaaaaaacuuccacuuucacucuaagagaguuacugcacauggagacacaccacaauuagauuugaaagcuagaccaacuuauggugcaggugaaaucacugugcugguggaaguugcugacauggaguuacacacaaagaaaauugagauaucagguuugaaguuugcaagcuuaacuugcacaggcuguuaugcuuguagcucugguaucuccuguaagguuagaauccauguagaugagccagaugagcuuacaguacaugugaagagugaagacccagacauaguugcugcuagcucaagucucauggcuagaaaacuugaauuugggacagauaguacauucaaagccuuuucagccaugcccaaaaccuccuuaugcuuuuacauuguggagagagaauauuguaaaagcugcagcaaagaagauacacaaaaaugugucaacacaaagcuugagcaaccacagagcauuuuaaucgagcacaaaggaacgauaauugguaagcagagcaacaccugcacagcuaaagcaagcuguuggcuagagucagucaagagcuucuuuuaugggcuaaagaacaugcuuaguggcauuuuuggcaauguuuucauagggguuuucuuauucuuugcuccuuuuauccuuuugauacuuuucuuuauguuuggauggagaauccuguucugcuuuaaauguugcagaagaacuagaggccuuuuuaaguacagacaccucaaggacgaugaagaaaccgguuacaggaaaaucauugagagacugaacaacaaaaaagggaaaaacaaacugcuugauggugaaagauuagcugauaggaagauugcugagcuguucuccacaaagacacacauuggc

SEQ ID NO: 4009 - RNA, 1932 nt, Artificial Sequence
  derived and/or modified CDS sequence (wt) from CCHFV(88166)__AB069675.1__Gc
uuuucagacagcauugucaaaggcaugaagaacuugcuaaauucaacaagcuuagaaacaagcuuaucaauugaggcaccauggggagcaauaaauguccaaucaaccuucaaaccuaccaugucagcugcgaauauagcucuuaguuggagcucaguggaacacagggguaauaagauuuugguuucagguagaucagagucaaucaugaagcuagaggaaaggacaggaaucagcuggaaucuagggguagaagaugcuucugagucuaaauugcuuacugucucuguuauggacuugucacagauguacucuccugucuuugaguaccuaucaggugacagacaaguggaggaauggcccaaggcaaccugcacaggagauugcccagaaagauguggcugcacaucaucaaccugccuacacaaagaauggccccauucaagaaacuggagaugcaaccccaccugguguuggggagucggcacuggauguaccugcugugggcuggauguaaaagaccuuuuuacagauuacauguuuaucaaguggaaaguugaguacauuaaaacagaagcuauaguguguguugagcuuacuagccaagagagacaauguaccuugauugaggcaggcacaagauucaacuuagguccugugaccaucacauugucagagccaagaaacauucagcaaaagcucccuccagagauaguuacauugcaccccagaauugaagaagguuucuuugauuuaaugcauguacaaaaggugcuaucagcaaguacaguguguaagcuacagaguugcacacauggugugccaggggaccuacaggucuaucacauaggaaacuuguuaaaaggagacaaggugaaugggcaccugauucacaaaauugaaccacacuucaacacuuccuggaugucuugggacggcugugaccuagacuacuacuguaauaugggggauuggccaucuugcacauauacuggaguaacccagcacaaucaugcugcauuuguaaacaugcucaacaucgaaacugauuauacaaaaaacuuccacuuucacucuaagagaguuacugcacauggagacacaccacaauuagauuugaaagcuagaccaacuuauggugcaggugaaaucacugugcugguggaaguugcugacauggaguuacacacaaagaaaauugagauaucagguuugaaguuugcaagcuuaacuugcacaggcuguuaugcuuguagcucugguaucuccuguaagguuagaauccauguagaugagccagaugagcuuacaguacaugugaagagugaagacccagacuuaguugcugcuagcucaagucucauggcuagaaaacuugaauuugggacagauaguacauucaaagccuuuucagccaugcccaaaaccuccuuaugcuuuuacauuguggagagagaauauuguaaaagcugcagcaaagaagauacacaaaaaugugucaacacaaagcuugagcaaccacagagcauuuuaaucgagcacaaaggaacgauaauugguaagcagaacaacacaugcacagcuaaagcaagcuguuggcuagagucagucaagagcuucuuuuaugggcuaaagaacaugcuuaguggcauuuuuggcaauguuuucauagggguuuucuuauucuuugcuccuuuuauccuuuugauacuuuucuuuauguuuggauggagaauccuguucugcuuuaaauguugcagaagaacuagaggccuuuuuaaguacagacaccucaaggacgaugaagaaaccgguuacaggaaaaucauugagagacugaacaacaaaaaagggaaaaacaaacugcuugauggugaaagauuagcugauaggaagauugcugagcuguucuccacaaagacacacauuggc

SEQ ID NO: 4010 - RNA, 1932 nt, Artificial Sequence
  derived and/or modified CDS sequence (wt) from CCHFV(BA88166)__AF338470.1__Gc
uauuuagacagcauugucaaaggcaugaagaacuugcuaaauucaacaagcuuagaaacaagcuuaucaauugaggcaccauggggagcaauaaauguccaaucaaccuucaaaccuaccaugucagcugcgaauauagcucuuaguuggagcucaguggaacacagggguaauaagauuuugguuucagguagaucagagucaaucaugaagcuagaggaaaggacaggaaucagcuggaaucuagggguagaagaugcuucugagucuaaauugcuuacugucucuguuauggacuugucacagauguacucuccugucuuugaguaccuaucaggugacagacaaguggaggaauggcccaaggcaaccugcacaggagauugcccagaaagauguggcugcacaucaucaaccugccuacacaaagaauggccccauucaagaaacuggagaugcaaccccaccugguguuggggagucggcacuggauguaccugcugugggcuggauguaaaagaccuuuuuacagauuacauguuuaucaaguggaaaguugaguacauuaaaacagaagcuauaguguguguugagcuuacuagccaagagagacaauguaccuugauugaggcaggcacaagauucaacuuagguccugugaucaucacauugucagagccaagaaacauucagcaaaagcucccuccagagauaguuacauugcaccccagaauugaagaagguuucuuugauuuaaugcauguacaaaaggugcuaucagcaaguacaguguguaagcuacagaguugcacacauggugugccaggggaccuacaggucuaucacauaggaaacuuguuaaaaggagacaaggugaaugggcaccugauucacaaaauugaaccacacuucaacacuuccuggaugucuugggacggcugugaccuagacuacuacuguaauaugggggauuggccaucuugcacauauacuggaguaacccagcacaaucaugcugcauuuguaaacaugcucaacaucgaaacugauuauacaaaaaacuuccacuuucacucuaagagaguuacugcacauggagacacaccacaauuagauuugaaagcuagaccaacuuauggugcaggugaaaucacugugcugguggaaguugcugacauggaguuacacacaaagaaaauugagauaucagguuugaaguuugcaagcuuaacuugcacaggcuguuaugcuuguagcucugguaucuccuguaagguuagaauccauguagaugagccagaugagcuuacaguacaugugaagagugaagacccagacauaguugcugcuagcucaagucucauggcuagaaaacuugaauuugggacagauaguacauucaaagccuuuucagccaugcccaaaaccuccuuaugcuuuuacauuguggagagagaauauuguaaaagcugcagcaaagaagauacacaaaaaugugucaacacaaagcuugagcaaccacagagcauuuuaaucgagcacaaaggaacgauaauugguaagcagaacaacacaugcacagcuaaagcaagcuguuggcuagagucagucaagagcuucuuuuaugggcuaaagaacaugcuuaguggcauuuuuggcaauguuuucauagggguuuucuuauucuuugcuccuuuuauccuuuugauacuuuucuuuauguuuggauggagaauccuguucugcuuuaaauguugcagaagaacuagaggccuuuuuaaguacagacaccucaaggacgaugaagaaaccgguuacaggaaaaucauugagagacugaacaacaaaaaagggaaaaacaaacugcuugauggugaaagauuagcugauaggaagauugcugagcuguucuccacaaagacacacauuggc

SEQ ID NO: 4011 - RNA, 1932 nt, Artificial Sequence
  derived and/or modified CDS sequence (wt) from CCHFV(BA66019)__AF350448.1__Gc
uucucagacaguauagucaagggcaugaaaaaccugcuaaauucaacuagcuuggaaacaagcuuaucaauugaagcaccauggggagcaauaaacguccagucaaccuuuaaacccaccguuucaacugcaaacauagcacuuagcuggaguucaguagaacacagagguaacaaaauuuuggucucaggcagaucagaaucaauuaugaagcuagaagaaaggacaggaaucagcugggaucugggcguagaagaugccucugaaucuaaguugcuuacuguuucugucauggauuugucacagauguauucuccugucuuugaguacuuaucaggugacagacagguagaggaguggcccaaagcaaccugcacaggugauugcccagauagguguggcugcacaucaucaaccuguuuacacaaagaauggccccauucaagaaauuggagaugcaaccccacuugguguuggggagucggcacuggaugcaccugcuguggacuagaugugaaagaucuuuuuacagauuauauguuugucaaguggaaaguugaauacauaaagaccgaggccauagugugcguugagcucaauagccaagaaaggcagugcagcuugauugaggcaggcacaagauucaacuuggguccugugaccaucacguugucagaaccaagaaacauucagcagaagcuuccuccugaaauaaucacauugcauccuagaauugaggaagguuucuucgaucugaugcauguucaaaaggugcugucugcaaguacaguaugcaagcuacaaagcugcacacauggugugccaggagacuuacagaucuaccacauuggcaacuuguuaaaaggggauaggguaaaugggcaucugauucacaaaauugagccacacuucaacacuucuuggauguccugggauggcugugaccuagauuacuacuguaacaugggggauuggcccucuugcacauauacuggagugacccaacauaaccaugcugcuuuuguaaacuuacuuaacaucgaaacugauuacacaaagaacuuccauuuucauucuaaaaggguuacugcccauggagacaccccacaacuggaucuuaaagcuagaccaacuuacggugcgggugaaaucacuguucugguggagguugcugacauggaguuacacacaaaaaagauugcgauaucaggucugaaauuugcaaguuugacuugcacagguugcuaugcuuguagcucuggcaucuccuguaaagucaggauucauguggaugaaccagaugagcuuacaguacaugugaaaagugaagauccggacauuguugcagccagcucaagccucauggcaaggaagcuugaauuugggacagacagcacauucaaggccuucucagccaugcccaaaaccuccuugugcuucuacauuguagagagagaauacugugagagcugcagcaaagaagacacacagaaauguguuaacacaaagcuugagcaaccacaaagcauuuuaauugagcacaaaggaacgauaaucggaaagcaaaaugacacuugcacagccaaagcaagcugcugguuagagucaguaaagaguuuuuuuuauggauugaagaacaugcuuagcggcaucuucggcaacguuuuuauaggcauuuucuuauuccuugcuccuuuuauucuguuaauacucuucuuuauguuuggguggagaauccuguuuugcuuuaaguguugcagaaggaccagaggcuuauucaaguacagauaucucaaggacgacgaagagucugguuacagaagaaucauugaaagauuaaacaacaaaaaaggaaaaaacaaguuacuugacggugaaagacuagcugacaggaggaucgcugaguuguucucuaccaaaacacacauuggu

SEQ ID NO: 4012 - RNA, 1932 nt, Artificial Sequence
  derived and/or modified CDS sequence (wt) from CCHFV(BA8402)__AF350449.1__Gc
uuuucagacagcauugucaaaggcaugaagaacuugcuaaauucaacaagcuuagaaacaagcuuaucaauugaggcaccauggggagcaauaaauguccaaucaaccuucaaaccuacugugucagcugcgaauauagcucuuaguuggagcucaguggaacacagggguaauaagauuuugguuucagguagaucagaaucaaucaugaagcuagaagaaaggacaggaaucagcugggaucuagggguagaagaugcuucugaaucuaaauugcuuacugucucuguuauggacuugucacagauguacucuccugucuuugaguaccuaucaggugacagacaaguggaggaauggcccaaggcaaccugcacaggagauugcccagaaagauguggcugcacaucaucaaccugccuacacaaagaauggccccauucaagaaacuggagaugcaaccccaccugguguuggggagucggcacuggauguaccugcugugggcuggauguaaaagaccuuuuuacagauuacauguuuaucaaguggaaaguugaguacauuaaaacagaagcuauaguguguguugagcuuacuagccaagagagacaauguaccuugauugaggcaggcacaagauucaacuuagguccugugaccaucacauugucagagccaagaaacauucagcaaaagcucccuccagagauaguuacauugcaccccagaauugaagaagguuucuuugauuuaaugcauguacaaaaggugcuaucagcaaguacaguguguaagcuacagaguugcacacauggugugccaggggaccuacaggucuaucacauaggaaacuuguuaaaaggagacaaggugaaugggcaccugauucacaaaauugaaccacacuucaacacuuccuggaugucuugggacggcugugaccuacacuacuacuguaauaugggggauuggccaucuugcacauauacuggagucacccagcacaaucaugcugcauuuguaaacaugcucaacaucgaaacugauuauacaaaaaacuuccacuuucacucuaagagaguuacugcacauggagacacaccacaauuagauuugaaagcuagaccaacuuauggugcaggugaaaucacugugcugguggaaguugcugacauggaguuacacacaaagaaaauugagauaucagguuugaaguuugcaagcuuaacuugcacaggcuguuaugcuuguagcucugguaucuccuguaagguuagaauccauguagaugagccagaugagcuuacaguacaugugaagagugaagaccccgacauaguugcugcuagcucaagucucauggcuaggaagcuugaauuugggacagauaguacauucaaagccuuuucagccaugcccaaaaccuccuuaugcuucuacauuguggagagagaauauugugaaagcugcagcaaagaagauacacaaaaauguguuaacacaaagcuugagcaaccacagagcauuuuaaucgagcacaaaggcacgauaauugguaagcagagcaacaccugcacagcuaaagcaagcuguuggcuagagucagucaagagcuucuuuuaugggcuaaagaacaugcuuaguggcauuuuuggcaauguuuucauagggguuuucuuauucuuugcuccuuuuauccuuuugauacuuuucuuuauguuuggauggagaauccuguucugcuuuaaauguugcagaagaacuagaggccuuuuuaaguacagacaccucaaggacgaugaagaaaccgguuacaggaaaaucauugagagacugaacaacaaaaaagggaaaaacaaacugcuugauggugaaagauuagcugauaggaagauugcugagcuguucuccacaaagacacacauuggc

SEQ ID NO: 4013 - RNA, 1932 nt, Artificial Sequence
  derived and/or modified CDS sequence (wt) from CCHFV(Matin)__AF467769.2__Gc
uuuuuagacaguauuauuaaggguaugaagaacuugcuaaauucaacaagcuuagaaacaagcuuaucaauugaggcaccauggggagcaauaaauguccaaucaacuuucaaaccuacuaugucagcugcgaacauagcgcuaaguuggagcucaguggaacacagagguaauaagauuuugguuucaggcagaucagagucgaucaugaagcuagaggaaaggacaggaaucagcugggaucuaggaguagaagaugccucugagucuaaauugcuuacuguaucuguuauggacuuaucacagauguauucuccugucuuugaguacuuaucaggugauagacaaguggaggaauggcccaaggcaaccugcacaggcgauuguccagaaagauguggcugcacaucaucaaccugccuacacaaagaauggccccauucaagaaacuggagaugcaauccuacuugguguuggggagucggcacuggauguaccugcugugggcuagacguaaaagaccuuuuuacugauuacauguuugucaaguggaaaguugaauacauuaaaacggaaguuauaguguguguugagcuuacuagccaagaaagacaauguagcuugauugaggcaggcacaagauucaacuuagguccugugaccauuacauugucagagccaagaaacauucagcaaaagcucccuccagagauagucacauugcaucccagaauugaagaagguuucuuugauuuaaugcauguacaaaaagugcuaucagcaaguacagugugcaagcuacagaguugcacacauggugugccaggggaccuacaggucuaccacauaggaaacuuguuaaaaggagauaaggugaacgggcacuugauucacaaaauugaaccacacuucaacacuuccuggaugucuugggacggcugugaccuagacuacuacuguaauaugggggauuggccaucuugcucauauacuggaguaacccaacacaaucaugcugcauuuguaaacaugcucagcaucgaaacugauuauacaaaaaacuuccacuuucacucuaagagaguuacugcacauggagacacaccacaauuagaucugaaagcuaggccaacuuacggugcaggugaaaucacugugcugguagagguugcugacauggaauuacauacaaagaaaauugagauaucagguuugaaguuugcaagcuuaacuugcacaggauguuaugcuuguagcucugguaucuccuguaagguuagaauccauguagaugaaccagaugagcuuacaguacaugugaagagugaagacccagacauaguugcugcuagcucaagucucauggcuagaaagcuugaauuugggacagauaguacauucaaagccuuuucagccaugcccaaaaccuccuuaugcuuuuacauuguggagagagaauauuguaaaaguugcaguaaagaagacacacaaaaaugugucaacacaaagcuugagcaaccacagagcaucuuaaucgagcauaaagggacgauaauuggaaagcaaaacgacaccuguacagccaaagcaagcugcuggcuggagucagucaaaaguuuuuuuuauggacuaaagaacaugcuuaguggcauuuuuggcaauguuuucauagggauuuucuuauuccuugcuccuuuugcccuuuuaauacuuuucuuuauguuuggauggagaauccuguucugcuuuaaauguugcagaagaacuagaggccuauuuaaauacagacaccucaaggacgacgaagaaaccgguuacaggaaaaucauugagaggcugaacaacaaaaaagguaaaaacaaacugcucgacggugaaagacuagcugacaggaagaucgcugagcuguucuccacaaaaacacacguuggc

SEQ ID NO: 4014 - RNA, 1932 nt, Artificial Sequence
  derived and/or modified CDS sequence (wt) from CCHFV(Baghdad 12)__AJ538197.2__Gc
uuccuggauaguauagucaaaggcacgaaaaaucugcuaaacucaacaaguuuagaaacaagcuuaucgauugaggcaccauggggagcaauaaauguucagucaaccuauaaaccaacugugucaacugcaaacauagcacuuaguuggaguucaguugaacacagagguaacaagauuuugguuucaggcagaucagaaucaauuaugaagcuagaagagagaacaggaaucaguugggaucuuggcguagaagaugccucugaaucuaagcuacuuacagucucugucauggacuugucucagauguacucuccugucuuugaguacuuaucaggugacagacaaguagaagaauggcccaaggcaaccuguacaggugacugcccagaaagauguggcugcacaacaucaaccugcuugcauaaagaauggccccauucaagaaacuggagauguaaucccacuuggugcuggggagugggaacuggcugcacuuguugcggauuagaugugaaggaccuuuuuacagauuauauguucgucaaauggaaaguugaauacauuaaaacagaugccauaguguguguggaacucacuagucaagaaaggcaaugcagcuugauugaggcagguacaagguuuaacuuagguucugugaccaucacauugucagaaccgaggaacauucagcaaaagcucccuccugaaauaaucacauuacauccuaggauugaagaagguuuuuuugaccugaugcauguacaaaaaguguugucagcuagcacaguguguaaguugcagaguugcacacacggugugccaggugaucuacaggucuaccacaucggaaauuuauuaaaaggggauaaagugaauggacaccuaauucauaaaauugagccacauuuuaacacuucuuggauguccugggauggcugugacuuagacuacuauugcaauaugggagacuggccuucuugcacauauaccggaguuacccaacacaaucaugcuucauuuguaaaccugcucaacauugaaacugauuacacaaaaagcuuccacuuucacucuaaaaggguuacugcacauggagauacaccacaguuagaucugaagguaagaccaaccuacggcgcaggagaaaucacuguacugguagaaguugcugacauggaguugcacacgaagaagauugaaauaucaggccuaaaauuugcaagccugacuugcacaggcuguuaugcuuguagcucuggcauuuccugcaaaguuaggauacauguggaugaaccggaugaacucacaguacacgucaaaagugaugauccagauguaguagcagcuagcucaagucucauggcaaggaagcuugaguuuggaacagacagcacauuuaaagcuuucuccgccaugccaaaaacuuccuuauguuucuacauugucgaaagggaguacuguaaaagcugcaguaaagaagauacacaaaaauguguuaacacaaaacuugagcaaccacagagcauuuugauugaacauaagggaacuauaaucggaaagcaaaacaauaccugcacagccaaaacaaguugcugguuagagucaguuaaaaguuucuuuuauggucuaaagaauaugcuuaguggcauuuuuggcaauuuuuucaugggcaucuucuuauuucuugcccccuuuaucuuguuaauacuuuucuuuauguuuggauggaggauccuguuuugcuuuaaguguugcagaagaaccaggggccuguuuaaguacagacaucucaaagaugaugaagaaacugguuauagaaggaucauugaaagacugaacaacaagaaagggaagaacaagcugcuugauggugaaagacuugccgauagaaggauugccgaacuauucuccacaaaaacacauauuggc

SEQ ID NO: 4015 - RNA, 1932 nt, Artificial Sequence
  derived and/or modified CDS sequence (wt) from CCHFV(VLG/TI29414)__AY179961.1__Gc
uucuuagacaguauaguuaaaggcaugaagaauuuacuaaacucaacaaacuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguagaagaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcugggaaguaggaacuggcugcaccugcugcggguggaauguaaaagaccuuuuuacagaucacauguuugucaaauggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacgcugcaucccaaaguugaagagggcuucuuugacuugaugcaugugcaaaaaguguugucugcaaguacaguguguaaacugcagaguugcacacaugguauaccaggagaucuacaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggaaugacccagcauaaccaugcugcauuuguaaacuugcuuaauaucgaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcauaccaagaaaguugagauaucaggcuuaaaauuugcaagucuggcuugcacggguugcuaugcuuguagcucuggcaucuccuguaaagucaggauucauguagaugagccagaugagcucacaguacauguaaagagcaaugauccagaugugauugcagcuagcacaagucucauggcgaggaagcuugaauuugggacagacaguacauucaaggccuuuucagcuaugcccaaaaccucuuuauguuuuuacauugcggagagagaauacugcaagagcugcagugaagaggacacacaaaaauguguugacacaaaacuugagcagccacagagcauacuaauugagcacaaaggaacgauaauuggaaagcagaaugauacuugcacagccaaggcaagcuguuggcuagagucagucaagaguuuuuuuuauggauugaaaaauaugcuugguaguguauuugguaacuuuuucauaggcauuuuguuauuccuugccccuuuuguccuguuggugcuuuucuuuauguuuggauggaaaaucuuguuuugcuucaaauguugcaggaggaccagaggcuuacuuaaguauagacuccucaaagacgaugaggaaacaggcuacagaaggauuauugaaagacugaacaacaaaaaaggaaaaaacagacugcuugauggugaaagguuggcugauaggaaaauugcugagcuguucuccacgaaaacacacauuggu

SEQ ID NO: 4016 - RNA, 1932 nt, Artificial Sequence
  derived and/or modified CDS sequence (wt) from CCHFV(TADJ/HU8966)__AY179962.1__Gc
uuccuggauaguauagucaaaggcaugaaaaauccgcuaaacuccacaaguuuagaaacaagcuugucgauugaggcaccauggggggcaauaaauguucagucaacuuacaagccaacuguuucaacugcaaacauagcacuuaguuggaguucaauugaacacagagguaauaauauuuugguuucaggcagaucagaaucaauuaugaagcuggaagaaagaacaggaauuaguggggaucuuggcguugaagaugccucugaauccaagcuacuuacagucucuguuauggacuugucucagauguacuccccugucuucgaguacuuaucaggugacagacaaguagaagaguggcccaaggcaaccuguacaggugacugcccagaaagauguggcugcacaucaucaaccugcuuacauaaagaauggccccauucacgaaacuggagaugcaaucccacuuggugcugggggguggggacuggcugcaccuguuguggauuagaugugaaagaccuauuuauagauuauauguucgucaaguggaaaguugauuacauuaaaacagaagccauaguguguguagaacucaccagucaggaaaggcaguguagcuugguugaggcgggcacaagguucaauuuagguccugugaccaucacauugucagaaccgaggaacauacaacaaaagcucccuccugaaauaaucacauugcauccuaggauugaagaagguuuuuuugaucuaaugcaugugcaaaaagugcugucagcaagcacaguguguaaauugcagaguugcacacauggugugccaggagaucuacaggucuaccacaucggaaacuuauuaaaaggagauaaagagaacggacaccuaauucauaaaauugagccgcacuucaauacuuccuggauguccugggauggcugugaccuagacuacuacugcaacaugggagacuggccuucuugcacauauaccggaguuacccagcacaaucaugcuucauuuguaaaccugcucaacauugaaacugacuauacaaaaagcuuccacuuucacucuaaaaggguuacugcacacggagacacaccacaauuggaucugaaggcaagaccaacuuacggcgcaggagaaaucacuguacugguagaaguugcugauauggaguuacacacgaagaagauugaaauaacaggccucaaauuugcaagccugacuugcacagguuguuaugcuuguaguucaggcauuuccugcaaaguuaggauucauguggacgagccagaugaacuuacaguacauguuaaaagugaugauccagauguaguugcagcuagcucaagucucauggcaaggaagcuugaguucgggacagacaguacauucaaagcuuucucagccaugccuaaaacuuccuuaugcuucuacauugucgaaagggaguaccguaagagcuguaguaaagaggacacacagaaauguguuaacacaaaacuugagcaaccacagagcauuuugaucgaacacaagggaacuauaaucggaaagcaaaauaauacuugcacagccaaagcaaguugcugguuagagucagucaaaaguuucuuuuauggucuaaagaacaugcuuaguggcauuuuuggcaauguuuuugugggcauuuucuuguuucuugccccuuuuaucuuguuaauacuuuucuuuauguuuggauggaggauccugucuugcuuuaaguguugcagaagaaccaggggccugcuuaagcauagacaucucaaagacgaugaagaaacugguuacagaaggaucauugaaagacugaacaacaagaaggggaaaaacaagcugcuugauggugaaagacuugccgauagacggauugccgaacuauucuccacaaaaacacacauuggc

SEQ ID NO: 4017 - RNA, 1932 nt, Artificial Sequence
  derived and/or modified CDS sequence (wt) from CCHFV(Hodzha)__AY223476.1__Gc
uuccuggauaguauaguuaaaggcacgaaaaaucuguuaaacuccacaaguuuagaaacaagcuugucgauugaggcaccauggggggcaauaaauguucagucaaccuacaaaccaacuguaucaacugcaaacauagcacuuaguuggaguucaguugaacacagagguaauaagauuuugguuucaggcagaucagaaucaauuaugaagcuggaagaaagaacaggaaucagcugggaucuuggcguugaagaugccucugaaucuaagcuacuuacugucucugucauggacuugucucagauguacuccccugucuucgaguacuuaucgggugacagacaaguagaagaguggcccaaagcaaccugcacaggugacugcccagaaagauguggcugcacaucaucaaccugcuuacauaaagaauggccccauucacgaaacuggagaugcaaucccacuuggugcugggggguggggacuggcugcaccuguuguggauuagaugugaaagaccuauuuacagauuauauguucgucaaguggaaaguugauuacauuaaaacagaggccauaguguguguagaacucaccagucaggaaaggcaguguagcuugguugaggcgggcacaagguucaauuuagguccuguaaccaucacauugucagaaccgaggaacauacaacaaaagcucccuccugaaauaaucacauugcauccuaggauugaagaagguuuuuuugaccugaugcauguacaaaaagugcugucagcaagcacaguguguaaauugcagaguugcacacauggugugccaggagaucuacaggucuaccacaucggaaauuuauuaaaaggggauaaagugaacggacaccuaauucauaaaauugagccgcacuucaauacuuccuggauguccugggauggcugugaccuagacuacuacugcaacaugggagacuggccuucuugcacauauaccggaguuacccaacacaaucaugcuucauuuguaaaccugcucaacauugaaacugacuauacaaaaagcuuccacuuucacucuaaaaggguuacugcacauggagacacaccacaauuggaucugaaggcaagaccaaccuacggcgcaggagaaaucacuguacugguagaaguugcugauauggaguuacacacaaagaagaucgaaauaacaggccuuaaauuugcaagccugacuugcacagguuguuaugcuuguaguucaggcaucuccugcaaaguuaggauucacguggaugaaccagaugagcuaacaguacauguuaaaagugaugacccagauguaguugcagccagcucaagucucauggcaaggaaacuugaguuuggaacagacaguacauucaaagcuuucucagccaugccuaaaacuuccuuaugcuucuacauugucgaaagggaguacuguaagagcugcaguaaagaagacacacagaaauguguuaacacaaaacuugagcaaccacagagcauuuugaucgaacgcaagggaacuauaaucggaaagcaaaacaauacuugcacagccaaggcaaguugcugguuagagucaguuaaaaguuucuuuuauggucuaaagaacaugcuuaguggcauuuuuggcaauguuuuuguaggcauuuucuuauuucuugcccccuuuaucuuguuaauacuuuucuucauguuuggauggaggauccuguuuugcuucaaguguugcagaagaaccaggggccuguuuaaguauaaacaucucaaagacgaugaagaaacugguuacagaaggaucauugaaagacugaacaacaagaaggggaaaaacaagcugcuugacggugaaagacuugccgauagaaggauugccgaacuauucuccacaaaaacacacauuggc

SEQ ID NO: 4018 - RNA, 1932 nt, Artificial Sequence
  derived and/or modified CDS sequence (wt) from CCHFV(Kosovo/9553/2001)__AY675511.1__Gc
uucuuagacaguauagucaaagguaugaaaaauuugcuaaacucaacaagcuuggaaacaagcuuaucaauugaggcaccauggggagcaauaaauguccagucaaccuuuaaaccaacaguaucgacugcgaacauagcacucaguuggagcucaguggagcacagaggcaacaagaucuuagucacaggcaggucugaaucaauuaugaaacuagaggaaaggacaggagucagcugggaucuagggguagaagaugccucugaauccaaauuacuuaccgucucuaucauggauuugucacagauguauuccccaguuuuugaguacuugucuggagacagacagguugaagaauggcccaaagcaacuuguacaggugacugcccagaaagguguggcugcacaucaucaaccugcuugcauaaagaauggccucauucaagaaacuggagauguaaucccacuuggugcuggggagugggaaccggcugcaccugcugcgggguggauguaaaagaccuuuuuacagaucacauguuugucaaauggaagguugaauauauaaaaacugaagccauaguguguguugagcucaccagccaagaaagacagugcagucugauugaggcagguacuagauucaacuugggcccugugacuauuacccugucugagccaagaaacauucagcagaagcuucccccugagaucauuacguugcaucccaaaauugaggaaggcuucuuugacuugaugcauguacaaaaaguguuguccgcaaguacaguguguaaacugcagaguugcacacaugguauaccaggagaucuacaaguuuaccacauuggcaacuuguugaaaggggauagaguaaacgggcaucuaauucacaaaauugaaccacauuucaacaccucuuggauguccugggaugguugugacuuagacuacuacugcaacaugggggacuggccuucuuguacauacacaggagugacccagcauaaucaugcugcauuuguaaacuugcuuaacauugaaacugauuacacgaaaaccuuccacuuccacucuaaaagagucacagcacauggugacacaccacaauuggacuuaaaagcaaggccgaccuacggugcaggagagaucacugugcugguugagguugcugacauggaguugcauaccaagaaaguugagauaucgggcuugaaauuugcaagucuggcuugcacagguugcuaugccuguagcucuggcaucuccuguaaagucaggauucauguagaugaaccagaugagcucacagugcauguaaagagcagugacccagauguuguugcagcuagcacaagccucauggcaaggaagcuugaauuugggacagacagcacauucaaggccuuuucagcuaugcccaaaaccucuuuauguuuuuacauuguggagaaagaauacugcaagagcugcagugaagaugauacaaaaaaauguguugacacaaaacuugagcagccacagagcauacuaauugagcacagagggacgauaauuggaaagccgaaugauacuugcccagccaagacaagcuguuggcuagaguccgucaagagcuuuuuuuauggauugaagaauaugcuuggcagugucuuugguaauuuuuucauaggcauuuuguuauuccuugccccuuuuuuccuguggaugcuuuccuuuauguuuggauggaaaaucuuguucugcuuuaaauguugcaggaggaccagaggccuguuuaaguauagacaccucaaagacgaugaggaaacaggcuacagaaggauuauugaaaggcugaacaacaaaaaagggaaaaauagacugcuugauggugaaagguuggcugauaggaaaauugccgagcuguuuucuacaaaaacacacauuggc

SEQ ID NO: 4019 - RNA, 1932 nt, Artificial Sequence
  derived and/or modified CDS sequence (wt) from CCHFV(SPU41/84)__AY900142.1__Gc
uucuuagauaguauaguuaagggcaugaaaaauuugcuaaacucaacaaguuuagagacaaguuuaucaauugaggcaccauggggagcaauaaauguucagucaaccuacaaaccaacuguaucaacugcaaacauagcgcuuaguuggagcucaguggaacacagaggcaauaagauacugguuucaggcagaucagaaucaauuaugaagcuggaagaaaggacaggaauaagcugggaucucgguguggaagacgccucugagucuaaacugcuuacagucucugucauggacuugucucagauguacucaccugucuucgaguacuuaucaggagacagacagguggaggaguggcccaaagcaacuuguacgggugacugcccagaaagauguggcugcacaucaucaaccugcuugcacaaagaauggccccacucaagaaauuggagauguaaucccacuuggugcugggguguaggaacuggcugcaccuguuguggauuagacgugaaagaccucuuuacagauuauauguuugucaaguggaaaguugaauacauuaagacagaagcaauaguguguguagaacuuacuagucaggaaagacaguguagcuugauugaagcgggcacaagguucaacuuggguccugugaccaucacauugucagaaccaagaaacauccagcaaaagcucccaccugaaauaaucacacugcaucccaggauugaggaggguuuuuuugaccugaugcauguacaaaaaguguugucggcaagcacaguguguaaguugcagaguugcacacauggugugccaggagaucuacaggucuaccacaucggaaauuuacuaaaaggggauaagguaaaugggcaccuaguucauaaaauugagccacacuucaauacuucuuggauguccugggaugguugugaucuagacuauuauugcaacaugggagauuggccuucuugcacauacacaggaguuacccagcacaaucaugccucauuuguaaacaugcucaacauugaaacugauuacacaaaaaacuuccacuuucacucuaaaagggucacugcacacggagacacaccacaacuagaucuuaaagcaagaccaaccuauggugcaggugagaucacuguauugguggagguugcugacauggaguuacacacaaagaagauugaaauaucaggcuuaaaauuuacuagcuugacuuguacagguuguuaugcuuguaguucuggcaucucaugcaaaguuagaauucauguggaugaaccagaugagcuuacagugcauguuaaaagugaagauccagauguuguugcagcuagcucaagucucauggcaagaaagcuugaauuuggaacagacaguacauuuaaagcuuuuucagccaugccuaaaacuucucuauguuucuacauuguggaaagagaauacuguaagagcugcagugaagaagacacacaaaaauguguuaacacaaaacuugagcagccacagagcauuuugaucgaacguaagggaacuauaaucgggaagcaaaacaacacuugcaaggcuaaggcggguugcugguuagagucaguuaagaguuuuuuuuacggccuaaagaacaugcucaguggcauuuuuggcaauguauuuauaggcauuuucuuauuccuugcccccuucauccuguuaauacuauucuuuauguuuggguggaggaucuuguuuuguuuuaaguguuguagaagaaccagaggccuguucaaguacagacaccugaaagacgaugaagaaacugguuauagaaagaucauugaaagacuaaacaacaaaaaagggaaaaauaaacugcuugauggugaaagacuugcugauagaagaauugccgaacuguucucuacaaaaacacacauuggc

SEQ ID NO: 4020 - RNA, 1932 nt, Artificial Sequence
  derived and/or modified CDS sequence (wt) from CCHFV(UG3010)__AY900143.1__Gc
uaccuagacagcauagccaaggggaugaaaagucugcuaaauucuacgaauuuagagacaagccugucgauugaggccccguggggagcaaucaauguucagucaacuuuuaaaccaacaguuucagcugccaauauagcacuuagcuggaguucaguugaacacaggggcaacaaaauccuaguuucgggcaggucagagucaauuaugaagcuggaagaaaggaccgguaucagcuggagccuagguguagaggaugcuucugagucaaagacgcugacuguuucugucauggaccuaucccaaauguauucucccgucuuugaguaucugucaggugauagacagguagaagaguggccaaaagccaccugcacaggcgacugccaagagagauguggcugcacuucuucaaccugcuugcauaaagaauggccacacucgagaaacuggcgaugcaaccccacuugguguuggggaguggggacuggcugcaccugcuguggauuggaugugagagaccuuuucacggacuacaugaugguuaaguggaaaguggaauauguaaaaacagaagcuauaauguguguugagcuaaccagucaggagaggcaauguaguuugauugaagcagguacaagauuuaaccuaggcccugugacaauaacccugucagagccaagaaacauccagcaaaggcucccuuccgaaaucguuacacugcacccuaagauagaagaaggguucuuugacuugaugcaugugcaaaagguacuaucugcaaguacagucugcaaacuacagagcugcacacacggugucccuggcgaucuacaggucuaccauguuggcaaccuacugaaaggagauaaggucaaugggcacucaauccacaagauagagucccauuucaacacuucauggaugucaugggauggaugugaucuagacuacuucugcaacaugggugacuggcccucauguacauacacuggagugacacagcacaaccgugcggcauucaucaauaugcucaauauugagacugauuauacaaagacuuuccacuuccauuccaagagaguaacggcacauggugacaccccucaacuggaucugaaggcaaggccuacauauggugcaggcgaagucacuguucuaguagagguugcagaucuggagcuacacaccaagaaaauugaagugucaggacugaaguuugcaagucugaccugcuccgguuguuacgccugcagcuccgguaucuccugcaaaguuagaauucaugugaaugaaccagaugaauuuacuguacaugugaaaagcagugauccagauguuguggcagcaggaucaaguuugauggcaaggaaaauagaguuuggggcugacagcaccuucaaagcuuucucaucaaugccuaaaaacucuuugugcuucuauauaguggaaagagacuacugcagcagcugcaccaaugaugacacucagaaguguguugacacaaagcucgaacauccacaaagcauauuaauugagcauaagggaacaauaauuggcaaacaaaacgacaccuguucgaccaaaacaagcuguuggcuagaaucagucaagaguuuuuuuuauggacuaaaaaacaugcuggguggcaucuucgguaaugucuucuuaggcaucuuccuguuccuugcuccuuuugcacugcuaauauucuucuucuucuucggguggaggcuucuguucugucugaaguguugcagaagaaccagggggcugcuaaaguauaaacaacuuaaggacgaagaagaagccggguacaagaaaaucaucgagaggcuaaaugacaaaaaaggcaaaagucgacuguuugacggagagaggcuugcagauaggaagauugcagaacucuuuucaaccaaaacucauauaggg

SEQ ID NO: 4021 - RNA, 1932 nt, Artificial Sequence
  derived and/or modified CDS sequence (wt) from CCHFV(Hy13)__AY900145.1__Gc
uuuucagacaguauugucaaaggcaugaagaacuugcuaaauucaacaagcuuagaaacaagcuuaucaauugaggcaccauggggagcuauaaauguccaaucaaccuucaaaccuacuguguccgcugcgaacauagcucuuaguuggagcucaguggaacacagggguaauaagauuuugguuucagguagaucagagucaauuaugaagcuagaggaaaggacaggaaucagcugggaucuagggguagaagaugccucugagucuaaauugcuuacugucucuauuauggacuugucacagauguauucuccugucuuugaguaccuaucaggugauagacaaguggaggaauggcccaaggcaaccugcacaggagauugcccagaaagauguggcugcacaucaucaaccugccuacacaaagaauggccccauucaagaaacuggagaugcaaccccaccugguguuggggagucggcacuggauguaccugcugugggcuggauguaaaagaccuuuuuacagaucacauguuugucaaguggaaaguugaguacauuaaaacagaagcuauaguguguguugagcuuacuagccaagagagacaauguagcuugauugaggcaggcacaagauucaacuuagguccugugaccaucacauugucagagccaagaaacauucagcaaaagcucccuccagagauaguuacauugcaucccagaauugaagaagguuucuuugauuuaaugcauguaaaaaaagugcuaucagcaaguacaguauguaagcuacagaguugcacacauggugugccaggggaccuacaggucuaccacauaggaaacuuguuaaaaggagacaaggugaaugggcaccugauucacaaaauugaaccacacuucaacacuuccuggaugucuugggacggcugugaccuagacuacuacuguaauaugggagacuggccaucuugcucauauacuggaguaacccagcacaaucaugcugcauuuguaaacaugcucaacaucgaaacugauuauacaaaaaucuuccacuuucacucuaagagaguuacugcacauggagacacaccacaauuagauuugaaagcuagaccaacuuauggugcaggugaaaucacugugcuaguggaaguugcugacauggaguuacacacaaagaaaauugagauaucagguuuaaaguuugcaagcuuaacuugcacaggcuguuaugcuuguagcucugguaucuccuguaagguuagaauccauguagaugagccugaugagcuuacaguacaugugaagagugaagacccagacauaguugcugcuagcucaagucucauggcuagaaaacuugaauuugggacagauagcacauucaaagccuuuucagccaugcccaaaaccuccuugugcuuuuacauuguggagagagaauauuguaaaagcugcaguaaagaagauacacaaaaaugugucaacacaaagcuugagcaaccacagagcauuuuaauugagcacaaaggaacgauaauugguaagcaaaacgacaccugcacaucuaaagcaggcuguuggcuagagucagucaagagcuucuuuuaugggcuaaaaaacaugcuuaguggcauuuuuggcaauguuuucauagggauuuucuuauuccuugcuccuuuuauccuuuuaauacuuuucuuuauguuuggauggagaauccuguucugcuuuaaauguugcagaagaacuagaggcuuauuuaaguacagacaccucaaggacgaugaagaaaccgguuacaggaaaaucauugagaggcugaacaacaaaaaagggaaaaacaaacugcuugauggugaaagauuagcugauaggaagauugcugagcuguucuccacaaagacacacauuggc

SEQ ID NO: 4022 - RNA, 1932 nt, Artificial Sequence
  derived and/or modified CDS sequence (wt) from CCHFV(Semunya)__DQ094832.1__Gc
uuccuggauagcauagccaaggggaagaaaagucuguuaaauucuacgaacuuagagacaagccugucgauugaggccccauggggagcaaucaauguucagucaacuuuuaaaccaacaguuucagcugccaacauagcacuuagcuggaguucaguugaacacaggggcaacaaaauccuaguuucgggcaggucagagucaauuaugaaacuggaagaacggaccggcaucagcuggagccuagguguagaggaugcuucugagucaaagacgcuuacuguuucugucauggaccugucucaaauguauucuccugucuuugaguaucugucaggugauagacaaguagaagaguggccaaaggccacuugcacaggcgacugcccggagagauguggcugcaccuccucaaccugcuugcauaaagaauggccgcacucgagaaacuggcgaugcaaccccacuugguguuggggaguagggacuggcugcaccugcuguggacuggauguuagagaccuuuucacggacuacaugauggucaaguggaaaguggaauauguaaaaacagaagcuauaauguguguugagcuaacuagucaggaaaggcaguguaguuuaauugaggcagguacaagguuuaaccuaggcccugugacaauaacccugucagagccaagaaauguccagcaaaggcuucccuccgaaaucguuacacugcacccuaagauagaggaaggauucuuugauuugaugcaugugcaaaaaguacuauucugcaaguacaguuugcaagcuacaagcugcacacacggcgucccaggcgauuugcaggucuaccauguuggcaaccuacugaaaggagacaagguuaaugggcacucaauucacaagauagagucucauuucaacaccucauggaugucaugggauggaugugaccuagacuacuuuugcaacaugggugacuggccuucauguacauauacuggagugacacagcacaaucgugcggcauucgucaacaugcucaauauugagacugauuauacaaagacuuuucacuuccauuccaagaggguuacggcacacggugacaccccucaacuggaucugaaggcaagaccaacauauggugcaggcgaggucacuguucuaguggagguugcagaucuggagcuacacacuaagaaaauagaagugucaggguugaaguuugcaagucugaccugcuccgguuguuaugccugcaguuccggcaucuccugcaaaguuagaauucaugugaaugaaccagaugaguucacaguacacgugaaaagcaaugauccagacguuguggcagcaggaucaagucugauggcaaggaaaauagaguuuggggcugacagcaccuuuaaagccuuuucaucaaugccuaaaaacucuuugugcuuuuauauaguggaaagagacuacugcagcagcugcaccgaugaugacacucagaaguguguuaacauaaagcucgaacauccacaaagcauauuaauugagcauaagggaacaauaauugguaagcaaaaugacaccuguccgaccaaaacaagcugcuggcuagaaucagucaagaguuuuuuuuauggacugaaaaacaugcuggguggcaucuucggcaaugucuucuuaggcaucuuccuauuccuugcuccuuuugcacugcugauacucuucuucuucuuuggauggaggcuucuguucugucugaaguguugcagaaggaccaggggucugcuaaaguauaaacaacuuaaggaugaagaagaagccggguacaagaaaaucaucgagaggcugaaugacaaaaagggcaaaagucgacuuuuugauggagagaggcucgcugacaggaagauugcuaaacucuucucaaccaagacucauauaggg

SEQ ID NO: 4023 - RNA, 1932 nt, Artificial Sequence
  derived and/or modified CDS sequence (wt) from CCHFV(SPU128/81/7)__DQ157174.1__Gc
uuccuagauaguauaguuaaaggcaugaaaaaucugcuaaacucaacaaguuuagaaacaaguuuaucaauugaggcaccauggggggcaauaaauguucagucaaccuacaaaccaacugugucaacugcaaacauagcacucaguuggagcucuguggaacacagaggcaauaagaucuugguuucaggcagaucagaaucaauuaugaagcuggaagaaaggacaggaaucagcugggaucucggcguagaagacgccucugagucuaaacugcuuacagucucugucauggacuugucucagauguacucuccugucuucgaguacuuaucaggagacagacagguggaagaguggcccaaagcaacuuguacaggugacugcccagaaagaugcggcugcacaucaucaacguguuugcacaaagaauggccccauucaagaaauuggagaugcaaucccacuuggugcugggguguagggacuggcugcaccuguuguggauuagaugugaaagaccuuuuuacagauuauauguuugucaaguggaaaguugaauauauuaagacagaggccauaguguguguagaacuuaccagucaggaaaggcaguguagcuugauugaagcgggcacaagguucaauuuagguccugugaccaucacacugucagaaccaagaaacauccaacagaagcucccuccugaaauaaucacacugcaucccaggaucgaagaagguuuuuuugacuugaugcauguacagaaaguguuaucggcaagcacaguauguaaguugcagaguugcacacaugguguaccaggagaccuacaggucuaccacaucggaaauuuauugaaaggggauaagguaaauggacaucuaauucauaaaauugagccacacuucaacacuuccuggauguccugggaugguugugaccuggacuacuacugcaacaugggagauuggccuucuugcacauacacaggagucacccaacacaaucaugcuucauuuguaaaccugcucaacauugagacugauuacacaaaaaacuuccacuuucacucuaaaagggucacugcacacggagacacaccacaacuagaucuuaaggcaagaccaaccuauggugcaggugagaucacuguacugguagaaguugcugacauggaguuacacacaaagaagauugaaauaucaggcuuaaaauuugcaagcuugacuugcacagguuguuaugcuuguagcucuggcaucucaugcaaaguuagaauucauguggaugaaccagaugaacuuacaguacauguuaaaagugaugauccagauguaguugcagcuagcucaagucucauggcaagaaagcuugaauuuggaacagacaguacauuuaaagcuuucucagccaugccuaaaacuucucuauguuucuacauuguugaaagagaacacuguaagagcugcagcgaagaagacacaaaaaaaugugucaacacaaaacuugagcaaccacaaagcauuuugaucgaacacaagggaacuauaaucggaaagcaaaacagcacuugcacagccaaggcgaguugcugguuagagucagucaaaaguuuuuuuuauggucuaaagaacaugcuuagugguauuuuuggcaauguuuuuauagguauuuucuuguuccuuggccccuucaucuuguuaauacuauucuuuauguuuggguggaggauccuauuuugcuuuaaauguuguagaagaacuagaggccugcucaaguauagacaccucaaggaagaugaagaaacugguuauagaaggauuauugaaagacuaaacaauaaaaaaggaaaaaacaaacugcuugauggugaaagacuugcugauagaagaauugccgaacuguucucuacaaaaacacacauuggc

SEQ ID NO: 4024 - RNA, 1932 nt, Artificial Sequence
  derived and/or modified CDS sequence (wt) from CCHFV(ROS/HUVLV-100)__DQ206448.1__Gc
uucuuagacaguauaguuaaaggcaugaagaauuugcuaaacucaacaagcuuagaaacaagccuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguagaagaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcuggggaguaggaacuggcugcaccugcugcgggguggauguaaaagaccuuuuuacagaucacauguuugucaaauggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacauugcaucccaaaguugaagagggcuucuuugacuugaugcaugugcaaaaagugcugucugcaaguacaguguguaaacugcagaguugcacacaugguauaccaggagaucuacaaguuuaccauauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacaucgaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcauaccaagaaaguugagauaucaggcuuaaaauuugcaagucuggcuugcacggguugcuaugcuuguagcucuggcaucuccuguaaagucaggauucauguagaugagccagaugagcucacaguacauguaaagagcagugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaaugauacuugcacagccaaggcaagcuguuggcuagagucagucaagaguuuuuuuuauggauugaaaaauaugcuugguaguguauuugguaauuuuuucauaggcauuuuguuauuccuugccccuuuuguccuguuggugcuuuucuuuauguuuggauggaaaaucuuguuuugcuucaaauguugcaggaggaccagaggcuuacuuaaguauagacuccucaaagacgaugaggaaacaggcuacagaaggauuauugaaagacugaacaacaaaaagggaaaaaacagacugcuugauggugaaagguuggcugauaggaaaauugcugagcuguucuccacaaaaacacacauuggu

SEQ ID NO: 4025 - RNA, 1932 nt, Artificial Sequence
  derived and/or modified CDS sequence (wt) from CCHFV(AP92)__DQ211625.1__Gc
uuuuuggauagcauagcuaaagguguuaagaaccucuugaacucaacaagccuggaaacuagcuugucaauugaagcaccauggggggccaucaaugcccaaucaacuuacaaaccaacugcaucaagugcuaauauugcucuaacauggagcucaguggaacacaggggcaacaagaucuuggucucaggcaggucugaaucaauuaugaaacuugaagagaggaccggaauaagcuggaacuugggcguugaagaugcuucugagucaagaacacucaccaucuccgucauggaucuaucacagauguauuccccugucuuugaguaccugucaggagaucgucagguggaggaauggccaaaggcaaccugcacuggcaacugcccggagagaugcggcugcacaucgucaaccugccuuuacaaggaguggccacauucgagaaacuggagaugcaaccccaccugguguugggggguugggacuggcugcacaugcuguggacuagaugucaaagaacuguucacggaucacaugcuaguaaaauggaaaguugaguacaucaagacagaggccauaguguguguugagcuuaccagucaagaaaggcagugcaguuugauugaagcagguacgagauuuagcuuaggaccaguaacaaucaccuugucugagccaaggaacauucagcagaagcuuccuccugaauuaauuacauuacacccaaagauagaagacggcuacuuugacuuaaugcauguucaaaagguuauguccgccaguacagugugcaagcugcaaaguugcacacacggugugcccggggacuugcaaauuuaucauguuggcaaucuguugaagggggacagagugaaugggcaccugauccacaagguugagccacaccugaacacauccuggaugucgugggaugguugugacuuagacuauuucugcaauaugggggacuggcccuccugcacauacaccggggugacacaacacaaucaugccgcauuugcaaaucugcuuaacauugaaaccgacuauacaaagacuuuccauuuccacuccaaaagagugacggcccauggagacacaccacagcuggacuugaaggcaaggccuagguauggugcaggugaaaucacuguucugguugaaguagcugauauggaguuacauacaaagaaggucgagguaacaggcuuaaaauuugcaagccuaacuuguucaggaugcuaugccuguaguucagguaucuccugcaagguuagaauacauguggacgagccagaugagcucacagugcaugugaaaagcagcgacccagacauuguggcagccagcucaagucucauggcaaggaagauugaguuugggguugacaguacuuucaaagcguucuccucuaugccuaaagauucucugugcuuuuauauugucgaaagagacuauugcaacagcugcaaaaaugaggaaacacagaggugugugaacgcaaagcuugaacagccacagagcauccucaucgaacauacagguacaaucauuggcaagcagaacgacaccuguggaucuaggacaagcugcuggcuagacucauuuaaaaguuucuuuuauggacuaaagagcauguugagcggcauuuuugguaaugucuuucuaggcaucuucuuguuucuugcccccuuugcucugcugcuguuuuucuuuuucuuuggauggagaauccuguuuugcuuuaagugcuguagaagaaccagaggccuguuuaaauacagacacaucaaggacgaugaagagguuggcuacaaaaaaaucaucgaaagacugaacaauaaaaaaggcaaacacagacuucuugacggcgagagacuugcagauaggaagaucgcugaacuuuucucaacuaagacacacauugga

SEQ ID NO: 4026 - RNA, 1932 nt, Artificial Sequence
  derived and/or modified CDS sequence (wt) from CCHFV(ArD8194)__DQ211626.1__Gc
uucuuagauagaauagccaagggaaugaaaagcuuguugaacuccacaaguuuagaaacgagcuugucaauugaagcuccauggggggcaaucaauguucaaucaacuuucaaaccaacaguuucagccgccaauauagcacuuagcuggaguucaguugaacacaagggcaacaagaucuuaguuucaggcagaucagagucaauuaugaaauuagaagaaagaacuggaaucagcuggugucuagguguggaagaugccucugagucaaaaacacucaccguuucuguuauggaucugucucaaauguauucuccuguuuucgaguaccugucaggugaccgacagguggaggaguggccaaaagcaaccugcacaggugacuguccagaaagauguggcugcacuucaucaaccugccugcauaaggaguggccgcacucgaggaacuggcgcuguaaccccacuugguguuggggggugggaacuggcugcaccugcugugggcuagauguaaaggaucucuucacagacuacauguugguuaaauggaaaguggaauauauaaaaacagaagccauaauauguguugagcuuacuagucaagagaggcaguguaguuuaauugaagcaggcacaagguuuaaccuaggcccugugacaauaacucuaucagaaccaaggaacguacagcagaggcuuccucccgagaucaucacacugcacccuaaaauagaagaaggguuuuuugauuugaugcauguacagaagguaaugucugcaagcacgguuuguaagcugcaaagcuguacucauggugugccuggagacuuacaagucuaccauguuggcaacuuguuaaagggggacaaagucaaugggcacucaauccacaagauagaaucacaccucaacaccucauggaugucaugggaugggugugauuuagacuauuuuugcaacaugggggacuggcccucaugcacauacacaggggugacacaacacaaccaugcugcauucaucaacaugcuuaacauugagacugauuacacaaaaaccuuucacuuucauucaaaaagggucacagcacacggagacaccccucaguuggaccuaaaagcgagaccagcauauggugcaggcgaaaucacuguucuaguagaaguugcagauuuagaacugcacacgaagaaaauugaagugucgggucugaaauucgcaaguuugucaugcuccggauguuaugcuugcagcucuggcaucuccugcaaaguuaggauucauguaaaugaaccggaugaauucacaguacauguaaaaaguaaugacccagauguuguagcagcaggaucaagucucauggcuagaaagauagagucuggggccgacagcacguuuaaggcuuuuucaucaaugccaaaaaacucucuauguuuuuacauaguagaaagagauuauuguagcagcuguacagaugaugacacucagaaauguguugacauuaaacuugaacauccacagagcauacucauugaacacaaaggaacgauuauuggcaagcagaaugacaccuguccaacuaaaacaagcugcugguuggaaucuauuaagaguuuuuuuuaugggcuuaaaaacaugcugagugggaucuucgguaauguuuucuuaggcaugcuccuguuucuugcuccuuuuauauugcuaauauuguuuuucuucuucggguggagacuucucuuuugccuuaagugcuguagaaggaccagaaagcugcuaaaguauaagcaccuuagggacgaagaagagagugguuacaaaaaaaucauugaaaggcuaaaugacaaaaaaggcaaaagucgauuguuugauggagaaaggcuugcagacagaaagauugccgaacucuuuucaacuaaaacucauauaggu

SEQ ID NO: 4027 - RNA, 1932 nt, Artificial Sequence
  derived and/or modified CDS sequence (wt) from CCHFV(ArD15786)__DQ211627.1__Gc
uccuuagauaguauagccaagggaaugaaaagcuuguugaacuccacaaguuuagaaacgagcuugucaauugaagcuccauggggggcaaucaauguucaaucaaccuucaaaccaacaauuucagccgccaacauagcacuuagcuggaguucaguugaacacaagggcaacaagaucuuaguuucaggcagaucagagucaauuaugaaauuagaagaaagaacuggaaucagcuggugucuagguguggaagaugcuucugaaucaaaaacacucacuguuucuguuauggaucugucucaaauguauucuccuguuuucgaguaccugucaggugaccgacagguggaggaguggccaaaagcaaccugcacaggugacuguccagaaagauguggcugcacuucaucaaccugccuacauaaggaguggccgcacucgaggaacuggcgcuguaaccccacuugguguuggggggugggaaccggcugcaccugcugugggcuagauguaaaggaucucuucacagacuacauguugguuaaauggaaaguggaauauauaaaaacagaagccauaauauguguugagcuuacuagucaagagaggcaguguaguuuaauugaagcaggcacaagguuuaaccuaggcccugugacaauaacucuaucagaaccaaggaacguacagcagaggcuuccccccgagaucauuacacugcacccuaaaauagaagaaggguuuuuugauuugaugcaugugcagaagguaaugucugcaagcacgguuuguaagcugcaaagcuguacucacggugugccuggagacuuacaagucuaccauguuggcaacuuguuaaagggggacaaagucaaugggcacucaauccacaagauagaaucgcaccucaacaccucauggaugucaugggaugggugugauuuagauuauuuuugcaacaugggggacuggcccucaugcacauacacaggggugacacaacacaaccgugcugcauucaucaacaugcuuaacauugagacugauuacacaaaaacuuuucacuuucauucaaaaagggucacagcacacggagacaccccucaguuggaccuaaaagcgaggccaacauauggugcaggcgaaaucacuguucuaguggaaguugcagauuuagaacuacacacgaagaaaauugaagugucgggucugaaauucgcaaguuugacaugcucuggauguuaugcuugcagcucuggcaucuccugcaaaguuaggauucauguaaaugaaccggaugaauucacaguacauguaaaaagcaaugacccagauguuguagcagcaggaucaagucucauggcuagaaagauagagucuggggccgacagcacguuuaaggcuuuuucaucaaugccaaaaaacucucuauguuuuuacauaguagaaagagauuauuguagcagcuguacagaugaugacacucaaaaaugcguugacauaaaacuugaacauccacaaagcauacuuauugaacacaaaggaacgauuauuggcaagcaaaaugacaccuguccaacuaaaacaagcugcugguuggaaucuaucaagaguuucuuuuaugggcuuaaaaauaugcugagugggaucuucgguaauauuuucuuaggcaugcuccuguuucuugcuccuuuuguauugcuaauauuguuuuucuucuucggguggagacuucucuuuugccuuaagugcuguagaaggacuagaaagcugcuaaaguauaagcaccuuagggacgaagaagagagugguuacaaaaaaaucauugaaaggcuaaaugacaagaagggcaaaagucgauuguuugauggagaaaggcuugcagacagaaagauugccgaacucuuuucaacuaaaacucauguaggu

SEQ ID NO: 4028 - RNA, 1932 nt, Artificial Sequence
  derived and/or modified CDS sequence (wt) from CCHFV(ArD39554)__DQ211628.1__Gc
uuuuuggacaguacugccaagagcaugaaaagccuguuaaauucaacaaguuuggaaacaagccugucaauugaagcacccuggggggcaauuaauguacagucaacuuucaaacccaccgcuucgacugcaaauauagcgcucaguuggagcucaguagaacacagaggcaauaagauucuuguuacagguagaucagagucgauuaugaaacuggaagaaagaacaggaaucaguuggaaucucgguguggaagaugcuucugaaucaaagacacucacuguaucagucauggacuuaucucagauguauuccacugucuucgaguacuuaucaggcgaccggcaaguagaggaguggccuaaagcaaccugcacaggugauuguccagaaagauguggcuguacaucaucuacuugccuccacaaggcguggccccauucaaggaacuggaggugcaaccccacgugguguuggggaguuggaacugguugcacuugcuguggauuggaugugaaaaaccucuuuacugacuauaugcuuaucaaauggaaaguugaauuuauaaaaacugaagccauaguguguguugaacucacaagccaggaaaggcaaugcagucuuauagaagcaggcacaagauuuaacuugggcccuguuaccaucacuuuaucagaaccaagaaacauucagcagaagcucccuccugaacugguuacgcugcauccaagaguagaagaaggcuucuucgaccuuaugcaugugcagaaagugcuuucugcaagcacuguguguaaauugcagagcugcacgcaugguguaccaggugacuugcaaguguaucauguaggcaacuugcugaaaggggauaaaauaaauggcaacucauuucacaaaauugagccgaaccuaaauacaucauggaugucuugggacggcugugaucuugauuacuacugcaacaugggagacuggcccuccuguacuuacacaggugugacgcagcacaaccaugcugcuuuugugaaccugcucaacauugaaacugacuauacaaagaacuuccacuuucacucaaagagagucacagcacauggagagacgccccagcuagaccuuaaagccagaccaaaguauggagcaggugaggucacaguccugguggaaguugcugacauggagcugcacacuaaaaagauugagauaucagguuugaaauuugcuagccugaccugcacgggcugcuaugcuuguagcucagguaucuccugcaagguuaggcuucauguagaugagccagaugagcucacgguacacgugaagagugaugauccggauguaguugcagccagcucaagccugauggccagaaaaauugaauuuggaacugauagcacauuuaaagcuuucucguccaugccuaaggauaaacucugcuuuuacauuguggaaagagacuacugcagcaguugcagcaaagaggacacacaaaaguguguaaaugcaaaacuugagcagccucagaguauacuuauugaacauaaaggcaccauaauugggaagcaaaaugacacuuguacagucaaggcgagcuguugguuggaaucgguaaaaaguuuuuuuuauggacuaaaaaacauguugggugguaucuucggcaacguuaucuugggcaucaucauguuccuugcuccuuuugccuuguuacugcucuucuuccuuuucggauggagaauucuguucugccuuagaugcugcagaaggacuagggggcuauuuaaguacaaacacaucaaagaugaugaagaaucaggcuacaaaaggauuauugaaagguuaaauaacaagaaagguaagaacaaguuauuugacggcgagagauuggcagacaagaaaauugcugaacuauucucaacgaagacacacauuggc

SEQ ID NO: 4029 - RNA, 1932 nt, Artificial Sequence
  derived and/or modified CDS sequence (wt) from CCHFV(C-68031)__DQ211629.1__Gc
uuuucagacaguauugucaaaggcaugaagaacuugcuaaauucaacaagcuuagaaacaagcuuaucaauugaggcaccauggggagcuauaaauguccaaucaaccuucaaaccuacuguguccgcugcgaacauagcucuuaguuggagcucaguggaacacagggguaauaagauuuugguuucagguagaucagagucaauuaugaagcuagaggaaaggacaggaaucagcugggaucuagggguagaagaugccucugagucuaaauugcuuacugucucuauuauggacuugucacagauguauucuccugucuuugaguaccuaucaggugauagacaaguggaggaauggcccaaggcaaccugcacaggagauugcccagaaagauguggcugcacaucaucaaccugccuacacaaagaauggccccauucaagaaacuggagaugcaaccccaccugguguuggggagucggcacuggauguaccugcugugggcuggauguaaaagaccuuuuuacagauuacauguuugucaaguggaaaguugaguacauuaaaacagaagcuauaguguguguugagcuuacuagccaagagagacaauguagcuugauugaggcaggcacaagauucaacuuagguccugugaccaucacauugucagagccaagaaacauucagcaaaagcucccuccagagauaguuacauugcaucccagaauugaagaagguuucuuugauuuaaugcauguaaaaaaagugcuaucagcaaguacaguauguaagcuacagaguugcacacauggugugccaggggaccuacaggucuaccacauaggaaacuuguuaaaaggagacaaggugaaugggcaccugauucacaaaauugaaccacacuucaacacuuccuggaugucuugggacggcugugaccuagacuacuacuguaauaugggggacuggccaucuugcucauauacuggaguaacccagcacaaucaugcugcauuuguaaacaugcucaacaucgaaacugauuauacaaaaaucuuccacuuucacucuaagagaguuacugcacauggagacacaccacaauuagauuugaaagcuagaccaacuuauggugcaggugaaaucacugugcuaguggaaguugcugacauggaguuacacacaaagaaaauugagauaucagguuuaaaguuugcaagcuuaacuugcacaggcuguuaugcuuguagcucugguaucuccuguaagguuagaauccauguagaugagccugaugagcuuacaguacaugugaagagugaagacccagacauaguugcugcuagcucaagucucauggcuagaaaacuugaauuugggacagauagcacauucaaagccuuuucagccaugcccaaaaccuccuugugcuuuuacauuguggagagagaauauuguaaaagcugcaguaaagaagauacacaaaaaugugucaacacaaagcuugagcaaccacagagcauuuuaauugagcacaaaggaacgauaauugguaagcaaaacgacaccugcacaucuaaagcaggcuguuggcuagagucagucaagagcuucuuuuaugggcuaaaaaacaugcuuaguggcauuuuuggcaauguuuucauagggauuuucuuauuccuugcuccuuuuauccuuuuaauacuuuucuuuauguuuggauggagaauccuguucugcuuuaaauguugcagaagaacuagaggccuauuuaaguacagacaccucaaggacgaugaagaaaccgguuacaggaaaaucauugagaggcugaacaacaaaaaagggaaaaacaaacugcuugauggugaaagauuagcugauaggaagauugcugagcuguucuccacaaagacacacauuggc

SEQ ID NO: 4030 - RNA, 1932 nt, Artificial Sequence
  derived and/or modified CDS sequence (wt) from CCHFV(Drosdov)__DQ211630.1__Gc
uucuuagacaguacaguuaaagguaugaaaaauuugcuaaacucaacaagcuuggaaacaagcuuaucaauugaggcaccauggggagcaauaaauguccagucaaccuuuaaaccaacaguaucgacugcaaacauagcacucaguuggagcucaguggagcacagaggcaacaagaucuuggucacaggcaggucugaaucaauuaugaaacuagaggaaaggacaggagucagcugggaucuaggcguagaagaugccucugaauccaaauuacuuaccgucuccaucauggauuugucacaaauguauuccccuguuuuugaguacuuaucaggagauagacagguugaagaauggcccaaggcaaccuguacaggugauugcccagaaagguguggcugcacaucaucaaccugcuugcauaaagaauggccucacucaagaaacuggagauguaaccccacuuggugcuggggaguaggaaccggcugcacaugcugcggaguggauguaaaagaccuuuuuacagaucacauguuugucaaauggaagguugaauauaugaaaaccgaagccauaguauguguugagcucaccagccaagaaagacagugcagucugauugaggcagguacuagauucaacuuggguccugugacuaucacccugucugagccaagaaacauucagcagaagcuucccccugagaucauuacgcugcaucccaaaauugaagaaggcuucuuugacuugaugcauguacaaaaaguguuaucugcaaguacaguguguaaacugcagaguugcacacaugguauaccaggagaucuacaaauuuaccacauuggcaacuuguugaaaggggauagaguaaacgggcaucuaauucacaaaauugaaccacauuuuaacaccucuuggauguccugggaugguugugaccuagacuacuauugcaacauggggaauuggccuucuugcacauacacaggagugacccaacauaaucaugcugcauuuguaaauuugcuuaacauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaagaaaguugagauaucaggcuugaaauuugcaagucugguuugcacggguugcuaugcuuguagcucuggcauuuccuguaaagucagaauucauguagaugaaccagaugagcucacagugcauguaaagagcagugauccagaugugguugcagcuagcacaagccuuauggcaaggaagcuugaauuugggacagauagcauauucaaggcauuuucagcuaugcccaaaaccucuuuaugcuuuuacauuguggagagggaauacugcaagagcugcagugaagaugauacaaaaaaauguguugacacaaaacuugagcagccacagagcauacuaauugagcacaaagggacgauaauuggaaagcagaaugauacuugcacagccaaggcaaguuguuggcuagagucagucaagaguuuuuuuuauggauugaagaauaugcuuggcaguguuuuugguaauuuuuucguaggcauuuuguuauuccuugccccuuuugucuuguuggugcuuuucuuuauguuuggauggaaaaucuuguuuugcuuuaaguguugcaggaggaccagaggcuuguuuaaguauagacaccucaaagacgaugaggaaacaggcuacagaaggauuauugaaagacugaauaguaaaaaaggaaaaaacagacugcuugauggugagagguuggcugauaggaaaauugcugagcuguucuccacaaaaacacacauuggc

SEQ ID NO: 4031 - RNA, 1932 nt, Artificial Sequence
  derived and/or modified CDS sequence (wt) from CCHFV(Kashmanov)__DQ211631.1__Gc
uucuuagacaguauaguuaaaggcaugaagaauucgcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguagaagaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcuggggaguaggaacuggcugcaccugcugcgggguggauguaaaagaccuuuuuacagaucacauguuugucaaauggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcaugugcaaaaaguguugucugcaaguacaguguguaaacugcagaguugcacacaugguauaccaggagaucuacaaguuuaccacauuggcaacuugcugaaaggggauaggauaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacauugaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcauaccaagaaaguugagauaucaggcuugaaauuugcaagucuggcuugcacggguugcuaugcuuguagcucuggcaucuccuguaaagucaggauucauguagaugagccagaugagcucacaguacauguaaagagcagugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaaugauacuugcacagccaaggcaagcuguuggcuagagucagucaagaguuuuuuuuauggauugaaaaauaugcuugguaguguauuugguaacuuuuucauaggcauuuuguuauuccuugccccuuuuguccuguuggugcuuuucuuuauguuuggauggaaaaucuuguuuugcuucaaauguugcaggaggaccagaggcuuacuuaaguauagacaccucaaagacgaugaggaaacaggcuacagaaggauuauugaaagacugaacaacaaaaaaggaaaaaacagacugcuugauggugaaagguuggcugauaggaaaauugcugagcuguucuccacaaaaacacacauuggu

SEQ ID NO: 4032 - RNA, 1932 nt, Artificial Sequence
  derived and/or modified CDS sequence (wt) from CCHFV(Oman)__DQ211632.1__Gc
uuuuuagacaguauugcuaagggcaugaagaaccugcugaauucaacaagcuuagaaacaagcuuaucaauugaggcaccauggggagcaauaaacguucaaucuacuuucaaaccuacugugucaacugcaaacauagcacuuaguuggagcucaguggaacacagagguaauaagaucuugguuucaggcagaucagagucaaucaugaagcuagaagaaagaacaggaaucagcugggauuugggaguagaagaugccucugaguccaaauuacuuacuguuuccgucauggacuuaucacagauguacucuccugucuuugaguaccuaucaggugacagacaaguagaggaauggccaaaggcaaccuguacaggcgauugcccggaaagauguggcugcacaucaucaaccugccuacacaaggaauggccucacucaagaaacuggagaugcaaccccacuugguguuggggagucggcaccggaugcaccuguuguggacuagauguaaaggaccuuuuuacagauuacauguuuguuaaauggaaggucgaauauauaaaaacagaggcuauaguguguguugagcuuacuagccaagaaagacaauguagcuugauugaggcaggcacaagauucaacuuagguccugugacuaucacauuaucagagccaagaaacauucagcaaaagcucccuccagaaauugucacauuacauccuagaauugaagaagguuuuuuugacuuaaugcauguacagaagguacuaucagcaagcacagugugcaagcuacagaguugcacacauggcguaccaggagacuuacaggucuaccacaucggaaacuuacuaaaaggagacaaagugaacgggcaucugauacauaaaguugaaccacauuucaacaccuccuggaugucuugggacggcugugaccuagauuacuacugcaauaugggggauuggcccucuugcacguauacuggaguuacccaacauaaucaugcugcauuuguaaaccuacuuaacauugaaacugauuacacaaagaacuuccacuuucacucuaagagagucacugcacauggggacacuccacaauuagauuuaaaagccagaccaaauuauggugcaggugaggucacugugcugguggaaguugcugacauggaguuacacacaaagaaaauugagauaucagguuugaaguuugcaagccuaacuugcacagguuguuaugcuuguagcucuggcaucucauguaagguuaggauccauguagaugaaccagaugagcuuacaguacaugugaagagugaagacccagacauaguugcugcuagcucaagucucauggcaagaaagcuugaauucgggacggauaguacauucaaagccuucucagccaugccuaaaaccuccuugugcuuuuacauuguugagagagaauacuguaaaagcugcaguaaagaagacacacaaaaguguguuaacgcaaagcuugagcgaccacagagcauuuuaauugagcacaaaggaacgauaauuggaaagcagaacgacacuugcacagcuaaagcaagcugcuggcuagagucagucaagaguuucuuuuauggacuaaagaacaugcuuaguggcauuuuuggcaauguuuucauagggauuuucuuauuccuugcuccuuuuauccuguuaauacuuuucuuuauguuuggguggagaauccuauucugcuuuaagugcugcaggagaacuagaggccuauuuaaguacagacaccucaaagaugaugaagaaaccgguuauaggaaaaucauugagagacuaaacaacaaaaaagguaaaaacaagcugcuugacggugaaagauuagcugauagaaagaucgcugagcuguucucuacaaaaacacacauuggc

SEQ ID NO: 4033 - RNA, 1932 nt, Artificial Sequence
  derived and/or modified CDS sequence (wt) from CCHFV(SPU97/85)__DQ211633.1__Gc
uuuuuagacaguauuguuaaaggcaagaagaacuugcuaaacucaacaagcuuggaaacaagcuuaucaauugaagcaccauggggugcaauaaauguccaaucaaccuucaaaccuacugugucagcugcaaacauagcacuuagcuggagcucaguggaacacagaggcaacaagauuuugguuucaggcaggucagaaucaaucaugaagcuggaggaaaggacaggaaucagcugggaucugggaguagaagacgccucugaguccaaauugcucaccgucucugucauggacuugucacagauguauucccccgucuuugaguaccugucaggugauagacagguagaagaguggcccaaggcgaccuguacaggcgauugcccagaaagauguggcugcacaucaucaaccuguuugcacaaggaauggccccauucaaggaacuggagaugcaaccccacuugguguuggggggucggcacuggaugcaccuguuguggacuagauguaaaagaccucuuuacagauuacauguuugucaaguggaaaguugaauacauaaaaacagaggccauagugugcgucgaacuuacuagccaagaaagacaauguagcuugauugaagcaggcacaagauucaauuuagguccugugacuaucacauugucagagccaagaaacauucagcaaaagcucccuccagagauaaucacauugcauccuagaauugaagaaggcuuuuuugacuuaaugcaugugcaaaaagugcugucagcaagcacagugugcaagcuacagaguugcacacaugguguuccaggagaccuacaggucuaccacaucggaaacuuguuaaaaggagacaagguaaacgggcaucugauucacaagauugaaccacauuucaacacuuccuggaugucuugggauggcugugaccuagacuacuacugcaauaugggggacuggccuucuugcacauacacuggaguaacccaacauaaccaugcugcauuuguaaauuugcucaauaucgaaaccgauuauacaaaaaacuuucauuuucacuccaagagaguuacugcacauggagacacaccacaguuagacuugaaggccagaccaacuuauggugcaggggaggucacuguacuaguggagguugcugacauggaguugcacacaaagaaaauugagauaucaggcuugaaguuugcaagccuaucuugcacaggcugcuaugcuuguagcucugguaucuccuguaaggucaggauccauguagaugaaccagaugagcuuacaguacaugugaagagugaagacccagacauaguugcugcaggcucaagucucauggcaaggaagcuugaauuuggggcagauaguacauucaaagccuuuucagccaugcccaaaaccuccuugugcuuuuacauuguggagagagaauacuguaagagcugcaguagagaagacacacaaaaauguguuaacacuaaacuugagcgaccacagagcauuuugaucgaacauaaaggaacgauuauuggaaagcaaaacgacacuugcacagcuaaagcaagcugcuggcuagagucagucaaaaguuuuuucuacggauuaaagaguaugcuuaguggcauuuuuggcaacguuuucauagggauuuucuuauucauugcuccuuuuguccuguuaauacuuuucuuuauguuuggguggaggauucuguucugcuuuaagugcugcagaagaaccaggggccuauuuaaguacagacaccucaaggacgaugaagaaaccgguuacaggaaaaucauugagaggcuaaauaacaaaaagggaaaaaacaaacuacuugauggggaaaggcuagcugacaggaaaaucgccgaguuauucuccacaaaaucacauaucggc

SEQ ID NO: 4034 - RNA, 1932 nt, Artificial Sequence
  derived and/or modified CDS sequence (wt) from CCHFV(SPU103/87)__DQ211634.1__Gc
uucuuagauaauauaguuaaaggcaugaaaaauuugcuaaacucaacaaguuuggagacaaguuuaucaauugaggcaccauggggagcaauaaauguucagucaaccuacaaaccaacuguaucaacugcaaacauagcgcuuaguuggagcucaguagaacacagaggcaauaagauacugguuucgggcagaucagaaucaauuaugaagcuggaagaaaggacaggaauaagcugggaucucgguguagaagacgccucugagucuaaacugcuuacagucucugucauggacuugucacagauguacucaccugucuucgaguacuuaucaggagacagacagguggaagaguggcccaaagcaacuuguacgggugauugcccagaaagauguggcugcacaucaucaaccugcuuacauaaagaauggccccauucaaggaauuggagauguaaccccacuuggugcugggguguagggacuggcugcaccuguuguggauuagacgugaaagaccucuuuacagauuauauguuugucaaguggaaaauugaauacauuaaaacagaagcaauaguguguguagaacuuacuagucaggaaagacaguguagcuugauugaagcgggcacaagguucaauuugggucccgugaccaucacauugucagaaccaagaaacauccagcaaaagcucccuucugaaauaaucacacugcaucccaggauugaggaggguuuuuuugaccugaugcauguacaaaaaguguugucggcaagcacaguguguaaguugcagaguugcacacauggugugccaggagaucuacaggucuaccacaucggaaauuuauuaaaaggggauaagguaaauggacaccuaguucauaaaauugagccacacuucaauacuucuuggauguccugggaugguugugaucuagacuauuauugcaacaugggagauuggccuucuugcacauacacaggaguuacccagcacaaucaugcuucauuuguaaaccugcucaacauugaaacugauuacacaaaaaacuuccacuuucacucuaaaagggucacugcacacggagacacaccacaacuggaucuuaaggcaagaccaaccuauggugcaggugagaucacuguauugguggaaguugcugacauggaguuacacacaaagaagauugaaauaucaggcuuaaaauuuacaagccugacuuguacaggcuguuaugcuuguaguucuggcaucucaugcaaaguuagaauucauguggaugaaccagaugaacuuacagugcauguuaaaagugaugauccagauguuguugcagcuagcucaagucucauggcaagaaagcuugaauuuggaacagacaguacauuuaaggcuuuuucagccaugccuaaaacuucucuauguuucuacauuguggaaagagaauacuguaagagcugcagugaagaagacacacaaaaauguguuaacacaaaacuugagcagccacagagcauuuugaucgaacauaaggguacuauaaucgggaagcaaaacaacacuugcaaggcuagggcggguugcugguuagagucaguuaagaguuuuuuuuacggccuaaagaacaugcucaguggcauuuuuggcaauguauuuauaggcauuuucuuauuucuugcccccuucauccuauuaauacuauucuuuauguuuggguggaggaucuuguuuuguuuuaaguguuguagaagaacuagaggccuguucaaguauagacaccugaaagacgaugaagaaacugguuauagaaagaucauugaaagacuaaacaacaaaaaagggaaaaauaaacugcuugauggugaaagacuugcugauagaagaauugccgaacuguucucuacaaaaacacacauuggc

SEQ ID NO: 4035 - RNA, 1932 nt, Artificial Sequence
  derived and/or modified CDS sequence (wt) from CCHFV(SPU415/85)__DQ211635.1__Gc
uuuuuagacaguauuguuaaaggcaugaagaacuugcuaaacucaacaagcuuggaaacaagcuuaucaauugaggcaccauggggugcaauaaauguccaaucaaccuucaaacccacugugucagcugcaaacauagcacuuagcuggagcucaguggaacacagaggcaacaagauuuugguuucaggcaggucagaaucaaucaugaagcuggaggaaaggacaggaaucagcugggaucugggaguagaagacgccucugaguccaaauugcucaccgucucugucauggacuugucacaaauguauucccccgucuuugaguaccugucaggugauagacagguagaagaguggcccaaggcgaccuguacaggcgauugcccagaaagauguggcugcacaucaucaaccuguuugcacaaggaauggccccauucaaggaacuggagaugcaaccccacuugguguuggggggucggcacuggaugcaccuguugugggcuagauguaaaagaccucuuuacagauuacauguuugucaaguggaaaguugaauacauaaaaacagaggccauagugugugucgaacuuacuagccaagaaaggcaauguagcuugauugaagcaggcacaagauucaauuuagguccugugacuaucacauuaucggagccaagaaacauucagcaaaagcucccuccagaaauaauuacauugcauccuagaauugaagaaggcuuuuuugacuuaaugcaugugcaaagagugcugucagcaagcacagugugcaagcuacagaguugcacacauggugugccaggagaccuacaggucuaccacaucggaaacuuguuaaaaggagacaagguaaacgggcaucugauucacaagauugaaccacauuucaacacuuccuggaugucuugggauggcugugaccuagauuacuacugcaauaugggggauuggccuucuugcacauacacuggaguaacccaacauaaccaugcugcauuuguaaauuugcucaauaucgaaaccgauuauacaaaaaacuuucauuuucacuccaagagaguuacugcacauggagacacaccacaauuagacuugaaggccagaccaacuuauggugcaggggagguuacuguacuaguggagguugcugacauggagcugcacacaaagaaaauugagauaucaggcuugaaguuugcaagucuaacuugcacaggcugcuaugcuuguagcucugguaucuccuguaaggucaagauccauguagaugaaccagaugagcuuacaguacaugugaagagugaagacccagacauaguugcugcaggcucaagucucauggcaaggaagcuugaauuuggggcagauaguacauucaaagccuuuucagccaugcccaaaaccuccuugugcuuuuauauuguggagagagaauacuguaagagcugcaguagagaggacacacgaaaauguguuaacacuaagcuugaucgaccacagagcauuuugaucgaacauaaaggaacgauuauuggaaagcaaaacaacacaugcacagcuaaagcaagcugcuggcuagagucagucaaaaguuuuuucuacggauugaagaauaugcuuaguggcauuuucgguaauguuuucauagggauuuucuuauucauugcuccuuuuguccuguuaauacuuuucuuuauguuuggguggaggauccuguucugcuuuaagugcugcagaagaaccagaggccuauuuaaguacagacaccucaaggacgaugaagaaaccgguuacaggaaaaucauugagaggcuaaauaacaaaaagggaaaaaacaaacuacuugauggggaaaggcuagcugauaggaaaaucgccgaguuauucuccacaaaaucacauaucggc

SEQ ID NO: 4036 - RNA, 1932 nt, Artificial Sequence
  derived and/or modified CDS sequence (wt) from CCHFV(Turkey200310849)__DQ211636.1__Gc
uucuuggacaguauaguuaaagguaugaaaaauuugcuaaacucaacaagcuuggaaacaagcuuaucaauugaggcaccauggggagcaauaaauguccagucaaccuuuaaaccagcuguaucgacugcaaacauagcacucaguuggagcucaguggagcacagaggcaacaagaucuuagucacaggcaggucugaaucaauuaugaaacuggaggaaaggacaggagucagcugggaucuagguguagaagaugccucugaauccaaauuacuuaccguuucuaucauggauuugucacaaauguauucuccuguuuuugaguacuugucaggagacagacagguugaagaauggcccaaagcaacuuguacaggugauugcccggagaggugugguugcacaucaucaaccugcuuacauaaagaauggccucacucaagaaacuggagauguaaucccacuuggugcuggggaguaggaaccggcugcaccugcugcgggguggauguaaaagaucuuuuuacagaucacauguuugucaaauggaaaguugaauacauaaaaacugaagcuauaguauguguugaacucaccagccaagaaagacagugcagucugauugaggcagguacuagauucaacuugggcccugugacuauuacccugucugagccaagaaacauucagcagaagcuuccuccugagauuaucacguugcaucccaaaauugaagaaggcuucuuugacuugaugcauguacaaaaaguguugucugcaaguacaguguguaaacugcagaguugcacacaugguauaccaggagaucuacaaguuuaccacauuggcaacuuguugaaaggggauagaguaaacgggcaucuaauucacaaaauugaaucacauuucaacaccucuuggauguccugggaugguugugacuuagacuacuacugcaacaugggggauuggccaucuugcacauacacaggagugacccagcauaaccaugcugcauuuguaaacuugcuuaacauugaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcauaccaagaaaguugaaauaucaggcuugaaauuugcaagucuggcuugcacggguugcuaugcuuguagcucuggcaucuccuguaaaguuagaauucauguagaugaaccagaugagcucacaguacauguaaagagcagugauccagaugugguugcagcuagcacaagucucauggcgaggaagcuugaauuugggacagacagcacauucaaggccuuuucagcuaugcccaaaaccucuuuauguuuuuacauuguggagagagaauacugcaagagcugcagugaagaugauacacaaaaauguguugacacaagacuugagcagccacagagcauacuaauugagcacaaaggaacgauaauuggaaagcagaaugauacuugcacagccaaggcaagcuguugguuagagucagucaagaguuuuuuuuauggauugaagaauaugcuuggcaguguuuuugguaaucuuuucauaggcauuuuguuauuccuugccccuuuuguccuguuggugcuuuucuuuauguuuggguggaaaaucuuguuuugcuuuaaauguugcaggaggaccagaggcuuauuuaaguauagacaccucaaagacgaugaggaaacaggcuacagaaggauuauugaaagacugaacagcaaaaaagggaaaaacaggcugcuugauggugauagacuggcugauaggaaaauugcugagcuguucuccacaaaaacacacauuggc

SEQ ID NO: 4037 - RNA, 1932 nt, Artificial Sequence
  derived and/or modified CDS sequence (wt) from CCHFV(Iran-52)__DQ446215.1__Gc
uuucuagauaguauagucaaagguaugaaaaaucugcuaaacucaacaagucuagaaacaagcuuaucaauugaggcaccauggggagcaauuaauguucagucaaccuacaaaccaacuguaucaacugcaaacauagcacuuaguuggagcucaguggaacacagaggcaauaagguuuuggucucaggcagaucagaaucaauuaugaagcuggaagaaaggacaggaaucagcugggaucuuggcguggaagaugccucugagucuaagcuacuuacaguuucagucauggacuugucucagauguacucuccugucuucgaguacuuaucaggugacagacaaguggaagaguggccuaaagcaaccugcacaggugacugcccagaaagauguggcugcacaucaucaaccugcuuacacaaagaguggccccacucaaggaauuggagauguaauccuacuuggugcugggguguagggacuggcugcaccuguugugguuuagaugugaaagaccuuuucacagauuacauguucgucaaguggaaaguugaguacauuaagacagaggccauaguauguguagaacuaaccagucaggaaagacaguguagcuugauugaggcgggcacaagauucaauuuagguucugugacuauuacauugucagaaccaaggaacauucaacaaaagcucccuccugaaauaaucacacugcaccccaagauugaggaagguuuuuuugaccuaaugcauguacaaaaagugcuaucggcaagcacaguguguaaguugcagaguugcacacauggugugccaggagaucugcaggucuaccacaucggaaaccuauuaaaaggggacagaguaaacggacaccugauucauaaaauugagcaacacuucaacacauccuggaugucuugggaugguugugaccuagacuacuacuguaacaugggagacuggccuuccugcacauauaccggagucacucagcauaaccaugcuucauuuguaaaccugcucaacauugaaacugauuauacaaaaaccuuucacuuucacucuaaaaggguuacugcacauggagacacaccacagcuagaucugaaggcaaggccaaccuauggugcaggugagaucaccgugcugguggaaguugcugacauggaguuacacacaaagaagauugaaauaucaggcuuaaaauuugcaggccuaacuugcacagguuguuaugcuuguaguucuggcaucucuuguaaaguuagaauucauguagaggaaccagaugaacuuacaguacauguuaaaagugaugacccagauguaguugcagcuagcucaagucucauggcgaggaagcuugaguuuggaacagacaguacauuuaaagcuuucucagccaugccuaaaaccucccuauguuucuacauuguggaaagagaauacuguaagagcugcaguaaagaagauacacaaaaauguguuaacacgaaacucgaacaaccacagagcauuuugaucgaacauaagggaacuauaauuggaaagcaaaacaauacuugcacggcuaaagcgaguugcugguuagagucaguuaagaguuuuuuuuauggucugaagaauaugcucgguggcauauuuggcaauguuuuuauaggcauuuucacauuucuuacccccuuuaucuuguuaauacuuuucuuuauguuuggguggaggauccuguuuugcuucaaguguugcagaagaaccagaggccuauucaaguacagacaccucaaagacgaugaagaaacugguuacagaaagaucauugaaagacugaacaacaaaaagggaaaaaacaggcugcuugauggugaaagacuugcugacagaaagauugcugaacuguucuccacaaaaacacacauuggc

SEQ ID NO: 4038 - RNA, 1932 nt, Artificial Sequence
  derived and/or modified CDS sequence (wt) from CCHFV(Iran-53)__DQ446216.1__Gc
uuucuagauaguauagucaaagguaugaaaaaucugcuaaacucaacaagucuagaaacaagcuuaucaauugaggcaccauggggagcaauuaauguucagucaaccuacaaaccaacuguaucaacugcaaacauagcacuuaguuggagcucaguggaacacagaggcaauaagguuuuggucucaggcagaucagaaucaauuaugaagcuggaagaaaggacaggaaucagcugggaucuuggcguggaagaugccucugagucuaagcuacuuacaguuucagucauggacuugucucagauguacucuccugucuucgaguacuuaucaggugacagacaaguggaagaguggccuaaagcaaccugcacaggugacugcccagaaagauguggcugcacaucaucaaccugcuuacacaaagaguggccccacucaaggaauuggagauguaauccuacuuggugcugggguguagggacuggcugcaccuguugugguuuagaugugaaagaccuuuucacagauuacauguucgucaaguggaaaguugaguacauuaagacagaggccauaguauguguagaacuaaccagucaggaaagacaguguagcuugauugaggcgggcacaagauucaauuuagguucugugacuauuacauugucagaaccaaggaacauucaacaaaagcucccuccugaaauaaucacacugcaccccaagauugaggaagguuuuuuugaccuaaugcauguacaaaaagugcuaucggcaagcacaguguguaaguugcagaguugcacacauggugugccaggagaucugcaggucuaccacaucggaaaccuauuaaaaggggacagaguaaacggacaccugauucauaaaauugagcaacacuucaacacauccuggaugucuugggaugguugugaccuagacuacuacuguaacaugggagacuggccuuccugcacauauaccggagucacucagcauaaccaugcuucauuuguaaaccugcucaacauugaaacugauuauacaaaaaccuuucacuuucacucuaaaaggguuacugcacauggagacacaccacagcuagaucugaaggcaaggccaaccuauggugcaggugaggucaccgugcugguggaaguugcugacauggaguuacacacaaagaagauugaaauaucaggcuuaaaauuugcaggccuaacuugcacagguuguuaugcuuguaguucuggcaucucuuguaaaguuagaauucauguagaugaaccagaugaacuuacaguacauguuaaaagugaugacccagauguaguugcagcuagcucaagucucauggcgaggaagcuugaguuuggaacagacaguacauuuaaagcuuucucagccaugccuaaaaccucccuauguuucuacauuguggaaagagaauacuguaagagcugcaguaaagaagauacacaaaaauguguuaacacgaaacucgaacaaccacagagcauuuugaucgaacauaagggaacuauaauuggaaagcaaaacaauacuugcacggcuaaagcgaguugcugguuagagucaguuaagaguuuuuuuuauggucugaagaauaugcucgguggcauauuuggcaauguuuuuauaggcauuuucacauuucuuacccccuuuaucuuguuaauacucuucuuuauguuuggguggaggauccuguuuugcuucaaguguugcagaagaaccagaggccuauucaaguacagacaccucaaagacgaugaagaaacugguuacagaaagaucauugaaagacugaacaacaaaaagggaaaaaacaggcugcuugauggugaaagacuugcugacagaaagauugcugaacuguucuccacaaaaacacacauuggc

SEQ ID NO: 4039 - RNA, 1932 nt, Artificial Sequence
  derived and/or modified CDS sequence (wt) from CCHFV(Kosova Hoti)__EU037902.1__Gc
uucuuagacaguauagucaaagguaugaaaaauuugcuaaacucaacaagcuuagaaacaagcuuaucaauugaggcaccauggggagcaauaaauguccagucaaccuucaaaccaacagugucgacugcgaacauagcacucaguuggagcucaguggaacacagaggcaacaagaucuuagucacaggcaggucugagucaauuaugaaacuagaggaaaggacaggaaucagcugggaucuaggcguagaagaugccucugaauccaaauuacuuaccgucucuaucauggauuugucacagauguauuccccaguuuuugaguacuugucaggggacagacagguugaagaauggcccaaagcaacuugcacaggugacugcccacaaagguguggcugcacaucaucaaccugcuugcauaaagaauggccucauucaagaaacuggagauguaaucccacuuggugcuggggagugggaacuggcugcaccugcugcgggguggauguaaaagaccuuuuuacagaucacauguuugucaaauggaagguugaauauauaaaaacugaagccauaguguguguugagcucaccagccaagaaagacagugcagucugauugaggcagguacuagauucaacuugggcccugugacuauuacccugucugagccaagaaacauucagcagaagcuccccccugagaucauuacguugcaucccaaaauugaggaaggcuucuuugacuugaugcauguacaaaaaguguuguccgcaaguacaguguguaaacugcagaguugcacacaugguauaccaggagaucuacaaguuuaccacauuggcaauuuguugaaaggggauagagugaacgggcaucuaauucacaaaauugaaccacauuucaacaccucuuggauguccugggaugguugugacuuagacuacuacugcaacaugggggacuggccuucuuguacauacacaggagugacccagcauaaucaugcugcauuuguaaacuugcucaacauugaaacugauuacacaaaaaccuuccacuuccacucuaaaagagucacagcacauggugacacaccacaauuggacuuaaaagcaaggccgaccuacggugcaggagagaucacugugcugguugagguugcugacauggaguugcauaccaagaaaguugagauaucgggcuugaaauuugcaagucuggcuugcacagguugcuaugccuguagcucugguaucuccuguaaagucaggauucauguagaugaaccagaugagcucacagugcauguaaagagcagugauccagaugugguugcagcuggcacaagccucauggcaaggaagcuugaauuugggacagacagcacauucaaggccuuuucagcuaugcccaaaaccucuuuauguuuuuacauuguggagaaagaauacugcaagagcugcagugaagaugauacaaaaaaauguguugacacaaaacuugagcagccacagagcauacuaauugagcacagagggacgauaauuggaaagcagaaugauacuugcacagccaaggcaagcuguuggcuagagucagucaagaguuuuuuuuauggauugaagaauaugcuuggcaguguuuuugguaauuuuuucauagguauuuuguuauuccuugccccuuuuguccuguuggugcuuuucuuuauguuuggauggaaaaucuuguuuugcuuuaaauguugcaggaggaccagaggcuuguuuaaguauagacaccucaaagacgaugaggaaacaggcuacagaaggauuauugaaaggcugaacaacaaaaaagggaaaaauagacugcuugauggugaaagguuggcugauaggaaaauugccgagcuguuuuccacaaaaacacacauuggc

SEQ ID NO: 4040 - RNA, 1932 nt, Artificial Sequence
  derived and/or modified CDS sequence (wt) from CCHFV(YL04057)__FJ562094.1__Gc
uuccuggauagcauagccaagggaaagaaaagccuguugaacuccacaagcuuagaaacuagucugucaauugaagcuccguggggagcaaucaauguucagucaacuuucaaaccaacaguuucagcugcuaacauagcacuuagcuggaguucaguugaacacaggggcaacaaaauuuuaguuucagguagaucagagucaaucaugaaauuagaagaaagaacaggagucagcuggaaucuggguguagaagaugcuucugagucaaagacgcucacuguuuccgucauggaccugucacaaauguacucuccuguuuuugaguacuugucaggugacagacaaguggaggaauggccaaaggcaacuugcacaggugacuguccagagagaugcggcugcacuucgucaaccugcuuacauaaagaguggccacauucaagaaacuggcgauguaguccuaccugguguugggggguggggacuggcugcacuugcugugggcuggauguuaaggauuuuuuuacugacuacaugcugguaaaauggaaaguggaauauauaaagacagaagcuauagugugugucgagcugacuagucaagagaggcaguguaguuuaauugaagcaggcacaagauuuaaccuaggcccuguaacaauaacacuaucagagccaagaaauguccagcagaggcuuccucccgaaauuguaacacugcauccuaaaauagaggaagguuuuuuugauuugaugcauguacaaaaaauacugucugcaagcacaguuugcaagcuacagagcugcacacacggugugccgggcgauuuucaggucuaccaugucgguaaccugcugaggggagacaagguuaauggacacucaauucacaagauagaaccacauuuuaauacuucauggaugucaugggaugguugcgaucuggacuauuucugcaauaugggggacuggccuucaugcacauacacuggaguaacacagcauaaccgugcugcauuuaucaacaugcucaacauugagacugacuauacaaaaacuuuccacuuucauucgaagagggucacggcacauggagauacuccccagcuagaccugaaagcgagaccggcauauggugcuggcgaggucacuguucuaguggagguugcagacuuggaguugcacacaaagaaacuugaagugucagguuugaaaauugcaaguuugaccugcucuggguguuaugccugcagcucuggcaucuccugcaaaguuagaauccauguaaaugaaccagaugaauucacaguacauguaagaaguagcgacccagauguuguagcagcaggaucaagucuuauggcaaggaaaauagaguuuggggcugacaguacauucaaggccuuuucaucaaugcccaaggacuccuuaugcuuuuacauaguagaaaaggauuacugcagcagcugcaccgacgaugacacacaaaagugugucaacacgaagcuugaccauccacagagcauacucauugagcacaaaggaacaauaauuggcaagcaaaaugacacuuguucgaccaagacaagcugcuggcuagaaucaguuaaggguuuuuucuaugggcucaaaaacaugcugaguggcaucuuuggaaauguuuuuuuaggcauccucuuauuccuugcuccuuuuguacuacugauauuuuuuuucuuuuuuggguggaggcuucuguuuugucucaaauguugcagaagaacuagaggacuguugaaauauaagcaccuuaaggacgaagaggaggcuggauacaaaaaaaucauugaaaggcuaaauggcaaaaaagguaaaagucaauuguuugauggugaaaggcuugcagacaggaagauugcugagcuuuuuucuacuaaaauucacauaggu

SEQ ID NO: 4041 - RNA, 1932 nt, Artificial Sequence
  derived and/or modified CDS sequence (wt) from CCHFV(V42/81)__GU477490.1__Gc
uucuuagacaguauaguuaaagguaagaaaaauuuguuaaacucaacaaguuuggaaacaagcuuaucaauugaagcaccauggggagcaauaaauauccagucaaccuuuaaaccaacaguaucggcugcaaacauagcacucaguuggagcucaguggagcacagaggcaacaagaucuuagucucaggcaggucugaaucaauuaugaaacuagaggaaagaacaggagucagcuggaaucuagguguagaagaugccucugaauccaaauuacuuaccgucucuaucauggauuugucacaaauguauuccccuguuuuugaguacuugucaggagacagacagguugaagaauggccuaaagcaacuuguacaggugacugcccagaaaggugugguugcacaucaucaaccugcuugcauaaagaauggccucacucaagaaacuggagaugcaauccuacuuggugcugggggguaggaaccggcugcaccugcugcggaguggauguaaaagaccuuuuuauagaucacauguuuguuaaauggaagguugaauauauaaaaacugaagccauaguauguguugagcucaccagccaagaaagacagugcagucugauugaggcagguacuagauucaacuugggcccugugacuauuacccuauccgagccaagaaacauucagcagaagcuucccccugagauuaucacguugcaccccaaaauugaagaaggcuucuuugacuugaugcauguacaaaaaguguugucugccaguacaguguguaaacugcaaaguugcacacaugguauaccaggagaucugcaagucuaccacauuggcaaccuauugaaaggggauagaguaaacgggcaucuaauucacaaaaucgaaccacauuuuaacaccucuuggauguccugggaugguugugaccuagacuacuacugcaacaugggggauuggccuucuugcacauacacaggagugacccagcacaaucaugcugcauuuguaaacuugcuuaacauugaaacugauuacacgaaaacuuuccacuuccacucuaaaagaguuacagcacauggugaaacaccacaauuagacuuaaaagcaaggccggcauacggugcaggugagaucacugugcugguugagguugcugacauggaguugcauaccaagaaaguugagauaucaggcuugaaauuugcaagucuggcuugcacggguugcuaugcuuguagcucuggcaucuccuguaaagucaggauucauguagaugaaccagaugagcucacaguacaugugaagagcaaugauccagaugugguugcagcuagcacaagucucauggcaaggaagcuugaaucugggacagacagcacauuuaaggccuuuucagcuaugcccaaaaccucuuuauguuuuuacauuguggagagagaauacugcaagagcugcagugaagaugauacacagaaauguguugaaacaaaacuugaacagccacaaagcauacuaauugaacacaaaggaacgauaauuggaaagcagaaugauacuugcacagccaaggcaagcuguuggcuggaaucagucaagaguuuuuuuuauggauugaagaacaugcuuggcaguguuuuugguaauuuuuucauaggcauuuuguuauuccuugcccccuuuguccuguuaguacuuuucuuuauguuuggauggaaaaucuuguuuugcuuuaaauguugcaggaggaccagaggcuuguuuaaguauagacaccucaaagaagaugaggaaacaggcuacagaaggauuauugagagacugaacagcaaaaaagggaaaaacagacugcuugauggugaaagguuggcugauaggaaaauugcugagcuguucucuacaaaaacacacauuggc

SEQ ID NO: 4042 - RNA, 1932 nt, Artificial Sequence
  derived and/or modified CDS sequence (wt) from CCHFV(79121M18)__GU477493.1__Gc
uuccuggauagcacagccaagggaaugaaaagccuguugaacuccacgagcuuagaaacaagucugucaauugaagcuccguggggagcaaucaauguccagucaacuuucaaaccaacaguuucagcugcuaacauagcacuuagcuggaguucaguugaacacaggggcaacaaaauuuuaguuucagguagaucagagucaaucaugaaauuagaagaaagaacaggagucagcuggaaucuggguguagaagaugcuucugagucaaagacgcuuacuguuuccgucauggaccugucacaaauguacucuccuguuuuugaguacuugucaggugacagacaaguggaggaauggccaaaggcaacuugcacaggugacuguccagagagaugcggcugcacuucgucaaccugcuuacauaaagaguggccacauucaagaaacuggcgauguaauccuaccugguguugggggguggggacuggcugcacuugcugugggcuggauguaaaggauuuuuuuacugacuacaugcugguaaaauggaaaguggaauauauaaagacagaagcuauagugugugucgagcugacuagucaagagaggcaguguaguuuaauugaagcaggcacaagauuuaaccuaggcccuguaacaauaacccuaucagagccaagaaauguccagcagaggcuuccucccgaaauuguaacacugcauccuaaaauagaggaagguuuuuuugauuugaugcauguacaaaaaauacugucugcaagcacaguuugcaagcuacagagcugcacacacggugugccgggcgauuuucagaucuaccaugucgguaaccugcugaggggagacaagguuaauggacacucaauucacaagauagaaccacauuuuaauacuucauggaugucaugggaugguugcgaucuggacuauuucugcaauaugggggacuggccuucaugcacauacacuggagugacacagcauaaccgugcugcauuuaucaacaugcucaacauugagacugacuauacaaaaacuuuccacuuucauucgaagagggucacggcacauggagauacuccccagcuagaccuaaaagcgagaccggcauauggugcuggcgaggucacuguucuaguggagguugcagacuuggaguugcacacaaagaaacuugaagugucagguuugaaaauugcaaguuugaccugcucuggguguuaugccugcagcucuggcaucuccugcaaaguuagaauccauguaaaugaaccagaugaauuuacaguacauguaagaaguagcgacccagauguuguagcagcaggaucaagucuuauggcaaggaaaauagaguuuggggcugacaguacauucaaggccuuuucaucaaugcccaaggacuccuuaugcuuuuacauaguagaaaaggauuacugcagcagcugcaccgacgaugacacacaaaagugugucaacacgaagcuugaccauccacagagcauacucauugagcacaaaggaacaauaauuggcaagcaaaaugacacuuguucgaccaagacaagcugcuggcuagaaucaguuaaggguuuuuucuaugggcuaaaaaacaugcuaaguggcaucuuuggaaauguuuuuuuaggcaucuucuuauuccuugcuccuuuugugcuacugauauuuuuuuucuuuuuuggguggaggcuucuguuuugucucaaauguugcagaagaacuagaggacuguugaaauacaagcaccuuaaggaugaagaggaggcuggauacaaaaaaaucauugaaaggcuaaauggcaaaaaagguaaaagucaauuguuugauggugaaaggcuugcagacaggaagauugcugagcuuuuuucuacuaaaauucacauaggu

SEQ ID NO: 4043 - RNA, 1932 nt, Artificial Sequence
  derived and/or modified CDS sequence (wt) from CCHFV(Afg09-2990)__HM452306.1__Gc
uuucuagauaguauagucaaagguaugaaaaaucugcuaaacucaacaagucuagaaacaagcuuaucaauagaggcaccguggggagcaauuaauguucagucaaccuacaaaccaacuguaucaacugcaaacauagcacuuaguuggagcucaguggaacacagaggcaauaagguuuuggucucaggcagaucagaaucaauuaugaagcuggaagaaaggacaggaaucagcugggaucuuggcguggaagaugccucugagucuaagcuacuuacaguuucaguuauggacuugucucagauguacucuccugucuucgaguacuuaucaggugacagacaaguggaagaguggccuaaagcaaccuguacaggugacugcccagaaagauguggcugcacaucaucaaccugcuuacacaaagaguggccccacucaaggaauuggagauguaauccuacuuggugcugggguguagggacuggcugcaccuguugugguuuagaugugaaagaccuuuucacagauuacauguucgucaaguggaaaguugaguacauuaagacagaggccauaguauguguagaacuaaccagucaggaaagacaguguagcuugauugaggcgggcacaagauucaauuuagguucugugacuauuacauugucagaaccaaggaacauucaacaaaagcucccuccugaaauaauuacacugcaccccaagauugaggaagguuuuuuugaccuaaugcauguacaaaaagugcuaucggcaagcacaguguguaaguugcagaguugcacacauggugugccaggagaucugcaggucuaccacaucggaaaccuauuaaaaggggacagaguaaacggacaccugauucauaaaauugagcaacacuucaacacauccuggaugucuugggaugguugugaccuagacuacuacuguaacaugggagacuggccuuccugcacauauaccggagucacucagcauaaccaugcuucauuuguaaaccugcucaacauugaaacugauuauacaaaaaccuuucacuuucacucuaaaaggguuacugcacauggagacacaccacaacuagaucugaaagcaaggccaaccuauggugcaggugagaucaccgugcugguggaaguugcugacauggaguuacacacaaagaagauugaaauaucaggcuuaaaauuugcaggccuaacuugcacagguuguuaugcuuguaguucuggcaucucuuguaaaguuagaauucauguagaugaaccagaugaacuuacaguacauguuaaaagugaugacccagauguaguugcagcuagcucaagucucauggcgaggaagcuugaauuuggaacagacaguacauuuaaagcuuucucagccaugccuaaaaccucccuauguuucuacauuguggaaagagaauacuguaagagcugcaguaaagaagauacacaaaaauguguuaacacgaaacucgaacaaccacagagcauuuugaucgaacauaagggaacuauaauuggaaagcaaaacaauacuugcacggcuaaagcgaguugcugguuagagucaguuaagaguuucuuuuauggucugaagaauaugcucgguggcauauuuggcaauguuuuuauaggcauuuucacauuucuuacccccuuuaucuuguuaauacuuuucuuuauguuuggguggaggauccuguuuugcuucaaguguugcagaagaaccagaggccuauucaaguacagacaccucaaagacgaugaagaaacugguuacagaaagaucauugaaagacugaacaacaaaaaaggaaaaaacaggcugcuugauggugaaagacuugcugacagaaagauugcugaacuguucuccacaaaaacacacauuggc

SEQ ID NO: 4044 - RNA, 1932 nt, Artificial Sequence
  derived and/or modified CDS sequence (wt) from CCHFV(Sudan Al-Fulah 3-2008)__HQ378184.1__Gc
uuccuagacaguauaguuaaaggcaugaaaaaucugcuaaacucaacaaguuuagaaacaagucugucaauugaggcaccauggggggcaauaaauguucagucaaccuacaagccaacugugucgacugcaaauauagcacucagcuggagcucaguggaacacagaggcaauaagaucuugguuucaggcagaucagaaucaauuaugaagcuggaagaaaggacagggaucagcugggaucucggcguagaagacgccucugagucuaaacugcuuacagucucuguuauggauuugucucagauguacucuccugucuucgaguacuuaucaggagacagacagguggaggaguggcccaaagcaacuugcacaggugacugcccagaaagauguggcugcacaucaucaacaugucugcacaaagaauggccccacucaagaaauuggagaugcaaucccacuuggugcugggguguagggacuggcugcaccugcuguggauuagaugugaaagaccuuuuuacagauuauauguuugucaaguggaaaguugaauacaucaagacagaggccauaguguguguagaacucaccagucaggaaaggcaguguagcuugauugaagcaggcacaagguucaauuuagguccugugaccaucacacugucagaaccaagaaacauccaacagaagcucccuccugaaauaaucacacuacauccuaggauugaagaagguuuuuuugaccugaugcacguucagaaaguguuaucagcaagcacaguguguaaguugcagaguugcacacaugguguaccaggagaccuacaggucuaccacaucggaaauuuauuaaaaggggacaagguaaauggacaucuaauucauaaaauugagccacacuucaacacuuccuggauguccugggaugguugugaccuagacuacuacugcaacaugggagauuggccuucuugcacauacacaggagucacccaacacaaucaugcuucauuuguaaaccugcucaacauugaaacugauuacacaaaaaacuuccacuuucacucuaaaagggucacugcacacggagacacaccacaacuggaucuuaaggcaagaccaaccuauggugcaggugagauuacuguacugguagaaguugcugacauggaguuacacacaaagaagauugaaauaucgggcuuaaaauuugcaagcuugacuugcacagguuguuaugccuguagcucuggcaucucaugcaaaguuagaauucauguagacgaaccagaugaacuuacagugcauguuaaaagugaugauccagauguaguugcagcuagcucaagccucauggcaagaaagcuugaauuuggaacagacaguacauuuaaagcuuuuucagccaugccuaaaacuucgcuauguuucuacauuguugaaaaagaauacugcaagagcugcagugaagaagacacaaaaaaauguguuaacacaaaacuugagcaaccacagagcauuuugaucgaacacaagggaacuauaaucggaaagcaaaacagcacuugcacagccaaggugaguugcugguuagagucagccaagaguuuuuuuuauggucuaaaggacaugcuuaguggcauuuuuggcaaugucuuuauagguauuuucuuauuccuugcccccuucguccuguuagugcuguucuuuauguuuggguggaggauccuacuuugcuuuagauguuguagaagaacuagaggccuguucaaguauagacaccucaaggacgaugaagaaacugguuauagaaggauuauugaaagacuaaacaauaaaaagggaaaaaacaaacugcuugauggugaaagacuugcugauagaaaaauugcugaacuguucuccacaaaaacacacauuggu

SEQ ID NO: 4045 - RNA, 1932 nt, Artificial Sequence
  derived and/or modified CDS sequence (wt) from CCHFV(Sudan AB1-2009)__HQ378187.1__Gc
uucuuagauaguauagcuaaaggcaugaaaaaucugcuaaauucaacaaguuuagaaacgaguuuaucaauugaggcaccauggggagcaauaaauguucagucaaccuacaaaccaacugugucaacugcaaacauagcacucaguuggagcucaguggaacacagaggcaauaagaucuugguuucaggcagaucagaaucaauuaugaagcuggaagaaaggacaggaaucagcugggaucuuggcguagaagaugccucugagucuaaacugcuuacagucucugucauggacuugucucagauguacucuccugucuucgaguacuuaucaggugacagacagguggaagaguggcccaaagcaaccuguacaggugacugcccagaaagauguggcugcacaucaucaaccuguuugcacaaagaauggccucacucaagaaauuggagaugcaaucccaccuggugcugggguguagggacuggcugcaccuguuguggauuagaugugaaggaccuuuuuacagauuacauguuugucaaguggaaaguugaauacaucaagacagaggccauaguguguguagaacuuacuagucaggaaaggcaguguagcuugauugaagcgggcacaagguucaauuuggguccugugaccaucacacugucagaaccaagaaacauccaacaaaaacucccuccugaaauaaucacacuacauccuaggaucgaagaagguuuuuuugaccugaugcauguacaaaagguguuaucggcaagcacaguguguaaguugcagaguugcacacauggugugccaggagaccuacaggucuaccacaucggaaauuuauuaaaaggggauaagguaaaugggcaucuaauucauaaaauugagccacacuucaacaccuccuggauguccugggaugguugugaccuagacuacuacugcaacaugggagauuggccuuccugcacauacacaggggucacccaacacaaucaugcuucauuuguaaacuuacucaacauugaaacugauuacacaaagaauuuccacuuucacucuaaaagggucacugcacacggagauacaccacaacuagaucuuaaggcaagaccaaccuauggugcaggugagaucacuguucugguagaaguugcugacauggaguuacauacaaagaagauugagauaucaggcuuaaaauuugcaagcuugacuugcacagguuguuaugcuugcagcucugguaucucaugcaaaguuagaauucauguggaugaaccagaugaacuuacaguacauguuaaaagugaugauccagaugugguugcagcuagcucaagucucauggcaagaaagcuugaauuuggaacagacaguacauuuaaagcuuucucggccaugccuaaaacuucuuuauguuucuacauuguugaaagggaacacuguaagagcugcaaugaagaagacacaaaaaaauguguuaacacaaaacuugagcaaccacaaagcauuuugaucgaacacaagggaaccauaaucggaaagcagaacagcacuugcacggcuagggcgaguugcugguuggagucagucaagaguuucuuuuauggccuaaagaacaugcuuaguggcauuuuuggcaaugucuuuaugggcaucuucuuauuccuugcccccuucauccuguuaauacuauucuuuauguuuggguggaggauccuauucugcuuuaaauguuguagaagaaccagaggccuguucaaguauagacaccucaaagacgaugaagaaacugguuauagaaggauuauugaaagacuaaacaauaaaaaaggaaaaaacaaacugcuugauggugaaagacuugcugauagaagaauugccgaacuguucucuacaaaaacacacauuggc

SEQ ID NO: 4046 - RNA, 1932 nt, Artificial Sequence
  derived and/or modified CDS sequence (wt) from CCHFV(NIVA 118595)__JN572083.1__Gc
uuucuagauaguauagucaaagguaugaaaaaucugcuaaacucaacaagucuagaaacaagcuuaucaauugaggcaccguggggagcaauuaauguucagucaaccuacaaaccaacuguaucagcagcaaacauagcacucaguuggagcucaguggaacacagaggcaauaagauuuuggucucaggcagaucagaaucaauuaugaagcuggaagaaaggacaggaaucagcugggaucucggcguagaagaugccucugagucuaagcuacuuacagucucagucauggacuugucucagauguacucuccugucuucgaguauuuaucaggugacagacaaguggaagaguggccuaaagcgaccuguacaggugacugcccagaaagauguggcugcacaucaucaaccugcuuacacaaagaguggccccacucaaggaauuggagauguaauccuacuuggugcugggguguagggacuggcugcaccugcuguggauuggaugugaaagaccuuuucacagauuacauguucgucaaguggaaaguugaguacauuaagacagaggccauaguauguguagaacuaaccagucaggaaagacaguguagcuugauugaggcgggcacaagauuuaauuuagguucugugaccauuacauugucagaaccaaggaacauucaacaaaagcucccuccugaaauaaucacacugcauccuagaauugaggaagguuuuuuugaccuaaugcaugugcaaaaagugcuaucagcaagcacaguguguaaguuacaaagcugcacacauggugugccaggagaucuacaggucuaccacauuggaaaccuauuaaaaggggacagaguaaacggacaccuaauucacaaaauugaacaacaccucaacacuucuuggauguccugggaugguugugaucuagacuacuacugcaauaugggagacuggccuucuugcacauauacaggagucacccaacauaaucaugcuucauuuguaaaccugcucaacauugaaacugauuacacaaaaaccuuccacuuucacucuaaaaggguuacugcacauggagacacaccacagcuagaucugaaggcaaggccaaccuauggugcaggugagaucacuguacugguggaaguugccgauauggaguuacacacaaagaagauugaaauaucaggcuugaaguuugcaagccuauccugcacagguuguuaugcuuguaguucuggcaucuccugcaaagucagaauucauguagaugaaccagaugaacuuacaguacauguuaaaagugaugauccagauguaguugcagcuagcucaagucucauggcaaggaagcuugaaucuggaacagacaguacauuuaaagcuuuuucagccaugccuaaaacuuccuugugcuucuacauuguagagagagaauacuguaagggcugcaguaaagaagacacacaaaaauguguuaacacgaaacucgagcaaccacagagcauuuugaucgaacacaagggaacuauaauuggaaagcaaaacaauacuugcacagcuaaggcaaguugcugguuagagucaguuaagaguuuuuuuuauggucugaagaauaugcuuaguggcauuuuuggcaauguuuuuuuaggcauuuucucauuucuugcccccuuuguccuauuaauacuuuucuuuauguuuggguggaggauccuguuuugcuucaaguguugcagaagaaccagaggccuauucaaguacagacaccucaaagacgaugaagaaacugguuacagaaagaucauugaaagacugaacaacaaaaaggggaaaaacaaacugcuugauggugaaaggcuugcugacagaaaaauugccgaacuguucuccacaaaaacacacauuggc

SEQ ID NO: 4047 - RNA, 1932 nt, Artificial Sequence
  derived and/or modified CDS sequence (wt) from CCHFV(NIV 112143)__JN572085.1__Gc
uuucuagauaguauagucaaagguaugaaaaaucugcuaaacucaacaagucuagaaacaagcuuaucaauugaggcaccguggggagcaauuaauguucagucaaccuacaaaccaacuguaucagcagcaaacauagcacucaguuggagcucaguggaacacagaggcaauaagauuuuggucucaggcagaucagaaucaauuaugaagcuggaagaaaggacaggaaucagcugggaucucggcguagaagaugccucugagucuaagcuacuuacagucucagucauggacuugucucagauguacucuccugucuucgaguauuuaucaggugacagacaaguggaagaguggccuaaagcgaccuguacaggugacugcccagaaagauguggcugcacaucaucaaccugcuuacacaaagaguggccccacucaaggaauuggagauguaauccuacuuggugcugggguguagggacuggcugcaccugcuguggauuggaugugaaagaccuuuucacagauuacauguucgucaaguggaaaguugaguacauuaagacagaggccauaguauguguagaacuaaccagucaggaaagacaguguagcuugauugaggcgggcacaagauuuaauuuagguucugugacuauuacauugucagaaccaaggaacauucaacaaaagcucccuccugaaauaaucacacugcauccuagaauugaggaagguuuuuuugaccuaaugcaugugcaaaaagugcuaucagcaagcacaguguguaaguuacaaagcugcacacauggugugccaggagaucuacaggucuaccacauuggaaaccuauuaaaaggggacagaguaaacggacaccuaauucacaaaauugaacaacaccucaacacuucuuggauguccugggaugguugugaucuagacuacuacugcaauaugggagacuggccuucuugcacauauacaggagucacccaacauaaucaugcuucauuuguaaaccugcucaacauugaaacugauuacacaaaaaccuuccacuuucacucuaaaaggguuacugcacauggagacacaccacagcuagaucugaaggcaaggccaaccuauggugcaggugagaucacuguacugguggaaguugccgauauggaguuacacacaaagaagauugaaauaucaggcuugaaguuugcaagccuauccugcacagguuguuaugcuuguaguucuggcaucuccugcaaaguuagaauucauguagaugaaccagaugaacuuacaguacauguuaaaagugaugauccagauguaguugcagcuagcucaagucucauggcaaggaagcuugaauuuggaacagacaguacauuuaaagcuuuuucagccaugccuaaaacuuccuugugcuucuacauuguagagagagaauacuguaagggcugcaguaaagaagacacacaaaaauguguuaacacgaaacucgagcaaccacagagcauuuugaucgaacacaagggaacuauaauuggaaagcaaaauaauacuugcacagcuaaggcaaguugcugguuagagucaguuaagaguuuuuuuuauggucugaagaauaugcuuaguggcauuuuuggcaauguuuuuuuaggcauuuucucauuucuugcccccuuuguccuauuaauacuuuucuuuauguuuggguggaggauccuguuuugcuucaaguguugcagaagaaccagaggccuauucaaguacagacaccucaaagacgaugaagaaacugguuacagaaagaucauugaaagacugaacaacaaaaaggggaaaaacaaacugcuugauggugaaaggcuugcugacagaaaaauugccgaacuguucuccacaaaaacacacauuggc

SEQ ID NO: 4048 - RNA, 1932 nt, Artificial Sequence
  derived and/or modified CDS sequence (wt) from CCHFV(SCT ex Afghanistan)__KC344856.1__Gc
uucuuaaacaguauagucaagggcaugaaaaaccugcuaaauucaacuaacuuggaaacaagcuuaucaaucgaagcaccauggggagcaauaaauguccagucaaccuuuaaacccacuguaucaacugcaaacauagcacucagcuggaguucaguggaacacagagguaauaaaauucuagucucaggcagaucagagucaauuaugaagcuagaagaaaggacaggaaucagcugggauuugggcguagaagaugccucugagucuaaaucgcuuacuguuucugucauggauuuaucacagauguauucuccugucuucgaguaucugucaggugacagacagguagaggaguggccuaaagcaaccugcacaggcgauugcccggagagauguggcugcacaucaucaaccugcuuacacaaggaauggccccauucaaggaauuggagaugcaaccccacuugguguuggggagucggcacuggaugcaccugcugugggcuagaugugaaagaccuuuucacagauuauauguuugucaaguggaagguugaauacauaaagacagaggccauaguguguguugagcucacuagccaagaaaggcagugcagcuugauugaggcaggaacaagguucaacuuagguccugugaccaucacguugucagagccaagaaacauucagcagaagcuuccuccugaaauaaucacauugcauccuagaauugaggaaggcuuuuucgaucuaaugcauguacaaaaggugcugucugcaaguacagugugcaagcugcaaagcugcacacaugguguuccaggagacuugcaggucuaccacauuggcaacuuguuaaaaggggauaaguuaaacgggcauaugauucacaaaauugagccacacuucaauaccucuuggauguccugggauggcugugaccuagacuauuacuguaauaugggggauuggcccucuugcacauacacuggggugacccaacauaaccaugcugcuuuuguuaacuuacuuaacaucgaaacugauuacacaaagaacuuccacuuucacucuaaaagaguuacugcacauggagacacaccacaauuggacuugaaagcuagaccaacuuacggugcgggugaaaucacuguacuaguggaaguugcugacauggaguuacacacaaaaaagauugauauaucagguuugaaauuugcaagucuaacuugcgcggguugcuaugcuuguagcucuggcaucuccuguaaagucaggauucauguagaugaaccugaugagcuuacaguacaugugaaaagugaagauccggacauuguugcagcuagcacaagccucauugcaaggaagcucgaacuugggacagacagcacauucaaggccuucucagccaugcccaaaaccuccuugugcuucuacauuguggagagagaauacuguaagagcugcagcaaagaggacacacagaaauguguuaacacaaagcuugagcacccacaaggcauuuuaauugagcacaaaggaacaauaaucggaaagcaaaaugacaccugcacagccaaagcaggcugcugguuggagucagucaagaguuuuuuuuauggauugaagaacaugcuuaguggcaucuucggcaacguuuuuauagguauuuucuuauuccuugcuccuuuuguucuauugauacucuucuuuauguuuggguggagacuccuguuuugcuuuaaguguuguagaagaaccagagguuuauucaaguacagacaucucaaggaagaugaagaaucugguuauagaagaaucauugaaagauuaaacaacaaaaaaggaaagaacaagcugcuugauggugaaagacuagcugauagaaggaucgcugagcuguucuccacaaaaacacauauuggu

SEQ ID NO: 4049 - RNA, 1932 nt, Artificial Sequence
  derived and/or modified CDS sequence (wt) from CCHFV(Zahedan 2007)__KC867273.1__Gc
uuucuagauaguauagucaaagauaugaaaaaucugcuaaacucaacaagucuagaaacaagcuuaucaauugaggcaccauggggagcaauuaauguucagucaaccuacaaaccaacuguaucaacugcaaacauagcacuuaguuggagcucaguggaacacagaggcaauaagguuuuggucucaggcagaucagaaucaauuaugaagcuggaagaaaggacaggaaucagcugggaucuuggcguggaagaugccucugagucuaagcuacuuacaguuucagucauggacuugucucagauguacucuccugucuucgaguacuuaucaggugacagacaaguggaagaguggccuaaagcaaccugcacaggugacugcccagaaagauguggcugcacaucaucaaccugcuuacacaaagaguggccccacucaaggaauuggagauguaauccuacuuggugcugggguguagggacuggcugcaccuguugugguuuagacgugaaagaccuuuucacagauuacauguucgucaaguggaaaguugaguacauuaagacagaggccauaguauguguagaacuaaccagucaggaaagacaguguagcuugauugaggcgggcacaagauucaauuuagguucugugacuauuacauugucagagccaaggaacauucaacaaaagcucccuccugaaauaaucacacugcaccccaagauugaggaagguuuuuuugaccuaaugcauguacaaaaagugcuaucggcaagcacaguguguaaguugcagaguugcacacauggugugccaggagaucugcaggucuaccacaucggaaaccuauuaaaaggggacagaguaaacggacacuugauucauaaaauugagcaacacuucaacacauccuggaugucuugggaugguugugaccuagacuacuacuguaacaugggagacuggccuuccugcacauauaccggagucacucagcauaaccaugcuucauuuguaaaccugcucaacauugaaacugauuauacaaaaaccuuucacuuucacucuaaaaggguuacugcacauggagacacaccacaacuagaucugaaggcaaggccaaccuauggugcaggugagaucaccgugcuuguggaaguugcugacauggaguuacacacaaagaagauugaaauaucaggcuuaaaauuugcaggccuaacuugcacagguuguuaugcuuguaguucuggcaucucuuguaaaguuagaauucauguagaugaaccagaugaacuuacaguacauguuaaaagugaugacccagauguaguugcagcuagcucaagucucauggcgaggaagcuugaauuuggaacagacaguacauuuaaagcuuucucagccaugccuaaaaccucccuauguuucuacauuguggaaagagaauacuguaagagcugcaguaaagaagauacacaaaaauguguuaacacgaaacucgaacaaccacagagcauuuugaucgaacauaagggaacuauaauuggaaagcaaaacaauacuugcacggcuaaagcgaguugcugguuagagucaguuaagaguuuuuuuuauggucugaagaauaugcucgguggcauauuuggcaauguuuuuauaggcauuuucacauuucuuacccccuuuaucuuguuaauauuuuucuuuauguuuggguggaggauccuguuuugcuucaaguguugcagaagaaccagaggccuauucaaguacagacaccucaaagacgaugaagaaacugguuacagaaagaucauugaaagacugaacaacaaaaagggaaaaaacaggcugcuugauggugaaagacuugcugacagaaagauugcugaacuguucuccacgaaaacacacauuggc

SEQ ID NO: 4050 - RNA, 1932 nt, Artificial Sequence
  derived and/or modified CDS sequence (wt) from CCHFV(SPU 44/08)__KJ682805.1__Gc
uuuuuggacaguauuguuaaaggcaugaagaacuugcuaaauucaacaagccuagaaacaagcuuaucaauugaggcaccauggggggcaauaaauguccaaucaacuuucaaaccaacugugucagcugcaaacauagcgcuuaguuggagcucaguagaacauagaggcaauaaaauuuugguuucaggcagaucagagucaaucaugaaauuagaggaaaggacaggaauuagcugggaucuggguguggaagacgccucugaguccaaauugcucacugucucuguaauggacuugucacaaauguauucuccugucuuugaguaccuaucaggugauagacaaguggaagaauggcccaaggcaaccugcacaggagauugcccagaaagaugcggcugcacgucaucaaccugccuacacaaggaauggccccauucaagaaacuggagaugcaacccuacuugguguuggggagucggcacuggaugcaccuguugugggcuggaugugaaagaccucuuuacagauuacauguuugucaaguggaaaguugacuacauuaaaacagaagcuauaguguguguugagcuuacuagccaggaaagacaauguagcuuaauugaggcaggcacaagauucaacuuggguccugugaccaucacauugucagagccaagaaacauucagcagaagcucccuccagaaauaguuacauugcauccuaggauugaagaaggcuucuuugacuuaaugcauauacaaaaagugcuaucagcaaguacaguauguaagcuacagaguugcacacauggcgugccaggagaccuacagaucuaccacauuggaaacuuguuaaaaggagacaaggugaacgggcaccugauucacaaaauugaaccacacuucaacaccuccuggaugucuugggacggcugugaccuagacuacuacuguaauaugggggauuggccgucuugcucauauacuggcguaacccaacacaaucaugcugcauuuguaaacaugcucaacaucgaaacugauuauacaaaaaacuuccacuuucacucuaagagaguuacagcacauggggacacaccacaauuagauuuaaaagcuagaccaacuuauggugcaggugaaaucacugugcugguagagguugcugacauggaguugcauacaaagaaaauugagauaucagguuugaaguuugcaagcuuaacuugcacaggcuguuaugcuuguaguucuggcaucuccuguaagguuaggauccauguagaugaaccagaugagcuuacaguacaugugaagagcgaggauccagacauaguugcugcuaguucaagucucauggcuaggaagcuugaauuugggacagauagcacauuuaaagccuuuucagccaugcccaaaaccuccuugugcuuuuacauuguggagagggaauacugcaaaagcuguaguaaagaagacacacaaaaaugugucaacacaaagcuugaacaaccacaaagcauuuuaaucgagcacaaagggacgauaaucggaaagcagaacgacacuuguacagccaaagcaaguugcugguuagagucaauuaagaguuuuuuuuauggacuaaagaauaugcuuaguggcauuuuuggcaauguuuucauagggauuuucuuauuccucgcuccuuuuaucaugcuaauacuuuucuucauguuuggauggaggauccuguucugcuucaaguguugcagaagaacuagaggcuuauuuaaguauagacaccucaaagacgaugaagaaaucgguuacaggaaaaucauugagaggcuaaacaacaaaaaagggaaaaacaaacuacuugacggugaaagacuagcugauaggaagaucgcugagcuguucucuacaaaaacacacauuggc

SEQ ID NO: 4051 - RNA, 1932 nt, Artificial Sequence
  derived and/or modified CDS sequence (wt) from CCHFV(SPU 383/87)__KJ682806.1__Gc
uuuuuggacaguauuguuaagggcaugaagaacuugcuaaauucaacaagccuagaaacaagcuuaucaauugaggcaccauggggggcaauaaauguccagucaacuuucaaaccaacugugucagcugcaaacauagcgcuuaguuggagcucaguagaacauagaggcaauaaaauuuugguuucaggcagaucagagucaaucaugaaauuagaggaaaggacaggaauuagcugggaucuggguguggaagacgccucugaguccaaauugcucacugucucuguaauggacuugucacaaauguauucuccugucuuugaguaccuaucaggugauagacaaguggaggaauggcccaaggcaaccugcacaggagauugcccagaaagaugcggcugcacgucaucaaccugccuacacaaggaauggccccauucaagaaacuggagaugcaacccuacuugguguuggggagucggcacuggaugcaccuguugugggcuggaugugaaagaccucuuuacagauuacauguuugucaaguggaaaguugacuacauuaaaacagaagcuauaguguguguugagcuuacuagccaggaaagacaauguagcuuaauugaggcaggcacaagauucaacuuggguccugugacuaucacauugucagagccaagaaacauucagcagaagcucccuccagaaauagucacauugcauccuaggauugaagaaggcuucuuugacuuaaugcauauacaaaaagugcuaucagcaaguacaguauguaagcuacagaguugcacacauggcgugccaggagaccuacagaucuaccacauuggaaacuuguuaaaaggagacaaggugaacgggcaccugauucacaaaauugaaccacacuucaacaccuccuggaugucuugggacggcugugaccuagacuacuacuguaauaugggggauuggccaucuugcucauauacuggcguaacccaacacaaucaugcugcauuuguaaacaugcucaacaucgaaacugauuauacaaaaaacuuccacuuucacucuaagagaguuacagcacauggagacacaccacaauuagauuuaaaagcuagaccaacuuauggugcaggugaaaucacugugcugguagagguugcugacauggaguugcauacaaagaaaauugagauaucagguuugaaguuugcaagcuuaacuugcacaggcuguuaugcuuguaguucugguaucuccuguaagguuaggauccauguagaugaaccagaugagcuuacaguacaugugaagagcgaggauccagacauaguugcugcuaguucaagucucauggcuaggaagcuugaauuugggacagauagcacauuuaaagccuuuucagccaugcccaaaaccuccuugugcuuuuacauuguggagagggaauacugcaaaagcuguaguaaagaagacacacaaaaaugugucaacacaaagcuugaacaaccacaaagcauuuuaaucgagcacaaagggacgauauuuggaaagcagaacgacacuuguacagccaaagcaaguugcugguuagagucaguuaagaguuuuuuuuauggacuaaagaauaugcuuaguggcauuuuuggcaauguuuucauagggguuuucuuauuccucgcuccuuuuaucaugcuaauacuuuucuucauguuuggauggaggauccuguucugcuuuaaguguugcagaagaacuagaggcuuauuuaaguauagacaccucaaagacgaugaagaaaucgguuacaggaaaaucauugagaggcuaaacaacaaaaaagggaaaaacaaacugcuugacggugaaagacuagcugauaggaagauugcugagcuguucucuacaaaaacacacauuggc

SEQ ID NO: 4052 - RNA, 1932 nt, Artificial Sequence
  derived and/or modified CDS sequence (wt) from CCHFV(SPU 130/89)__KJ682807.1__Gc
ucuuuggacaguauuguuaaaggcaugaagaacuugcuaaauucaacaagccuagaaacaagcuuaucaauugaggcaccauggggggcaauaaauguccagucaacuuucaaaccaacugugucagcugcaaacauagcgcuuaguuggagcucaguagaacauagaggcaauaaaauuuugguuucaggcagaucagagucaaucaugaaauuagaggaaaggacaggaauuagcugggaucuggguguggaagacgccucugaguccaaauugcucacugucucuguaauggacuugucacaaauguauucuccugucuuugaguaccuaucaggugauagacaaguggaggaauggcccaaggcaaccuguacaggagauugcccagaaagaugcggcugcacgucaucaaccugccuacacaaagaauggccccauucaagaaacuggagaugcaacccuacuugguguuggggagucggcacuggaugcaccuguugugggcuggaugugaaagaccucuuuacagauuacauguuugucaaguggaaaguugacuacauuaaaacagaagcuauaguguguguugagcuuacuagccaggaaagacaauguagcuuaauugaggcaggcacaagauucaacuuggguccugugaccaucacauugucagagccaagaaacauucagcagaagcucccuccagaaauagucacauugcauccuaggauugaagaaggcuucuuugacuuaaugcauauacaaaaagugcuaucagcaaguacaguauguaagcuacagaguugcacacauggcgugccaggagaccuacagaucuaccacauuggaaacuuguuaaaaggagacaaggugaacgggcaccugauucacaaaauugaaccacacuucaacaccuccuggaugucuugggacggcugugaccuagacuacuacuguaauaugggggauuggccaucuugcucauacacuggcguaacccaacacaaccaugcugcauuuguaaacaugcucaacaucgaaacugauuauacaaaaaacuuccacuuucacucuaagagaguuacagcacauggggacacaccacaauuagauuuaaaagcuagaccaacuuauggugcaggugaaaucacugugcugguagagguugcugacauggaguugcauacaaagaaaguugagauaucagguuugaaguuugcaagcuuaacuugcacaggcuguuaugcuuguaguucugguaucuccuguaaggucaggauccauguagaugaaccagaugagcuuacaguacaugugaagagcgaggauccagacauaguugcugcuaguucaagucucauggcuaggaagcuugaauuugggacagauagcacauuuaaagccuuuucagccaugcccaaaaccuccuugugcuuuuacauuguggagagggaacacugcaaaagcuguaguaaagaagacacacaaagaugugucaacacaaagcuugaacaaccacaaagcauuuuaaucgagcacaaagggacgauaauuggaaagcagaacgacacuuguacagccaaagcaaguugcugguuagagucaauuaagaguuuuuuuuauggacuaaagaauaugcuuaguggcauuuuuggcaauguuuucauagggguuuucuuauuccucgcuccuuuuaucauacuaauacuuuucuucauguuuggauggaggauccuguucugcuuuaaguguugcagaagaacuagaggcuuacuuaaguauagacaccucaaagacgaugaggaaaucgguuacaggaaaaucauugagaggcuaaacaacaaaaaagggaaaaacaaacugcuugacggugaaagacuagcugauaggaagaucgcugagcuguucucuacaaaaacacacauuggc

SEQ ID NO: 4053 - RNA, 1932 nt, Artificial Sequence
  derived and/or modified CDS sequence (wt) from CCHFV(SPU 497/88)__KJ682808.1__Gc
uuuuuggacaguauuguuaaaggcaugaggaacuugcuaaauucaacaagccuagaaacaagcuuaucaauugaggcaccauggggggcaauaaauguccagucaacuuucaaaccaacugugucagcugcaaacauagcgcuuaguuggagcucaguagaacauagaggcaauaaaauuuugguuucaggcagaucagagucaaucaugaaauuagaggaaaggacaggaauuagcugggaucuggguguggaagacgccucugaguccaaacugcucacugucucuguuauggacuugucacaaauguauucuccugucuuugaauaccuaucaggugauagacaaguggaggaauggcccaaggcaaccugcacaggagauugcccagaaagaugcggcugcacgucaucaaccugccuacacaaggaauggccccauucaagaaacuggagaugcaacccuacuugguguuggggagucggcacuggaugcaccuguuguggguuggaugugaaagaccucuuuacagauuacauguuugucaaguggaaaguugacuacauuaaaacagaagcuauaguguguguugagcuuacuagccaggaaagacaauguagcuuaauugaggcaggcacaagauucaacuuggguccugugaccaucacauugucagaaccaaggaacauucagcaaaagcucccuccagaaauagucacauugcauccuaggauugaagaaggcuucuuugacuuaaugcauauacaaaaaguacuaucagcaaguacaguauguaagcuacagaguugcacacauggcgugccaggagaccuacagaucuaccacauuggaaacuuguuaaaaggagacaaggugaacgggcaccugauucacaaaauugaaccacacuucaacaccuccuggaugucuugggacggcugugaccuagacuacuacuguaacaugggggauuggccaucuugcucauauacuggcguaacccaacacaaucaugcugcauuuguaaacaugcucaacaucgaaacugauuauacaaaaaacuuccacuuucacucuaagagaguuacagcacauggagacacaccacaauuagauuuaaaagcuagaccaacuuauggugcaggugaaaucacugugcugguagagguugcugacauggaguugcauacaaagaaaauugagauaucagguuugaaguuugcaagcuuaacuugcacaggcuguuaugcuuguaguucugguaucuccuguaagguuaggauccauguagaugaaccagaugagcuuacaguacaugugaagagcgaggauccagacauaguugcugcuaguucaagucucauggcuaggaagcuugaauuugggacagauagcacauuuaaagccuuuucagccaugcccaaaaccuccuugugcuuuuacauuguggagagggaauacugcaaaagcuguaguaaagaagacacacaaaaaugugucaacacaaagcuugaacaaccacaaagcauuuuaaucgagcacaaagggacgauaauuggaaaacagaacgacacuuguacagccagagcaaguugcugguuagagucaaucaagaguuuuuuuuauggacugaagaauaugcuuaguggcauuuuuggcaauguuuucauagggauuuucuuauucuucgcuccuuuuaucaugcuaauacuuuucuuuauguuuggauggaggauccuguucugcuuuaaguguugcagaagaacuagaggcuuguuuaaguauagacaccucaaagacgaugaagaagucgguuacaggaaaaucauugagaggcuaaacaacaaaaaagggaaaaacaaacugcuugacggugaaagacuagcugauaggaagaucgcugagcuguucucuacaaaaacacacauuggc

SEQ ID NO: 4054 - RNA, 1932 nt, Artificial Sequence
  derived and/or modified CDS sequence (wt) from CCHFV(SPU 18/88)__KJ682810.1__Gc
uuuuuggacaguauuguuaaaggcaagaagaacuugcuaaauucaacaagccuagaaacaagcuuaucaauugaggcaccauggggggcaauaaauguccagucaacuuucaaaccaacugugucagcugcaaacauagcgcuuaguuggagcucaguagaacauagaggcaauaaaauuuugguuucaggcagaucagagucaaucaugaaauuagaggaaaggacaggaauuagcugggaucuggguguggaagacgccucugaguccaaauugcucacugucucuguuauggacuugucacaaauguauucuccugucuuugaguaccuaucaggugauagacaaguggaggaauggcccaaggcaaccugcacaggagauugcccagagagaugcggcugcacgucaucaaccugccuacacaaggaauggccccauucaagaaacuggagaugcaacccuacuugguguuggggagucggcacuggaugcaccuguugugggcuggaugugaaagaccucuuuacagauuacauguuugucaaguggaaaguugacuacauuaaaacagaagcuauaguguguguugagcuuacuagccaggaaagacaauguagcuuaauugaggcaggcacaagauucaacuuggguccugugaccaucacauugucagagccaagaaacauucagcaaaagcucccuccagaaauagucacauugcauccuaggauugaagaaggcuucuuugacuuaaugcauauacaaaaagugcuaucagcaaguacaguaugcaagcuacagaguugcacacauggcgugccaggagaccuacagaucuaccacauuggaaacuuguuaaaaggagacaaggugaacgggcaccugauucacaaaauugaaccacacuucaacacuuccuggaugucuugggacggcugugaccuagacuacuacuguaauaugggggauuggccaucuugcucauauacuggcguaacccaacacaaucaugcugcauuuguaaacaugcucaacaucgaaacugauuauacaaaaaacuuccacuuucacucuaagagaguuacagcacauggagacacaccacaauuagauuuaaaagcuagaccaacuuauggugcaggugaaaucacugugcugguagagguugcagacauggaguugcauacaaagaaaauugagauaucagguuugaaguuugcaagcuuaacuugcacaggcuguuaugcuuguaguucugguaucuccuguaagguuaggauccauguagaugaaccagaugagcuuacaguacaugugaagagcgaggacccagacauaguugcugcuaguucaagucucauggcuaggaagcuugaauuugggacagauagcacauuuaaagccuuuucagccaugcccaaaaccuccuugugcuuuuacauuguggagagggaauacugcaaaagcuguaguaaagaagacacacaaaaaugugucaacacaaagcuugaacaaccacaaagcauuuuaaucgagcacaaagggacgauaauugggaagcagaacgacacuuguacaggcaaagcagguugcugguuagagucaaucaagaguuuuuuuuauggacuaaagaauaugcuuaguggcauuuuuggcaauguuuucauagggauuuucuuauuccuagcuccuuuuaucaugcuaauacuuuucuucauguuuggauggaggauccuguucugcuuuaaguguugcagaagaacuagaggccuauuuaaguauagacaccucaaagacgaugaagaaaucgguuacaggaaaaucauugagaggcuaaaaaacaaaaaagggaaaaacaaacugcuugauggugaaagacuagcugauaggaagaucgcugagcuguucucuacaaaaacacacauuggc

SEQ ID NO: 4055 - RNA, 1932 nt, Artificial Sequence
  derived and/or modified CDS sequence (wt) from CCHFV(SPU 431/85)__KJ682812.1__Gc
uuuuuagacaguauuguuaaaggcaggaagaacuugcuaaacucaacaagcuuggaaacaagcuuaucaauugaggcaccauggggugcaauaaauguccaaucaaccuucaaacccacugugucagcugcaaacauagcacuuagcuggagcucaguggaacacagaggcaacaagauuuugguuucaggcaggucagaaucaaucaugaagcuggaggaaaggacaggaaucagcugggaucugggaguagaagacgccucugaguccaaauugcucaccgucucugucauggacuugucacaaauguauucccccgucuuugaguaccugucaggugauagacagguagaagaguggcccaaggcgaccuguacaggcgauugcccagaaagauguggcugcacaucaucaaccuguuugcacaaggaauggccccauucaaggaacuggagaugcaaccccacuugguguuggggggucggcacuggaugcaccuguugugggcuagauguaaaagaccucuuuacagauuacauguuugucaaguggaaaguugaauacauaaaaacagaggccauagugugugucgaacuuacuagccaagaaaggcaauguagcuugauugaagcaggcacaagauucaauuuagguccugugacuaucacauuaucggagccaagaaacauucagcaaaagcucccuccagaaauaauuacauugcauccuagaauugaagaaggcuuuuuugacuuaaugcaugugcaaagagugcugucagcaagcacagugugcaagcuacagaguugcacacauggugugccaggagaccuacaggucuaccacaucggaaacuuguuaaaaggagacaagguaaacgggcaucugauucacaagauugaaccacauuucaacacuuccuggaugucuugggauggcugugaccuagauuacuacugcaauaugggggauuggccuucuugcacauacacuggaguaacccaacauaaccaugcugcauuuguaaauuugcucaauaucgaaaccgauuauacaaaaaacuuucauuuucacuccaagagaguuacugcacauggagacacaccacaauuagacuugaaggccagaccaacuuauggugcaggggagguuacuguacuaguggagguugcugacauggagcugcacacaaagaaaauugagauaucaggcuugaaguuugcaagucuaacuugcacaggcugcuaugcuuguagcucugguaucuccuguaaggucaagauccauguagaugaaccagaugagcuuacaguacaugugaagagugaagacccagacauaguugcugcaggcucaagucucauggcaaggaagcuugaauuuggggcagauaguacauucaaagccuuuucagccaugcccaaaaccuccuugugcuuuuauauuguggagagagaauacuguaagagcugcaguagagaggacacacgaaaauguguuaacacuaagcuugaucgaccacagagcauuuugaucgaacauaaaggaacgauuauuggaaagcaaaacaacacaugcacagcuaaagcaagcugcuggcuagagucagucaaaaguuuuuucuacggauugaagaauaugcuuaguggcauuuucgguaauguuuucauagggauuuucuuauucauugcuccuuuuguccuguuaauacuuuucuuuauguuuggguggaggauccuguucugcuuuaagugcugcagaagaaccagaggccuauuuaaguacagacaccucaaggacgaugaagaaaccgguuacaggaaaaucauugagaggcuaaauaacaaaaagggaaaaaacaaacuacuugauggggaaaggcuagcugauaggaaaaucgccgaguuauucuccacaaaaucacauaucggc

SEQ ID NO: 4056 - RNA, 1932 nt, Artificial Sequence
  derived and/or modified CDS sequence (wt) from CCHFV(SPU 48/90)__KJ682813.1__Gc
uuccgagacaguauaguuaaaggcaugaaaaaucugcuaaacucaacaaguuuagaaacaagucuaucaauugaggcaccauggggggcaauaaauguucagucaaccuacaagccaacugugucgacugcaaacauagcacucagcuggagcucaguggaacacagaggcaauaagaucuugguuucaggcagaucagaaucaauuaugaagcuggaagaaaggacagggaucagcugggaucucggcguagaagacgccucugaguccaaacugcuuacagucucugucauggacuugucucagauguacucuccugucuucgaguacuuaucaggagacagacagguggaagaguggcccaaagcaacuuguacaggugacugcccagaaagauguggcugcacaucaucaacauguuugcacaaagaauggccccacucaagaaauuggagaugcaauccuacuuggugcugggguguagggacuggcugcaccuguuguggauuagaugugaaagaccuuuuuacagauuauauguuugucaaguggaaaguugaauacaucaagacagaggccauaguguguguagaacuuaccagucaggaaaggcaguguagcuugauugaagcgggcacaagguucaauuuagguccugugaccaucacacugucagaaccaagaaacauccaacagaagcucccuccugaaauaaucacacuacauccuaggauugaagaagguuuuuuugaccugaugcacguucagaaaguguuaucagcaagcacaguguguaaguugcagaguugcacacaugguguaccaggagaccuacaggucuaccacaucggaaauuuauuaaaaggggacaagguaaauggacaucuaauucauaaaauugagccacacuucaacacuuccuggauguccugggaugguugugaccuagacuacuacugcaacaugggagauuggccuucuugcacauacacaggagucacccaacacaaucgugcuucauuuguaaaccugcucaacauugaaacugauuacacaaaaaacuuccauuuucacucuaaaagggucacugcacacggagacacaccacaacuggaucuuaaggcaagaccaaccuauggugcaggugagauuacuguacugguagaaguugcugacauggaguuacacacaaagaagauugaaauaucaggcuuaaaauuugcaagcuugacuugcacagguuguuaugcuuguagcucuggcaucucaugcaaaguuagaauucauguggacgaaccagaugaacuuacagugcauguuaaaagugaugauccagauguaguugcagcuagcucaagccucauggcaagaaagcuugaauuuggaacagacagcacauuuaaagcuuucucagccaugccuaaaacuucgcuauguuucuacauuguugaaaaagaauacugcaagagcugcagugaagaagacacaaaaaaauguguuaacacaaaacuugagcaaccacaaagcauuuugaucgaacacaagggaacuauaaucggaaagcaaaacagcacuugcacagccaaagugaguugcugguuagagucagccaagaguuuuuuuuauggucuaaaggacaugcuuaguggcauuuuuggcaaugucuuuauagguauuuucuuguuccuugcccccuucauccuguuaauacuauucuuuauguuuggguggaggauccuacuuugcuuuaaauguuguagaagaacuagaggccuguucaaguauagacaccucaaggacgaugaagaaacugguuauagaaggauuauugaaagacuaaacaauaaaaaaggaaaaaacaaauugcuugauggugaaagacuugcugauagaagaauugcugaacuguucuccacaaaaacacacauuggc

SEQ ID NO: 4057 - RNA, 1932 nt, Artificial Sequence
  derived and/or modified CDS sequence (wt) from CCHFV(SPU 187/90)__KJ682814.1__Gc
uuccuagauaguauaguuaaagguaugaaaaaucugcuaaauucaacaaguuuagaaacaaguuuaucaauugaggcaccauggggggcaauaaauguucagucaaccuacaaaccaacugugucaacugcaaacauagcacucaguuggagcucuguggaacacagaggcaauaagaucuugguuucaggcagaucagaaucaauuaugaagcuggaagaaaggacaggaaucagcugggaccucggcguggaagacgccucugagucuaaacugcuuacagucucugucauggacuugucucagauguacucuccugucuucgaguacuuaucaggagacagacagguggaagaguggcccaaggcaacuuguacaggugacugcccagaaagauguggcugcacaucaucaacauguuuacacaaagaauggccccacucaagaaauuggaggugcaaucccacuuggugcugggguguagggacuggcugcaccuguuguggauuagaugugaaggaccuuuuuacagauuauauguuugucaaguggaaaguugaauauauuaagacagaagccauaguguguguagaacuuaccagucaggaaaggcaguguagcuugauugaagcaggcacaagguucaauuuagguccuguaaccaucacacugucagaaccacgaaacauccaacagaagcucccuccugaaauaaucacacugcaucccaggaucgaagaagguuuuuuugaccugaugcauguacagaaaguguuaucggcaagcacaguguguaaguugcagaguugcacacauggugugccaggagaccuacaggucuaccacaucgggaauuuauuaaaaggggauaaggugaauggacaucuaauucauaaaauugagccacacuucaacacuuccuggauguccugggaugguugugaccuagacuacuacugcaacaugggagauuggccuucuugcacauacacaggagucacccaacacaaucaugcuucauuuguaaaccugcucaacauugaaacugauuacacaaaaaacuuccacuuucacucuaaaagggucacugcacacggagacacaccacaacuagaucuuaaggcaagaccaaccuauggugcaggugagaucacuguacugguagaaguugcugacauggaguuacacacaaagaagauugaaauaucaggcuuaaaauuugcaagcuugacuugcacaggcuguuaugcuuguagcucuggcaucucaugcaaaguuagaauucauguggaugaaccagaugaacuuacaguacauguuaaaagugaugauccagauguaguugcagcuagcucaagucucauggcaagaaagcuugaauuuggaacagacaguauauuuaaagcuuucucagccaugccuaaaacuucucuauguuucuacauuguugaaagagaacacuguaagagcugcagcgaagaagacacuaaaaaauguguuaacacaaaacuugagcaaccacaaagcauuuugaucgaacacaagggaacuauaaucggaaagcaaaacagcacuugcacagccaagacgaguugcugguuagagucagucaaaaguuuuuuuuauggucuaaagaacaugcuuaguggcauuuuuggaaauguuuuuauagguauuuucuuguuccuugcccccuucauccuguuaauacuguucuuuauguuuggguggaggauccuauuuugcuuuaaauguugcagaagaacuagaggccuguucaaguauagacacuuaaaggacgaugaagaaacugguuauagaaggauuauugaaagauuaaacaauaaaaaaggaaaaaacaaacugcuugauggugaaagacuugcugauagaagaauugccgaacuguucucuacaaaaacacacauuggc

SEQ ID NO: 4058 - RNA, 1932 nt, Artificial Sequence
  derived and/or modified CDS sequence (wt) from CCHFV(Haskovo-V46/13)__KR092379.1__Gc
uucuuagacaguauaguuaaagguaugaaaaauuugcuaaacucaacaagcuuggaaacaagcuuaucaauugaggcaccauggggagcaauaaauguccagucaaccuuuaaaccaacaguaucgacugcaaacauagcacucaguuggagcucaguggagcacagaggcaacaagaucuuagucacaggcaggucugaaucaaucaugaaacuagaggaaaggacaggagucagcugggaucuaggcguagaagaugccucagaauccaaauuacuuaccguuucuaucauggauuuaucacaaauguauuccccuguuuuugaguacuugucaggggacagacagguugaagaauggccaaaagcaacuuguacaggugauugcccagaaagguguggcugcacaucaucaaccugcuuacauaaagaauggccucacucaagaaacuggagaugcaaucccacuuggugcuggggaguaggaaccggcugcaccuguugcgggguggauguaaaagaccuuuuuacggaucacauguucgucaaauggaaaguugaauacauaaaaacugaagccauaguauguguugagcucaccagccaagaaagacagugcagucugauugaggcagguacuagauucaacuugggcccugugacuauuacccugucugagccaagaaacauucagcagaagcuucccccugaaauuaucacguugcaucccaaaauugaagaaggcuucuuugacuugaugcauguacaaaaaguguugucugcaaguacaguguguaaacugcagaguugcacacaugguauaccaggagaucuacaaguuuaccacauuggcaacuuguugaaaggggauagaguaaacgggcaucuaauucacaaaauugaaccacauuucaacaccucuuggauguccugggaugguugugauuuagauuacuacugcaacaugggggauuggccuucuugcacauacacaggagugacccagcauaaccaugcugcauuuguaaacuugcuuaacauugaaacugauuacacgaaaaccuuccacuuccacucuaaaagaguuacagcacauggugacacaccacaauuggacuuaaaagcaaggccgaccuacggugcaggugagaucacugugcugguugagguugcugacauggaguugcauaccaagaaaguugaaauaucaggcuugaaauuugcaaguuugacuugcacggguugcuaugcuuguagcucuggcaucuccugcaaaguuaggauucauguagaugaaccagaugagcuuacaguacauguaaagagcagugauccugaugugguugcagcuggcacaagucuuauggcgaggaagcuugaauuuggaacagacagcacauucaaggccuuuucagcuaugcccaaaaccucuuuauguuuuuacauuguggagagagaauacugcaagagcugcagugaagaugauacacaaaaauguguugacacaaaacuugagcagccacagagcauacuaauugagcacaaaggaacaauaauuggaaagcagaaugauacuugcacagccagggcaagcuguuggcuagagucagucaagaguuuuuuuuauggauugaagaauaugcuuggcaguguuuuugguaauuuuuuaauaggcauuuuguuauuccuugccccuuuuguccuguuggugcuuuucuuuauguuuggguggaaaaucuuguuuugcuuuaaauguugcaggaggaccagaggcuuauucaaauauagacaccucaaagacgaugaggaaacaggcuacagaaggauuauugaaagacugaacagcaaaaaagggaaaaacagacugcuugauggugaaaggcuggcugauaggaaaauugcugagcuguucuccacaaaaacacacauuggc

SEQ ID NO: 4059 - RNA, 1932 nt, Artificial Sequence
  derived and/or modified CDS sequence (wt) from CCHFV(24-R-2012)__KR814856.1__Gc
uucuuagacaguauaguuaaaggcaugaagaauuugcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguagaagaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaacuugcuugcauaaagaauggccucacucaagaaacuggagauguaaucccacuuggugcuggggaguaggaacuggcugcaccugcugcgggguggauguaaaagaccuuuuuacagaucacauguuugucaaauggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcaugugcaaaaaguguugucugcaaguacaguguguaaacugcagaguugcacacaugguauaccaggagaucuacaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaauaucgaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcauaccaagaaaguugagauaucaggcuuaaaauuugcaagucuggcuugcacggguugcuaugcuuguagcucuggcaucuccuguaaagucaggauucauguagaugagccagaugagcucacaguacauguaaagagcaaugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaaugauacuugcacagccaaggcaagcuguuggcuagagucagucaagaguuuuuuuuauggauugaaaaauaugcuugguaguguauuugguaacuuuuucauaggcauuuuguuauuccuugccccuuuuguccuguuggugcuuuucuuuauguuuggauggaaaaucuuguuuugcuucaaauguugcaggaggaccagaggcuuacuuaaguauagacuccucaaagacgaugaggaaacaggcuacagaaggauuauugaaagacugaacaacaaaaaaggaaaaaacagacugcuugauggugaaagguuggcugauaggaaaauugcugagcuguucuccacaaaaacacacauuggu

SEQ ID NO: 4060 - RNA, 1932 nt, Artificial Sequence
  derived and/or modified CDS sequence (wt) from CCHFV(36-ST-2014)__KR814857.1__Gc
uucuuagacaguauaguuaaagguaugaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggauuugucacaaauguauuccccuguuuuugaguacuuaucaggagauagacagguugaagaauggcccaaggcaaccugcacaggugauugcccagaaagguguggcugcacaucaucaaccugcuugcauaaagaauggccucacucaagaaacuggagauguaaucccacuuggugcuggggaguaggaaccggcugcacaugcugcggaguggauguaaaagaccuuuuuacagaucacauguuuaucaaauggaagguugaauauauaaaaaccgaagccauaguauguguugagcucaccagccaagaaagacagugcagucugauugaggcagguacuagauucaacuuggguccugugacuaucacccugucugagccaagaaacauucagcagaagcuucccccugagaucauuacgcugcauccuaaaauugaagaaggcuucuuugacuugaugcaugugcaaaaaguguuaucugcaaguacaguguguaaacugcagaguugcacacaugguauaccaggagaucuacaaauuuaccacauuggcaacuuguugaaaggggauagauuaaacgggcaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccauucuaaaagagucacagcacauggagacacaccacaauuagacuuaaaagcaaggccgacuuacggugcaggugagaucacugugcugguugagguugcugacauggaguugcauaccaagaaaguugagauaucaggcuugaaauuugcaagucuggcuugcacggguugcuaugcuuguagcucuggcaucuccuguaaagucagaauucauguagaugaaccggaugagcucacagugcauguaaagagcagugauccagaugugguugcagcuagcacaagccuuauggcaaggaagcuugaauuugggacagauagcacauucaaggcauuuucagcuaugcccaaaaccucuuuaugcuuuuacauuguggagagggaauacugcaagagcugcagugaagaugauacaaaaaaauguguugacacaaaacuugaucagccacagagcauacuaauugagcacaaagggaccauaauuggaaagcagaaugacacuugcacagccaaggcaaguuguuggcuagagucagucaagaguuuuuuuuauggauugaagaauaugcuuggcaguguuuuugguaauuuuuucguaggcauuuuguuauuccuugcccccuuugucuuguuggugcuuuucuuuauguguggauggaaauucuuguuuugcuuuaaguguugcaggaggaccagaggcuuguuuaaguauagacaccucaaagaugaugaggaaacaggcuacagaaggauuauugaaagacugaacagcaaaaaaggaaagaacagacugcuugauggugagagguuggcugauaggaaaauugcugagcuguucucuacaaaaucacacauuggc

SEQ ID NO: 4061 - RNA, 1932 nt, Artificial Sequence
  derived and/or modified CDS sequence (wt) from CCHFV(37-R-2013)__KR814858.1__Gc
uucuuagacaguauaguuaaaggcaugaagaauuugcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguagaugaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaacuugcuugcauaaagaauggccucacucaagaaacuggagauguaaucccacuuggugcuggggaguaggaacuggcugcaccugcugcgggguggauguaaaagaccuuuuuacagaucacauguuugucaaauggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcaugugcaaaaaguguugucugcaaguacaguguguaaacugcagaguugcacacaugguauaccaggagaucuacaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaauaucgaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcauaccaagaaaguugagauaucaggcuuaaaauuugcaagucuggcuugcacggguugcuaugcuuguagcucuggcaucuccuguaaagucaggauucauguagaugagccagaugagcucacaguacauguaaagagcaaugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaauguuacuugcacagccaaggcaagcuguuggcuagagucagucaagaguuuuuuuuauggauugaaaaauaugcuugguaguguauuugguaacuuuuucauaggcauuuuguuauuccuugccccuuuuguccuguuggugcuuuucuuuauguuuggauggaaaaucuuguuuugcuucaaauguugcaggaggaccagaggcuuacuuaaguauagacuccucaaagacgaugaggaaacaggcuacagaaggauuauugaaagacugaacaacaaaaaaggaaaaaacagacugcuugauggugaaagguuggcugauaggaaaauugcugagcuguucuccacaaaaacacacauuggu

SEQ ID NO: 4062 - RNA, 1932 nt, Artificial Sequence
  derived and/or modified CDS sequence (wt) from CCHFV(44-ST-2010)__KR814859.1__Gc
uucuuagacaguauaguuaaagguaugaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggauuugucacaaauguauuccccuguuuuugaguacuuaucaggagauagacagguugaagaauggcccaaggcaaccugcacaggugauugcccagaaagguguggcugcacaucaucaaccugcuugcauaaagaauggccucacucaagaaacuggagauguaaucccacuuggugcuggggaguaggaaccggcugcacaugcugcggaguggauguaaaagaccuuuuuacagaucacauguuuaucaaauggaagguugaauauauaaaaaccgaagccauaguauguguugagcucaccagccaagaaagacagugcagucugauugaggcagguacuagauucaacuuggguccugugacuaucacccugucugagccaagaaacauucagcagaagcuucccccugagaucauuacgcugcauccuaaaauugaagaaggcuucuuugacuugaugcaugugcaaaaaguguuaucugcaaguacaguguguaaacugcagaguugcacacaugguauaccaggagaucuacaaauuuaccacauuggcaacuuguugaaaggggauagauuaaacgggcaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccauucuaaaagagucacagcacauggagacacaccacaauuagacuuaaaagcaaggccgacuuacggugcaggugagaucacugugcugguugagguugcugacauggaguugcauaccaagaaaguugagauaucaggcuugaaauuugcaagucuggcuugcacggguugcuaugcuuguagcucuggcaucuccuguaaagucagaauucauguagaugaaccggaugagcucacagugcauguaaagagcagugauccagaugugguugcagcuagcacaagccuuauggcaaggaagcuugaauuugggacagauagcacauucaaggcauuuucagcuaugcccaaaaccucuuuaugcuuuuacauuguggagagggaauacugcaagagcugcagugaagaugauacaaaaaaauguguugacacaaaacuugaucagccacagagcauacuaauugagcacaaagggaccauaauuggaaagcagaaugacacuugcacagccaaggcaaguuguuggcuagagucagucaagaguuuuuuuuauggauugaagaauaugcuuggcaguguuuuugguaauuuuuucguaggcauuuuguuauuccuugcccccuuugucuuguuggugcuuuucuuuauguguggauggaaaaucuuguuuugcuuuaaguguugcaggaggaccagaggcuuguuuaaguauagacaccucaaagaugaugaggaaacaggcuacagaaggauuauugaaagacugaacagcaaaaaaggaaagaacagacugcuugauggugagagguuggcugauaggaaaauugcugagcuguucucuacaaaaucacacauuggc

SEQ ID NO: 4063 - RNA, 1932 nt, Artificial Sequence
  derived and/or modified CDS sequence (wt) from CCHFV(46-ST-2012)__KR814860.1__Gc
uucuuagacaguauaguuaaaggcaugaaaaauuugcuaaacucaacaagcuuagaaacaagcuuaucaaucgaggcaccauggggagcaauaaauguccagucaaccuuuaaaccaacaguaucgacugcaaacauagcacucaguuggagcucaguggagcacagaggcaacaagaucuuagucacaggcaggucugaaucaauuaugaaacuggaggaaaggacaggagucagcugggaucuaggcguagaggaugccucugaauccaaauuacuuaccgucucuaucauggaucugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcuggggaguaggaacuggcugcaccugcugcgggguggauguaaaagaccuuuuuacagaucacauguuugucaaguggaagguugaauauauaaaaacugaagccauaguauguguugagcucaccagccaagaaagacagugcagucugauugaggcagguaccagauucaacuugggcccugugacuauuacccugucugagccaagaaacauacagcagaagcuucccccugagauuaucacauugcaucccaaaguugaagagggcuucuuugacuugaugcaugugcaaaaaguguugucugcaaguacaguguguaaacugcagaguugcacacacgguauaccaggagaucuacaaguuuaccacauuggcaacuuacugaaaggagauaggauaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacauugaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcacaccaaaaaaguugagauaucaggcuugaaauuugcaagucuggcuugcacggguugcuaugcuuguagcucuggcaucuccuguaaagucaggauucauguagaugagccagaugagcucacaguacauguaaagagcagugauccagaugugguugcagccagcacaagucucauggcgaggaagcuugaguuugggacagacaguaccuucaaggccuuuucagcuaugcccaaaaccucuuuauguuuuuacauuguggagagagaauacuguaagagcugcagugaagaggacacacaaaaauguguugacacaagacuugagcagccgcagagcauacuaauugagcacaaaggaacgauaauuggaaagcagaaugauacuugcacagccaaggcaagcuguugguuagagucagucaagaguuuuuuuuauggauugaagaauaugcuugguagugucuuugguaauuuuuucauaggcauucuguuauuccuugccccuuuuguccuguuggugcuuuucuuuauguuuggguggaaaaucuuguuuugcuuuaaauguugcaggaggaccagaggcuuacuuaaguauagacaccucaaagacgaugaggaaacaggcuacagaaggauuauugaaagacugaacaacaaaaaagggaaaaacagacugcuugauggugaaagguuggcugauaggaagauugcugagcuguucuccacaaaaacacacauuggu

SEQ ID NO: 4064 - RNA, 1932 nt, Artificial Sequence
  derived and/or modified CDS sequence (wt) from CCHFV(47-ST-2013)__KR814861.1__Gc
uucuuagacaguauaguuaaagguaugaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagauccuggucacaggcaggucugaaucaauuaugaaacuagaggaaaggacaggagucagcugggaucuagguguagaagaugccucugaauccaaauuacuuaccgucucuaucauggauuugucacaaauguauuccccuguuuuugaguacuuaucaggagauagacagguugaagaauggcccaaggcaaccugcacaggugaaugcccagaaagguguggcugcacaucaucaaccugcuugcauaaagaauggccucacucaagaaacuggagauguaaucccacuuggugcuggggaguaggaaccggcugcacaugcugcggaguggauguaaaagaccuuuuuacagaucacauguuuaucaaauggaagguugaauauauaaaaaccgaagccauaguauguguugagcucaccagccaagaaagacagugcagucugauugaggcagguacuagauucaacuuagguccugugacuaucacccugucugagccaagaaacauucagcagaagcuucccccugagaucauuacgcugcaucccaaaauugaagaaggcuucuuugacuugaugcauguacaaaaaguguuaucugcaaguacaguguguaaacugcagaguugcacacaugguauaccaggagaucuacaaauuuaccacauuggcaacuuguugaaaggggauagaguaaacgggcaucuaauucacaaaauugaaccacauuuuaacaccucuuggauguccugggaugguugugaccuagacuacuacugcaacaugggggauuggccuucuugcacauacacaggagugacccaacauaaucaugcugcauuuguaaacuugcuuaacauugaaacugauuacacaaaaaccuuccacuuccacucuaaaagagucacagcacauggagacacaccacaauuagacuuaaaagcaaggccgaccuacggugcaggugagaucaccgugcugguugagguugcugacauggaguugcauaccaagaaaguugagguaucaggcuugaaauuugcaagucuggcuugcacggguugcuaugcuuguagcucuggcaucuccuguaaagucagaauucauguagaugaaccagaugagcucacagugcauguaaagagcagugauccagaugugguugcagcuagcacaagccuuauggcaaggaagcuugaauuugggacagauaguacauucaaggcauuuucagcuaugccuaaaaccucuuuaugcuuuuacauuguggagagggaauacugcaaaagcugcagugaagaugauacaaaaaaauguguugacacaaaacuugaacagccacagagcauacuaauugagcacaaagggacaauaauuggaaagcagaaugauacuugcacagccaaggcaaguuguuggcuagagucagucaagaguuuuuuuuauggauugaagaauaugcuuggcaguguuuuugguaauuuuuuuguaggcauuuuguuauuccuugccccuuuugucuuguuggugcuuuucuuuauguuuggauggaaaaucuuguuuugcuuuaaguguugcaggaggaccagaggcuuguuuaaguauagacaccucaaagaugaugaggaaacaggcuacagaaggauuauugaaagacugaacagcaaaaaagggaaaaacagacugcuugauggugagagguuggcugauaggaaaauugcugagcuguucucuacgaaaacacacauuggc

SEQ ID NO: 4065 - RNA, 1932 nt, Artificial Sequence
  derived and/or modified CDS sequence (wt) from CCHFV(52-R-2014)__KR814862.1__Gc
uucuuagacaguauaguuaaaggcaugaagaauuugcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguagaugaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaacuugcuugcauaaagaauggccucacucaagaaacuggagauguaaucccacuuggugcuggggaguaggaacuggcugcaccugcugcgggguggauguaaaagaccuuuuuacagaucacauguuugucaaauggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcaugugcaaaaaguguugucugcaaguacaguguguaaacugcagaguugcacacaugguauaccaggagaucuacaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaauaucgaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcauaccaagaaaguugagauaucaggcuuaaaauuugcaagucuggcuugcacggguugcuaugcuuguagcucuggcaucuccuguaaagucaggauucauguagaugagccagaugagcucacaguacauguaaagagcaaugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaaugauacuugcacagccaaggcaggcuguuggcuagagucagucaagaguuuuuuuuauggauugaaaaauaugcuugguaguguauuugguaacuuuuucauaggcauuuugcuauuccuugccccuuuuguccuguuggugcuuuucuuuauguuuggauggaaaaucuuguuuugcuucaaauguugcaggaggaccagaggcuuacuuaaguauagacuccucaaagacgaugaggaaacaggcuacagaaggauuauugaaagacugaacaacaaaaaaggaaaaaacagacugcuugauggugaaagguuggcugauaggaaaauugcugaacuguucuccacaaaaacacacauuggu

SEQ ID NO: 4066 - RNA, 1932 nt, Artificial Sequence
  derived and/or modified CDS sequence (wt) from CCHFV(75-R-2012)__KR814863.1__Gc
uucuuagacaguauaguuaaaggcaugaagaauuugcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcagguccgaaucaauuaugaaacuggaggaaaggacaggagucagcugggaucuaggcguagaagaugccucugaguccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcuggggaguagguacuggcugcaccugcugcgggguggauguaaaagaccuuuuuacagaucacauguuugucaaauggaagguugaauauauaaaaacugaagccauaguauguguugagcucaccagucaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcaugugcaaaaaguguugucugcaaguacaguguguaaacugcagaguugcacacaugguauaccaggagaucuacaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacauugaaacugauuacacgaaaaccuuccacuuccacucuaaaagaguuacagcacauggugacacaccacaauuagacuuaaaagcaaggccgaccuacggugcaggugagaucaccgugcugguugagguugcugacauggaguugcauaccaagaaaguugagauaucaggcuuaaaauuugcaagucuggcuugcacggguugcuaugcuuguagcucuggcaucuccuguaaagucaggauucauguagaugagccagaugagcucacaguacauguaaagagcagugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaaugauacuugcacagccaaggcaagcuguuggcuagagucagucaagaguuuucuuuauggauugaaaaauaugcuugguaguguauuugguaacuuuuucauaggcauuuuguuauuccuugccccuuuuguccuguuggugcuuuucuuuauguuuggauggaaaaucuuguucugcuucaaauguugcaggaggaccagaggcuuacuuaaguauagacuccucaaagacgaugaggaaacaggcuacagaaggauuauugaaagacugaacaacaaaaaaggaaaaaacagacugcuugauggugaaagguuggcugauaggaaaauugcugagcuguucuccacaaaaacacacauuggu

SEQ ID NO: 4067 - RNA, 1932 nt, Artificial Sequence
  derived and/or modified CDS sequence (wt) from CCHFV(75-ST-2010)__KR814864.1__Gc
uucuuagacaguauaguuaaaggcaugaagaauuugcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguagaagaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcuggggaguaggaacuggcugcaccugcugcgggguggauguaaaagaccuuuuuacagaucacauguuugucaaguggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcauguacaaaaaguguugucugcaaguacaguguguaaacugcagaguugcacacaugguauaccaggagaucuacaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacauugaaacugauuacacgaaaaccuuccacuuccacucuaaaagaguuacagcacauggugacacaccacaauuagacuuaaaagcaaggccaaccuacggugcaggugagaucacugugcugguugagguugcugacauggaguugcauaccaagaaaguugagauaucaggccugaaauuugcaagucuggcuugcacggguugcuaugcuuguagcucuggcaucuccuguaaagucaggauucauguagaugagccagaugagcucacaguacauguaaagagcagugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaaugauacuugcacagccaaggcaagcuguuggcuagagucagucaagaguuuuuuuuauggauugaaaaauaugcuugguaguguauuuggcaacuuuuucauaggcauuuuguuauuccuugccccuuuuguccuguuggugcuuuucuuuauguuuggauggaaaaucuuguuuugcuucaaauguugcaggagggccagaggcuugcuuaaguauagacaccuaaaagacgaugaggaaacaggcuacagaaagauuauugaaaggcugaacaacaaaaaaggaaaaaacagacugcuugauggugaaagguuggcugauaggaaaauugcugagcuguucuccacaaaaacacacauuggu

SEQ ID NO: 4068 - RNA, 1932 nt, Artificial Sequence
  derived and/or modified CDS sequence (wt) from CCHFV(3756-ST-2007)__KR814866.1__Gc
uucuuagacaguauaguuaaagguaugaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggauuugucacaaauguauuccccuguuuucgaguacuuaucaggagauagacagguugaagaauggcccaaggcaaccugcacaggugauugcccagaaagguguggcugcacaucaucaaccugcuugcauaaagaauggccucauucaagaaacuggagauguaaucccacuuggugcuggggaguaggaaccggcugcacaugcugcggaguggauguaaaagaccuuuuuacagaccacauguuuaucaaauggaagguugaauauauaaaaaccgaagccauaguauguguugagcucaccagccaagaaagacaaugcagucugauugaggcagguacuagauucaacuuggguccugugacuaucacccugucugagccaagaaacauucagcagaagcuucccccugagaucauuacgcugcaucccaaaauugaagaaggcuucuuugacuugaugcaugugcaaaaaguguuaucugcaaguacaguguguaaacugcagaguugcacacauggcauaccaggagaucuacaaauuuaccacauuggcaacuuguugaaaggggauagaguaaacgggcaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaagaaaguugagauaucaggcuugaaauuugcaagucugacuuguacggguugcuaugcuuguagcucuggcaucuccuguaaagucagaauucauguagaugaaccagaugagcucacagugcauguaaagagcagugauccagaugugguugcagcuagcacaagccuuauggcaaggaagcuugaauuugggacagauagcacauucaaggcauuuucagcuaugcccaaaaccucuuuaugcuuuuacauuguggagagggaauacugcaagagcugcagugaagaugauacaaaaaaauguguugacacaaaacuugagcagccacagagcauacuaauugagcacaaagggacgauaauuggaaagcagaaugauacuugcacagccaaggcaaguuguuggcuagagucggucaagaguuuuuuuuauggauugaagaauaugcuuggcaguguuuuugguaguuuuuucguaggcauuuuguuauuccuuaccccuuuugucuuguuggugcuuuucuuuauguuuggauggaaaaucuuguuuugcuuuaaguguugcaggaggaccagaggcuuguuuaaguauagacaccucaaagaugacgaggaaacaggcuacagaaggauuauugaaagacugaacagcaaaaaaggaaaaaacagacugcuugauggugagagguuggcugauaggaaaauugcugagcuguucucuacaaaaacacacauuggc

SEQ ID NO: 4069 - RNA, 1932 nt, Artificial Sequence
  derived and/or modified CDS sequence (wt) from CCHFV(3809-ST-2007)__KR814867.1__Gc
uucuuagacaguauagucaaaggcaugaagaauuugcuaaacucaacaagcuuagaaacaagcuuaucaauugaagcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguggaagaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcuggggaguaggaacuggcuguaccugcugcgggguggauguaaaagaccuuuuuacagaucacauguuugucaaauggaagguugaauauauaaaaacugaagccauaguauguguugagcucaccagccaggaaagacagugcagucugauugaggcagguacuagauucaacuugggcccugugacuaucacccugucugagccaagaaacauucagcagaagcuucccccugagauuaucacguugcaucccaaaguugaagagggcuucuuugacuugaugcaugugcaaaaaguguugucugcaaguacaguguguaaacugcagaguugcacacaugguauaccaggagaucuucaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacauugaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcauaccaagaaaguugagauaucaggcuugaaauuugcaagucuggcuugcacggguugcuaugcuuguagcucuggcaucuccuguaaagucaggauucauguagaugagccagaugagcucacaguacauguaaagagcagugauccagaugugguugcagcuagcacaagucucauggcgaggaagcuugaauuugggacagacaguacauucaaggccuuuucagcuaugcccaaaaccucuuuauguuuuuacauuguggagaaagaauacugcaggagcugcagugaagaggacacacaaaaauguguugacacaaaacuugagcagccacagagcauacuaauugagcacaaaggaacgauaauuggaaagcagaaugauacuugcacagccaaagcaagcuguuggcuagagucagucaagaguuuuuuuuauggauugaagaauaugcuugguagugucuuugguaacuuuuucauaggcauuuuguuauuccuuaccccuuuuguccuguuggugcuuuucuuuauguuuggauggaaaaucuuguuuugcuucaaauguugcaggaggaccagaggcuuacuuaaguauagacaccucaaagacgaugaggaaacaggcuacagaaggauuauugaaagacugaacaacaaaaaagggaaaaacagacugcuugauggugaaagguuggcugauaggaaaauugcugagcuguuuuccacaaaaacacacauuggu

SEQ ID NO: 4070 - RNA, 1932 nt, Artificial Sequence
  derived and/or modified CDS sequence (wt) from CCHFV(3820-ST-2007)__KR814868.1__Gc
uucuuagacaguauaguuaaagguaugaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaccuaggcguagaagaugccucugaauccaaauuacuuaccgucucuaucauggauuugucacaaauguauuccccuguuuuugaguacuuaucaggagauagacagguugaagaauggcccaaggcaaccugcacaggugauugcccagaaagguguggcugcacaucaucaaccugcuugcauaaagaauggccucauucaagaaacuggagauguaaucccacuuggugcuggggaguaggaaccggcugcacaugcugcggaguggauguaaaagaccuuuuuacagaccacauguuuaucaaauggaagguugaauauauaaaaaccgaagccauaguauguguugagcucaccagccaagaaagacagugcagucugauugaggcagguacuagauucaacuuggguccugugacuaucacccugucugagccaagaaacauucagcagaagcuucccccugagaucauuacgcugcaucccaaaauugaagaaggcuucuuugacuugaugcaugugcaaaaaguguuaucugcaaguacaguguguaaacugcagaguugcacacaugguauaccaggagaucuacaaauuuaccacauuggcaacuuguugaaaggggauagaguaaacggccaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaaaaaaguugagauaucaggcuugaaauuugcaagucugacuuguacggguugcuaugcuuguagcucuggcaucuccuguaaagucagaauucauguagaugaaccagaugagcucacagugcauguaaagagcagugauccagaugugguugcagcuagcacaagccuuauggcaaggaagcuugaauuugggacagauagcacauucaaggcauuuucagcuaugcccaaaaccucuuuaugcuuuuacauuguggagagggaauacugcaagagcugcagugaagaugauacaaaaaaauguguugacacaaaacuugagcagccacagagcauacuaauugagcacaaagggacgauaauuggaaagcagaaugauacuugcacagccaaggcaaguuguuggcuagagucagucaagaguuuuuuuuauggauugaagaauaugcuuggcaguguuuuugguaguuuuuucguaggcauuuuguuauuccuugccccuuucgucuuguuggugcuuuucuuuauguuuggauggaaaaucuuguuuugcuuuaaguguugcaggaggaccagaggcuuguuuaaguauagacaccucaaagaugacgaggaaacaggcuacagaaggauuauugaaagacugaacagcaaaaaaggaaaaaacagacugcuugauggugagagguuggcugauaggaaaauugcugagcuguucucuacaaaaacacacauuggc

SEQ ID NO: 4071 - RNA, 1932 nt, Artificial Sequence
  derived and/or modified CDS sequence (wt) from CCHFV(4495-ST-2008)__KR814869.1__Gc
uucuuagacaguauaguuaaaggcaugaagaauuugcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggaaucagcugggaucuaggcguagaagaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcuggggaguaggaacuggcugcaccugcugcgggguggauguaaaagaccuuuuuacagaucacauguuugucaaguggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcauguacaaaaaguguugucugcaaguacaguguguaaacugcagaguugcacacaugguauaccaggagaucuacaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacauugaaacugauuacacgaaaaccuuccacuuccacucuaaaagaguuacagcacauggugacacaccacaauuagacuuaaaagcaaggccaaccuacggugcaggugagaucacugugcugguugagguugcugacauggaguugcauaccaagaaaguugagauaucaggccugaaauuugcaagucuggcuugcacggguugcuaugcuuguagcucuggcaucuccuguaaagucaggauucauguagaugagccagaugagcucacaguacauguaaagagcagugauccagaugugguugcagcuagcacaagucucauggcgaggaagcuugaauuugggacagacaguacauucaaggccuuuucagcuaugcccaaaaccucuuuauguuuuuacauuguggagagggaauacugcaagagcugcagugaagaggacacacaaagauguguugacacaaaacuugagcagccacagagcauacuaauugagcacaaaggaacgauaauuggaaagcagaaugauacuugcacagccaaggcaagcuguuggcuagagucagucaagaguuuuuuuuauggauugaaaaauaugcuugguaguguauuuggcaacuuuuucauaggcauuuuguuauuccuugccccuuuuguccuguuggugcuuuucuuuauguuuggauggaaaaucuuguuuugcuucaaauguugcaggagggccagaggcuugcuuaaguauagacaccuaaaagacgaugaggaaacaggcuacagaaagauuauugaaaggcugaacaacaaaaaaggaaaaaacagacugcuugauggugaaagguuggcugauaggaaaauugcugagcuguucuccacaaaaacacacauuggu

SEQ ID NO: 4072 - RNA, 1932 nt, Artificial Sequence
  derived and/or modified CDS sequence (wt) from CCHFV(4691-ST-2009)__KR814871.1__Gc
uucuuagacaguaucguuaaagguaugaaaaauuugcuaaacucaacaagcuuagaaacaagcuuaucaauugaggcaccauggggagcaauaaauguccagucaaccuuuaaaccagcaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggauuugucacaaauguauuccccuguuuuugaguacuuaucaggagauagacagguugaagaauggcccaaggcaaccugcacaggugauugcccagaaagguguggcugcacaucaucaaccugcuugcauaaagaauggccucacucaagaaacuggagauguaaucccacuuggugcuggggaguaggaaccggcugcacaugcugcggaguggauguaaaagaccuuuuuacagaucacauguuuaucaaauggaagguugaauauauaaaaaccgaagccauaguauguguugagcucaccagccaagaaagacagugcagucugauugaggcagguacuagauucaacuuggguccugugacuaucacccugucugagccaagaaacauucagcagaagcuucccccugagaucauuacgcugcaucccaaaauugaagaaggcuucuuugacuugaugcaugugcaaaaaguguuaucugcaaguacaguguguaaacugcagaguugcacacaugguauaccaggagaucuacaaauuuaccacauuggcaaccuguugaaaggggauagaguaaacgggcaucuaauucacaaaauugaaccacauuuuaacaccucuuggauguccugggaugguugugaccuagacuacuauugcaacaugggggauuggccuucuugcacauacacaggagugacccaacacaaucaugcugcauuuguaaacuugcuuaacauugaaacugauuacacgaaaaccuuccacuuccacucuaaaagagucacagcgcauggagacacaccacaauuggacuuaaaagcaaggccgaccuacggugcaggugagaucacugugcugguugagguugcugacauggaguugcauaccaagaaaguugagauaucaggcuugaaauuugcaagucuggcuugcacggguugcuaugcuuguagcucuggcaucuccuguaaagucagaauucauguagaugaaccagaugagcucacagugcauguaaagagcagugauccagaugugguugcagcuagcacaagccuuauggcaaggaagcuugaauuugggacagauagcacauucaaggcauuuucagcuaugcccaaaaccucuuuaugcuuuuacauuguggagagggaauacugcaagagcugcagugaagaugauacaaaaaaauguguugacacaaaacuugagcagccacagagcauacuaauugagcauaaagggacgauaauuggaaagcagaaugauacuugcacagccaaggcaaguuguuggcuagagucagucaagaguuuuuuuuauggauuaaagaauaugcuuggcaguguuuuugguaauuuuuucguaggcauuuuguuauuccuugccccuuuugucuuguuggugcucuucuuuauguuuggauggaaaaucuuguuuugcuuuaaguguugcaggaggaccagaggcuuguuuaaguauagacaccucaaagaugaugaggaaacaggcuacagaaggauuauugaaagacugaacagcaaaaaaggaaaaaacagacugcuugacggugagagguuggcugauaggaaaauugcugagcuguucucuacaaaaacacacauuggc

SEQ ID NO: 4073 - RNA, 1932 nt, Artificial Sequence
  derived and/or modified CDS sequence (wt) from CCHFV(4701-ST-2009)__KR814872.1__Gc
uucuuagacaguauaguuaaagguaugaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggauuugucacaaauguauuccccuguuuuugaguacuuaucaggagauagacagguugaagaauggcccaaggcaaccuguacaggugauugcccagaaagguguggcugcacaucaucaaccugcuugcauaaagaauggccucauucaagaaacuggagauguaaucccacuuggugcuggggaguaggaaccggcugcacaugcugcggaguggauguaaaagaccuuuuuacagaccacauguuuaucaaauggaagguugaauauauaaaaaccgaagccauaguauguguugagcucaccagccaagaaagacagugcagucugauugaggcagguacuagauucaacuuggguccugugacuaucacccugucugagccaagaaacauucagcagaagcuucccccugagaucauuacgcugcauccuaaaauugaagaaggcuucuuugacuugaugcaugugcaaaaaguguuaucugcaaguacaguguguaaacugcagaguugcacacaugguauaccaggagaucuacaaauuuaccacauuggcaacuuguugaaaggggauagaguaaacggccaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaauauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaaaaaaguugagauaucaggcuugaaauuugcaagucugacuuguacggguugcuaugcuuguagcucuggcaucuccuguaaagucagaauucauguagaugaaccagaugagcucacagugcauguaaagagcagugauccagaugugguugcagcuagcacaagccuuauggcaaggaagcuugaauuugggacagauagcacauucaaggcauuuucagcuaugcccaaaaccucuuuaugcuuuuacauuguggagagggaauacugcaagagcugcagugaagaugauacaaaaaaauguguugacacaaaacuugagcagccacagagcauacuaauugagcacaaagggacgauaauuggaaagcagaaugauacuugcacagccaaggcaaguuguuggcuagagucagucaagaguuuuuuuuauggauugaagaauaugcuuggcaguguuuuuggugguuuuuucguaggcauuuuguuauuccuugccccuuucgucuuguugguacuuuucuuuauguuuggauggaaaaucuuguuuugcuuuaaguguugcaggaggaccagaggcuuguuuaaguauagacaccucaaagaugacgaggaaacaggcuacagaaggauuauugaaagacugaacagcaaaaaaggaaaaaacagacugcuugauggugagagguuggcugauaggaaaauugcugagcuguucucuacaaaaacacacauuggc

SEQ ID NO: 4074 - RNA, 1932 nt, Artificial Sequence
  derived and/or modified CDS sequence (wt) from CCHFV(Oman-199809166)__KR864901.1__Gc
uuuuuagacaguauugcuaaggguaugaagaaccugcugaauucaacaagcuuagaaacaagcuuaucaauugaggcaccauggggagcaauaaacguccaaucuacuuucaaaccuacugugucaacugcaaacauagcacuuaguuggagcucaguggaacacagagguaauaagaucuugguuucaggcagaucagagucaaucaugaagcuagaagaaagaacaggaaucagcugggauuugggaguagaagaugccucugaguccaaauuacuuacuguuuccgucauggacuuaucacagauguacucuccugucuuugaguaccuaucaggugacagacaaguagaggaauggccaaaggcaaccuguacaggcgauugcccggaaagauguggcugcacaucaucaaccugccuacacaaggaauggccucacucaagaaacuggagaugcaaccccacuugguguuggggagucggcaccggaugcaccuguuguggacuagauguaaaggaccuuuuuacagauuacauguuuguuaaauggaaggucgaauauauaaaaacagaggcuauaguguguguugagcuuacuagccaagaaagacaauguagcuugauugaggcaggcacaagauucaacuuagguccugugacuaucacauuaucagagccaagaaacauucagcaaaagcucccuccagaaauugucacauuacauccuagaauugaagaagguuuuuuugacuuaaugcauguacagaagguacuaucagcaagcacagugugcaagcuacagaguugcacacauggcguaccaggagacuuacaggucuaccacaucggaaacuuacuaaaaggagacaaagugaaugggcaucugauacauaaaguugaaccacauuucaacaccuccuggaugucuugggacggcugugaccuagauuacuacugcaauaugggggauuggcccucuugcacguauacuggaguuacccaacauaaucaugcugcauuuguaaaccuacuuaacauugaaacugauuacacaaagaacuuccacuuucacucuaagagagucacugcacauggggacacuccacaauuagauuuaaaagccagaccaaauuauggugcaggugaaaucacugugcugguggaaguugcugacauggaguuacacacaaagaaaauugagauaucagguuugaaguuugcaagccuaaccugcacagguuguuaugcuuguagcucuggcaucucauguaagguuaggauccauguagaugaaccagaugagcuuacaguacaugugaagagugaagacccagacauaguugcugcuagcucaagucucauggcaagaaagcuugaauucgggacggauaguacauucaaagccuucucagccaugccuaaaaccuccuugugcuuuuacauuguugagagagaauacuguaaaagcugcaguaaagaagacacacaaaaguguguuaacgcaaagcuugagcgaccacagagcauuuuaauugagcacaaaggaacgauaauuggaaagcagaacgacacuugcacagcuaaagcaagcugcuggcuagagucagucaagaguuucuuuuauggacuaaagaacaugcuuaguggcauuuuuggcaauguuuucauagggauuuucuuauuccuugcuccuuuuauccuguuaauacuuuucuuuauguuuggguggagaauccuauucugcuuuaagugcugcaggagaacuagaggccuauuuaaguacagacaccucaaagaugaugaagaaaccgguuauaggaaaaucauugagagacuaaacaacaaaaaagguaaaaacaagcugcuugacggugaaagauuagcugauagaaagaucgcugagcuguucucuacaaaaacacacauuggc

SEQ ID NO: 4075 - RNA, 1932 nt, Artificial Sequence
  derived and/or modified CDS sequence (wt) from CCHFV(200406546-Turkey)__KR864902.1__Gc
uucuuagacaguauaguuaaaggcaugaaaaauuugcuaaacucaacaagcuuagaaacaaguuuaucaauugaggcaccauggggagcaauaaauguccagucaaccuuuaaaccaacaguaucgacugcaaauauagcacucaguuggagcucaauagagcacaggggcaacaagaucuuagucacaggcaggucugaaucaauuaugaagcuggaggaaaggacaggggucagcugggaucuaggcguagaagaugccucugaaucuaaauuacucacugucucuauuauggauuugucacaaauguacuccccuguuuuugaguacuugucaggagacagacagguugaggaauggcccaaagcaacgugcacaggugacugcccagaaaggugugguugcacaucaucaaccugcuugcauaaagaauggccucacucaagaaacuggagauguaaucccacuuggugcuggggaguaggaacuggcugcaccugcugcgggguggaugugaaagaccuuuuuacagaucacauguuugucaaauggaagguugaauauauaaaaacugaagccauaguauguguugagcucaccagccaagaaagacagugcagucugauugaggcagguacuagauucaacuugggcccugugacuauuacccugucugagccaagaaacauucagcagaagcuucccccugagauuaucacguugcaucccaaaguugaagaaggcuucuuugacuugaugcauguacaaaaaguguugucugcaaguacaguguguaaacugcaaagcugcacacaugguauaccaggagaucuacaaguuuaccacauuggcaacuugcugaaaggugauagaguaaacgggcaucuaauucacaaaauugaaccacauuucaacaccucuuggauguccugggaugguugugacuuagacuacuacugcaacaugggggauuggccuucuugcacauacacaggagugacccagcauaaccaugcugcauuuguaaacuugcuuaacauugaaacugauuacacgaaaaccuuccacuuccacucuaaaagagucacagcacauggugacacaccacaauuagacuuaaaagcaaggccgaccuacggugcaggugagaucacugugcugguugaaguugcugauauggagcugcauaccaagaaaguugagauaucaggcuugaaauuugcaagucuagcuugcacggguugcuaugcuuguagcucuggcaucuccuguaaagucaggauucauguagaugagccagaugagcucacaguacauguaaagagcagugauccugaugugguugcagcuagcacaagucucacggcgaggaagcuugaauuugggacagacagcacauucaaggccuuuucagcuaugcccaagaccucuuuauguuuuuacauuguggagaaagaauacugcaagagcugcaaugaagaugacacacaaaaauguguugacacaaagcuugagcagccacagagcauacuaauugagcacaaaggaacgauaauuggaaagcagaaugauacuugcacagccaaggcaagcuguuggcuggagucagucaagaguuuuuuuuauggauuaaagaauaugcuugguagugucuuugguaauuuuuucauaggcauuuuguuauuccuugccccuuuuguccuguuggugcuuuucuuuauguuuggauggaaaaucuuguuuugcuuuaaauguugcaggaggaccagaggcuuauuuaaguauagacaccucaaagacgaugaggaaacaggcuacaaaaggauuauugaaagauugaacaacaaaaaagggaaaaacagacugcuugauggugaaagguuggcugauaggaaaauugcugagcuguucuccacaaaaacacacauuggu

SEQ ID NO: 4076 - RNA, 1932 nt, Artificial Sequence
  derived and/or modified CDS sequence (wt) from CCHFV(1-CR/HU-2015)__KU161584.1__Gc
uuccuagacaguauaguuaaagguaugaaaaauuugcuaaacucgacaagcuuagaaacaagcuuaucaauugaggcaccauggggagcaauaaauguccagucaaccuuuaaaccaacaguaucaacugcaaacauagcacucaguuggagcucaguggagcacagaggcaacaagaucuuagucacaggcaggucugaaucaauuaugaaacuagaggaaaggacaggagucagcugggaucuaggcguagaagaugccucugaauccaaauuacuuaccgucucuauaauggauuuaucacaaauguauuccccuguuuuugaguacuugucaggagacagacagguugaagaguggcccaaagcaacuuguacaggugauugcccagaaagguguggcugcacaucaucaaccugcuugcauaaagaauggccucacucaagaaacuggagauguaaucccacuuggugcuggggaguaggaaccggcugcaccuguugcgggguggauguaaaagaccuuuuuacagaucacauguuugucaaauggaagguugaauauauaaaaacugaagccauaguauguguugagcucaccagccaggaaagacagugcagucuuauugaggcagguacaagauucaacuuaggcccugugacuaucacccugucugagccaagaaacauucagcagaagcuucccccugagaucauuacguugcaucccaaaauugaagaaggcuucuuugacuugaugcauguacaaaaaguguugucugcaaguacaguguguaaacugcagaguugcacacaugguauaccaggagaccuacaaguuuaccacauuggcaacuuguugaaaggggauagaguaaacgggcaucuaauucacaaaauugaaccacauuuuaacaccucuuggauguccugggaugguugugaucuagacuacuacugcaacaugggggacuggccuucuugcacauacacaggagugacccagcauaaucaugcugcauuuguaaacuugcuuaacauugaaacugauuacacgaaaaccuuccacuuccacucuaaaagagucacagcacauggugacacaccacaauuagacuuaaaagcaaggccgaccuacggugcaggugagaucacugugcugguugagguugcugacauggaguugcauaccaaaaaaguugagauaucaggcuugaaauuugcaagccuggcaugcacggguugcuaugcuuguagcucuggcaucuccuguaaagucagaauucauguagaugaaccagaugagcucacagugcauguaaagagcagugauccagacgugguugcagcuagcacaagucuuauggcaaggaagcuugaauuugggacagacagcacauucaaggccuuuucagcuaugccuaaaaccucuuuauguuuuuacauuguggagagagaauacugcaagagcugcagugaagaugauaccaaaaaauguguugacacaaaacuugagcagccacagagcauacuaauugagcacaaagggacgauaauuggaaagcagaaugauacuugcacagccaaggcaagcuguuggcuagagucagucaagaguuuuuuuuauggauugaagaauaugcucggcaguguuuuuggcaauuuuuuuauaggcauuuuguuauuccuugccccuuuuguccuguuggugcuuuucuuuauguuuggauggaaaaucuuguuuugcuuuaaauguugcaggaggaccagaggcuuguuuaaguauagacaccucaaagacgaugaggaaacaggcuacagaaggauuauugaaagacugaacaacaaaaaggggaaaaacagacugcuugauggugaaagguuggcugauaggaaaauugcugagcuguucuccacaaaaacacacauuggc

SEQ ID NO: 4077 - RNA, 1932 nt, Artificial Sequence
  derived and/or modified CDS sequence (wt) from CCHFV(Gaib)__KX013445.1__Gc
uucucagacagcauaguuaagggcaugaaaaaccugcugaacucaacaaguuuagagacaaguuuaucaauugaggcaccauggggagcgauaaauguccaaucaaccuuuaaaccuacuguaucaacugcaaauauagcacucaguuggagcucaauagagcacagaggcaacaagauucuggucucaggcagaucagagucaaucaugaagcuagaagagaggacaggaaucagcugggaccuaggcguggaagaugcuuccgagucuagguuacuuacuguuucuguuauggauuugucacaaauguacucucccguuuuugaauaccugucaggugacagacagguggaggaauggccuaaagcaaccugcacaggcgacuguccugaaagauguggaugcacaucgucaaccugcuuacacaaagaauggccucauucaagaaauuggagaugcaaucccacuuggugcuggggaguugguaccgggugcaccugcuguggacuagauguaaaagaccuuuuuacagacuauauguuugucaaauggaaagucgaguacauaaagacagaggcuauaguguguguugaacuuacaagccaagaaaggcaaugcaguuugauugaggcaggcacaagauucaacuuagguccagugaccaucacauugucagaaccgagaaacauucagcaaaagcuuccuccugaaauaaucacauugcacccuagaauugaagaaggcuucuuugaccuaaugcacgugcagaaagugcugucugcuaguacgguguguaaacuacagaguugcacacacggugugccgggggaucuacaggucuaccacauuggcaauuuguuaaaaggggauaaggugaacggacaucugauucacaagauugaaccacacuucaacacuucuuggauguccugggaugguugugaccuggacuacuacugcaauaugggggauuggccuuccugcacguauacuggaguaacccaacauaaccacgccgcauuugugaaccugcucaacauugaaacugauuauaccaaaaacuuccacuuccacucuaagagaguuacugcacauggagacacaccgcaauuggauuugaaggcuagaccaaccuauggugcaggcgagaucacugugcugguagaaguugcugacauggagcuacacacaaaaaagauugagauaucaggccugaaauuugcgagucuaacuugcacagguugcuaugcuugcagcucuggcaucuccuguaaaguuaggauccauguagaugaaccagaugagcuuacagugcaugugaaaagugaagauccagacauaguugcagcuagcucaagucucauggcaaggaagcuugaauuugguacagacaguaccuuuaaagccuuuucagcuaugcccaaaaccucuuuaugcuuuuacauuguagagagagaauauugcaagagcugcaguagagaagacacacaaaaaugugucagcacaaaacuugagcaaccacagagcauuuuaauugaacacaaaggaacgauaaucggaaaacagaauaacaccugcacaacuaaaacaaccuguugguuggaaucaguaaagaguuucuuuuauggacuaaagaacaugcuuagcaguauuuuuggcaauguuuucgugggcauuuucucauuccuugccccuuucaucuuacugauacuuuucuucauguuuggguggagaauccuauuuugcuuuaaguguugcagaaggacuagaggcuuauuuaaguacagacaucucaaagacgaugaagagaccgguuauaggaggaucauugaaagauuaaacaacaaaaaaggaaagagcaaguugcuugauggugaaagguuggcugauaggaagauugcugagcuguucuccacaaaaacacacauugga

SEQ ID NO: 4078 - RNA, 1932 nt, Artificial Sequence
  derived and/or modified CDS sequence (wt) from CCHFV(Hodzha)__KX013448.1__Gc
uuccuggauaguauaguuaaaggcaagaaaaaucuguuaaacuccacaaguuuagaaacaagcuugucgauugaggcaccauggggggcaauaaauguucagucaaccuacaaaccaacuguaucaacugcaaacauagcacuuaguuggaguucaguugaacacagagguaauaagauuuugguuucaggcagaucagaaucaauuaugaagcuggaagaaagaacaggaaucagcugggaucuuggcguugaagaugccucugaaucuaagcuacuuacugucucugucauggacuugucucagauguacuccccugucuucgaguacuuaucgggugacagacaaguagaagaguggcccaaggcaaccugcacaggugacugcucagaaagauguggcugcacaucaucaaccugcuuacauaaagaauggccccauucacgaaacuggagaugcaaucccacuuggugcugggggguggggacuggcugcaccuguuguggauuagaugugaaagaccuauuuacagauuauauguucgucaaguggaaaguugauuacauuaaaacagaggccauaguguguguagaacucaccagucaggaaaggcaguguagcuugguugaggcgggcacaagguucaauuuagguccuguaaccaucacauugucagaaccgaggaacauacaacaaaagcucccuccugaaauaaucacauugcauccuaggauugaagaagguuuuuuugaccugaugcauguacaaaaagugcugucagcaagcacaguguguaaauugcagaguugcacacauggugugccaggagaucuacaggucuaccacaucggaaauuuauuaaaaggagauaaagugaacggacaccuaauucauaaaauugagccgcacuucaauacuuccuggauguccugggauggcugugaccuagacuacuacugcaacaugggagacuggccuucuugcacauauaccggaguuacucaacacaaucaugcuucauuuguaaaccugcucaacauugaaacugacuauacaaaaagcuuccacuuucacucuaaaaggguuacugcacauggagacacaccacaauuggaucugaaggcaagaccaaccuacggcgcaggagaaaucacuguacugguagaaguugcugauauggaguuacacacaaagaagaucgaaauaacaggccucaaauuugcaagccugacuugcacagguuguuaugcuuguaguucaggcaucuccugcaaaguuaggauucacguggaugaaccagaugagcuaacaguacauguuaaaagugaugauccagauguaguugcagccagcucaagucucauggcaaggaaacuugaguuuggaacagacaguacauucaaagcuuucucagccaugccuaaaacuuccuuaugcuucuacauugucgaaagggaguacuguaagagcugcaguaaagaagacacacagaaauguguuaacacaaaacuugagcaaccacagagcauuuugaucgaacaaaagggaacuauaaucggaaagcaaaacaauacuugcacagccaaggcaaguugcugguuagagucaguuaaaaguuucuuuuauggucuaaagaacaugcuuaguggcauuuuuggcaauguuuuuguaggcauuuucuuauuucuugcccccuuuaucuuguuaauacuuuucuucauguuuggauggaggauccuguuuugcuucaaguguugcagaagaaccaggggccuguuuaaguauaaacaucucaaagacgaugaagaaacugguuacagaaggaucauugaaagacugaacaacaagaaggggaaaaacaagcugcuugacggugaaagacuugccgauagaaggauugccgaacuauucuccacaaaaacacacauuggc

SEQ ID NO: 4079 - RNA, 1932 nt, Artificial Sequence
  derived and/or modified CDS sequence (wt) from CCHFV(IbAn7620)__KX013451.1__Gc
uuccuagauaguauagcuaaaggcaugaaaaauccgcuaaauucaacaaguuuagaaacgaguuuaucaauugaggcaccauggggagcaauagauguucagucaaccuacaaaccaacugugucaacugcaaacauagcacucaguuggagcucaguggaacacagagguaauaagaucuugguuucaggcagaucagaaucaauuaugaagcuagaagaaaggacgggaaucagcugggaucucggcguagaagaugccucugagucuaaacugcuuacagucucugucauggaccugucucagauguacucuccugucuucgaguacuuaucaggggacagacagguggaagaguggcccaaagcaacuuguacaggugauugcccagaaagaugugguugcacaucaucaaccuguuugcacaaagaauggccucacucaagaaauuggagaugcaaucccacuuggugcuggggaguagggacuggcugcaccuguuguggauuagaugugaaagaccuuuuuacagauuauauguuugucaaguggaaaguugaauacaucaagacagaggccauaguguguguagaacuuaccagucaggaaaggcaguguagcuugauugaagcgggcacgagguucaauuuagguccugugaccaucacacugucagaaccaagaaacauccaacaaaaacucccuccugaaauaaucacacugcauccuaggaucgaagaagguuuuuuugaucugaugcaugugcaaaagguguuaucggcaagcacaguguguaaguugcagaguugcacacauggugugccaggagaccuacaggucuaccacaucggaaauuuauuaaaaggggauaagguaaauggacaucuaauucauaaaauugagccacacuucaacacuuccuggauguccugggaugguugugaccuagacuacuacugcaacaugggagauuggccuucuugcacauacacaggggucacccaacacaaucaugcuucauuuguaaacuuacucaacauugaaacugauuacacaaagaacuuccacuuucacucuaaaagggucacugcacacggagacacaccacaacuagaucuuaaggcaagaccaaccuauggugcaggcgagaucacuguucugguagaaguugcuaacauggaguuacauacaaagaagauugaaauaucaggcuuaaaauuugcaagcuugacuuguacagguuguuaugcuuguagcucuggcaucucaugcaaaguuagaauucauguggaugaaccagaugaacuuacaguacauguuaaaagugaugauccagaugugguugcagcuagcucaagucucauggcaagaaagcuugaauuuggaacagacaguacauuuaaagcuuucucggccaugcccaaaacuucucuauguuucuacauuguugaaagagaacacuguaagagcugcagugaagaagauacaaaaaaauguguuaacacaaagcuugagcaaccacaaagcauuuugaucgaacacaagggaacuauaauaggaaagcaaaacagcacuugcacggcuaaggcgaguugcugguuggagucagucaagaguuuuuuuuauggccuaaagaacaugcuuaguggcauuuuuggcaaugucuuuaugggcauuuucuuguuccuugcccccuucauccuguuaauacuauucuuuauguuuggguggaggauccuauucugcuuuaaauguuguagaagaaccagaggccuguucaaguacagacaccucaaagacgaugaagaaacugguuauagaaggauuauugaaagacuaaacaauaaaaaaggaaaaaacaagcugcuugauggugaaagacuugcugauagaagaauugccgaacuguucucuacaaaaacacacauuggc

SEQ ID NO: 4080 - RNA, 1932 nt, Artificial Sequence
  derived and/or modified CDS sequence (wt) from CCHFV(K128_76)__KX013454.1__Gc
uuucaggacaguauagucaaaggcaugaaaaaccugcuaaacucaacaaguuuagaaacaagcuugucgauugaggcaccauggggggcaauaaauguucagucaaccuacaaaccagcugugucagcugcaaacauagcacuuaguuggaguucaguugaacacagagguaguaagauuuugguuucaggcagaucagaaucaauuaugaagcuggaagaaaggacaggaaucagcugggaucuuggcguagaagaugccucugaaucuaagcuacuuacagucucugucauggacuugucucagauguacuccccugucuucgaguacuugucaggugacagacaaguagaagaguggcccaaggcaaccuguacaggugacugcccagagagaugugguuguacaucaucaaccuguuugcauaaagaauggccccauucaagaaacuggagguguaaucccacuuggugcugggggguagggacuggcugcaccuguugugguuuagaugugaaagaccuuuuuacagacuauauguucgucaaguggaaaguugaauauauuaagacagaggccauaguguguguagaacuuaccagucaggaaaggcaguguaguuuaauugaggcagguacaagguucaauuuagguccugugaccaucacauugucagaaccgaggaacauccaacaaaagcucccuccugaaauaaucacacugcauccuaggauugaagaagguuuuuuugaccugaugcaugugcaaaaggugcugucagcaagcacaguguguaaguugcagaguugcacacauggugugccaggagaucuacaagucuaccacaucgggaauuuacuaaaaggagauagaguuaacggacaccuaauucauaaaauugagccacacuuuaacacuucuuggauguccugggauggcugugaccuagacuauuacugcaacaugggagacuggccuucuugcacauauaccggaguuacccagcacaaucaugcuucauuugugaaccugcucaacauugaaacugacuauacaaaaagcuuccauuuucacucuaaaaggguuacugcacauggagacacaccacaauuagaucugaaggcaaggccaaacuauggcgcaggagagaucaccguacugguagagguugccgauauggaguuacacacaaagaagauugaaauaucaggccuaaaguuugcaagcuugacuuguacagguuguuaugcuuguaguuccgguaucuccuguaaaguuaggauucauguggaugaaccagaugaacuuacaguacauguuaaaagugaugauccagauguaguugcagcuagcucaagucucauggcaaggaagcuugaauuuggaacagacaguacauuuaaggcuuucucagccaugcccaaaaccuccuuauguuucuacauugucgaaagggaguacugcaagagcugcaguaaagaagacacacaaaaauguguuaacacaaaacuugagcagccacagagcauuuuaaucgaacauaagggaacuauaaucggaaagcaaaacaauaccugcacagcaaagacaaguugcugguuagagucaguuaaaaguuucuuuuaugguuuaaagaacaugcuuaguggcauuuuuggcaauguuuuuguggguauuuucuuauuucuugcccccuucaucuugcuaauacuuuucuuuauguuuggguggaggauccuguuuugcuucaagugcuguagaagaaccagaggccuguucagauauaagcaucucgaaaacgaugaagaaacugguuacagaagaaucauugaaagacugaacaacaaaaaaggaaaaaacaagcugcuugauggugaaagacuugcugauagaagaaucgccgaacuauucuccacaaaaacacacauuggc

SEQ ID NO: 4081 - RNA, 1932 nt, Artificial Sequence
  derived and/or modified CDS sequence (wt) from CCHFV(K168_40)__KX013457.1__Gc
uuucuggacgguauagucaaaggcaugaaaaaccugcuaaacucaacaaguuuggaaacaagcuugucgauugaggcaccauggggggcaauaaauguucagucaaccuacaaaccaacuguaucagcugcaaacauagcacuuaguuggaguucaguugaacacagagguaauaagauuuugguuucaggcagaucagaaucaauuaugaagcuggaagaaaggacaggaaucagcugggaucuuggcguagaagaugccucugaaucuaagcuacucacagucucugucauggacuugucucagauguacucuccugucuucgaguacuugucaggugacagacaaguagaagaguggcccaaggcaaccuguacaggugacugcccagagagauguggcuguacaucaucaaccuguuugcauaaagaauggccccauucaagaaacuggagguguaaucccacuuggugcugggggguagggacuggcugcaccuguugugguuuagaugugaaagaccuuuuuacagacuauauguuugucaaguggaaagucgaauacauuaagacagaggccauaguguguguagaacuuaccagucaggaaaggcaguguagcuuaauugaggcggguacaagguucaauuuaggucccgugaccaucacauugucagaaccgaggaacauccaacaaaaacucccuccugaaauaaucacacugcauccuaggauugaagaagguuuuuuugaccugaugcauguacaaaaggugcugucagcaagcacaguguguaaguugcagaguugcacacauggugugccaggagaucuacaggucuaccacaucggaaauuuacuaaaaggagauaaaguuaacggacaccuaauucauaaaauugaaccacacuucaacacuucuuggaugucuugggauggcugugaccuagacuacuacugcaacaugggagauuggccuucuugcacauauaccgggguuacccagcacaaucaugcuucauuuauaaaccugcucaacauugaaacugacuauacaaaaagcuuccauuuucacucuaaaaggguuacugcacauggagacacaccacaauuagaucugaaggcaaggccaaacuauggcgcaggagagaucaccguacugguagagguugccgauauggaguuacacacaaagaagauugaaauaucaggacuaaaguuugcaagcuugacuuguacagguuguuaugcuuguaguuccgguaucuccuguaaaguuaggauucauguggaugaaccagaugaacuuacaguacauguuaaaagugaugauccagauguaguugcugcuagcucaagucucauggcaaggaagcuugaauuuggaacagacaguacauuuaaggcuuucucagccaugccaaaaaccuccuuauguuucuauauugucgaaagggaauacugcaagagcugcaguaaagaagacacacaaaaauguguuaacacgaagcuugagcauccacagagcauuuugaucgaacauaagggaacuauaaucggaaagcagaacaauaccugcacagcaaagacaaguugcugguuagagucaguuaagaguuucuuuuaugguuuaaagaacaugcuuaguggcauuuucggcaacguuuuuguaggcauuuucuuauuucuugcccccuucaucuugcuaauacuuuucuuuauguuuggguggaggauccuauuuugcuucaagugcuguagaagaaccagaggccuguuuagauauaaacaucucgaagacgaugaagaaacugguuacagaagaaucauugaaagacugaacaacaaaaaaggaaaaaacaagcugcuugauggugaaagacuugcugauagaagaauugccgaacuauucuccacaaaaacacacauuggc

SEQ ID NO: 4082 - RNA, 1932 nt, Artificial Sequence
  derived and/or modified CDS sequence (wt) from CCHFV(K168_125)__KX013460.1__Gc
uuucuggacaguauagucaaaggcaagaaaaaccugcuaaacucaacaaguuuggaaacaagcuugucgauugaggcaccauggggggcaauaaauguucagucaaccuacaaaccaacuguaucagcugcaaacauagcacuuaguuggaguucaguugaacacagagguaauaagauuuugguuucaggcagaucagaaucaauuaugaagcuggaagaaaggacaggaaucagcugggaucuuggcguagaagaugccucugaaucuaagcuacucacagucucugucauggacuugucucagauguacucuccugucuucgaguacuugucaggugacagacaaguagaagaguggcccaaggcaaccuguacaggugacugcccagagagauguggcuguacaucaucaaccuguuugcauaaagaauggccccauucaagaaacuggagguguaaucccacuuggugcugggggguagggacuggcugcaccuguugugguuuagaugugaaagaccuuuuuacagacuauauguuugucaaguggaaagucgaauacauuaagacagaggccauaguguguguagaacuuaccagucaggaaaggcaguguagcuuaauugaggcggguacaagguucaauuuaggucccgugaccaucacauugucagaaccgaggaacauccaacaaaaacucccuccugaaauaaucacacugcauccuaggauugaagaagguuuuuuugaccugaugcauguacaaaaggugcugucagcaagcacaguguguaaguugcagaguugcacacauggugugccaggagaucuacaggucuaccacaucggaaauuuacuaaaaggagauaaaguuaacggacaccuaauucauaaaauugaaccacacuucaacacuucuuggaugucuugggauggcugugaccuagacuacuacugcaacaugggagauuggccuucuugcacauauaccgggguuacccagcacaaucaugcuucauuuauaaaccugcucaacauugaaacugacuauacaaaaagcuuccauuuucacucuaaaaggguuacugcacauggagacacaccacaauuagaucugaaggcaaggccaaacuauggcgcaggagagaucaccguacugguagagguugccgauauggaguuacacacaaagaagauugaaauaucaggccuaaaguuugcaagcuugacuuguacagguuguuaugcuuguaguuccgguaucuccuguaaaguuaggauucauguggaugaaccagaugaacuuacaguacauguuaaaagugaugauccagauguaguugcugcuagcucaagucucauggcaaggaagcuugaauuuggaacagacaguacauuuaaggcuuucucagccaugccaaaaaccuccuuauguuucuauauugucgaaagggaauacugcaagagcugcaguaaagaagacacacaaaaauguguuaacacgaagcuugagcauccacagagcauuuugaucgaacauaagggaacuauaaucggaaagcagaacaauaccugcacagcaaagacaaguugcugguuagagucaguuaagaguuucuuuuaugguuuaaagaacaugcuuaguggcauuuucggcaacguuuuuguaggcauuuucuuauuucuugcccccuucaucuugcuaauacuuuucuuuauguuuggguggaggauccuauuuugcuucaagugcuguagaagaaccagaggccuguuuagauauaaacaucucgaagacgaugaagaaacugguuacagaagaaucauugaaagacugaacaacaaaaaaggaaaaaacaagcugcuugauggugaaagacuugcugauagaagaauugccgaacuauucuccacaaaaacacacauuggc

SEQ ID NO: 4083 - RNA, 1932 nt, Artificial Sequence
  derived and/or modified CDS sequence (wt) from CCHFV(K229_194)__KX013463.1__Gc
uuuuuagacaguauaguuaaagguaagaaaaaucugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggaccugucacaaauguauuccccuguuuuugaguacuuaucaggagauagacagguugaagaauggcccaaggcaaccugcacaggugauugcccagaaagguguggcugcacaucaucaaccugcuugcauaaagaauggccucacucaagaaacuggagauguaaucccacuuggugcuggggaguaggaaccggcugcacaugcugcggaguggauguaaaagaccuuuuuacagaucacauguuuaucaaauggaagguugaauauauaaaaaccgaagccauaguauguguugagcucaccagccaagaaagacagugcagucugauugaggcagguacuagauucaacuuggguccugugacuaucacccugucugagccaagaaacauucagcagaagcuucccccugagaucauuacgcugcauccuaaaauugaagaaggcuucuuugacuugaugcaugugcaaaaaguguuaucugcaaguacaguguguaaacugcagaguugcacacaugguauaccaggagaucuacaaauuuaccacauuggcaaccuguugaaaggggauagauuaaacgggcaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaagaaaguugagauaucaggcuugaaauuugcaagucuggcuugcacggguugcuauucuuguagcucuggcaucuccuguaaagucagaauucauguagaugaaccggaugagcucacagugcauguaaagagcagugauccagaugugguugcagcuagcacaagccuuauggcaaggaagcuugaauuugggacagauagcacauucaaggcauuuucagcuaugcccaaaaccucuuuauguuuuuacauuguggagagggaauacugcaagagcugcagugaagaugauacaaaaaaauguguugacacaaaacuugagcagccacagagcauacuaauugagcacaaagggacgauaauuggaaagcaaaaugacacuugcacagccaaggcaaguuguuggcuagagucagucaagaguuuuuuuuauggauugaagaauaugcuuggcaguguuuuugguaauuuuuucguaggcauuuuguuauuccuugcccccuuugucuuguuggugcuuuucuuuauguuuggauggaaaaucuuguuuugcuuuaaguguugcaggaggaccagaggcuuguuuaaguauagacaccucaaagaugaugaggaaacaggcuacagaaagauuauugaaagacugaacagcaaaaaaggaaaaaacagacugcuugauggugagagguuggcugauaggaaaauugcugagcuguucucuacaaaaacacacauuggc

SEQ ID NO: 4084 - RNA, 1932 nt, Artificial Sequence
  derived and/or modified CDS sequence (wt) from CCHFV(K229_243)__KX013466.1__Gc
uucuuagacaguauaguuaaaggcaugaagaauuugcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguggaagaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcuggggaguaggaacuggcuguaccugcugcgggguggauguaaaagaccuuuuuacagaucacauguuugucaaauggaagguugaauauauaaaaacugaagccauaguauguguugagcucaccagccaggaaagacagugcagucugauugaggcagguacuagauucaacuugggcccugugacuaucacccugucugagccaagaaacauucagcagaagcuucccccugagauuaucacguugcaucccaaaguugaagagggcuucuuugacuugaugcaugugcaaaaaguguugucugcaaguacaguguguaaacugcagaguugcacacaugguauaccaggagaucuucaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacauugaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcauaccaagaaaguugagauaucaggcuugaaauuugcaagucuggcuugcacggguugcuaugcuuguagcucuggcaucuccuguaaagucaggauucauguagaugagccagaugagcucacaguacauguaaagagcagugauccagaugugguugcagcuagcacaagucucauggcgaggaagcuugaauuugggacagacaguacauucaaggccuuuucagcuaugcccaaaaccucuuuauguuuuuacauuguggagaaagaauacugcaagagcugcagugaagaggacacacaaaaauguguugacacaaaacuugagcagccacagagcauacuaauugagcacaaaggaacgauaauuggaaagcagaaugauacuugcacagccaaagcaagcuguuggcuagagucagucaagaguuuuuuuuauggauugaagaauaugcuugguagugucuuugguaacuuuuucauaggcauuuuguuauuccuuaccccuuuuguccuguuggugcuuuucuuuauguuuggauggaaaaucuuguuuugcuucaaauguugcaggaggaccagaggcuuacuuaaguauagacaccucaaagacgaugaggaaacaggcuacagaaggauuauugaaagacugaacaacaaaaaagggaaaaacagacugcuugauggugaaagguuggcugauaggaaaauugcugagcuguucuccacaaaaacacacauuggu

SEQ ID NO: 4085 - RNA, 1932 nt, Artificial Sequence
  derived and/or modified CDS sequence (wt) from CCHFV(K315_14)__KX013469.1__Gc
uucuuagacaguauaguuaaagguaugaaaaaauugcuaaacucaacaagcuuagaaacaagcuuaucaauugaggcaccauggggagcaauaaauguccagucaaccuuuaaaccaacaguaucuacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggacuugucacaaauguauuccccuguuuuugaguacuuaucaggagauagacagguugaagaauggcccaaggcaaccugcacaggugauugcccagaaagguguggcugcacaucaucaaccugcuugcauaaagaauggccucauucaagaaacuggagauguaaucccacuuggugcuggggaguaggaaccggcugcacaugcugcggaguggauguaaaagaccuuuuuacagaccacauguuuaucaaauggaagguugaauauauaaaaaccgaagccauaguauguguugagcucaccagccaagaaagacagugcagucugauugaggcagguacuagauucaacuuggguccugugacuaucacccugucugagccaagaaacauucagcagaagcuucccccugagaucauuacgcugcaucccaaaauugaagaaggcuucuuugacuugaugcaugugcaaaaaguguuaucugcaaguacaguguguaaacugcagaguugcacacaugguauaccaggagaucuacaaauuuaccacaucgguaacuuguugaaaggggauagaguaaacgggcaucugauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaagaaaguugagauaucaggcuugaaauuugcaagucugacuuguacggguugcuaugccuguagcucuggcaucuccuguaaagucagaauucauguagaugaaccagaugagcucacagugcauguaaagagcagugauccagaugugguugcagcuagcacaagccuuauggcaaggaagcuugaauuugggacagauagcacauucaaggcauuuucagccaugcccaaaaccucuuuaugcuuuuacauuguagagagggaauacugcaagagcugcagugaagaugauacaaaaaaauguguugacacaaaacuugagcagccacagagcauacuaauugagcacaaggggacaauaauuggaaagcagaaugauacuugcacagccaaggcaaguuguuggcuagagucagucaagaguuuuuuuuauggacugaagaauaugcuuggcaguguuuuugguaguuuuuucguaggcauuuuguuauuccuugccccuuuugucuuguuggugcuuuucuuuauguuuggauggaaaaucuuguuuugcuuuaaguguugcaggaggaccagaggcuuguuuaaguauagacaccucaaagaugacgaggaaacaggcuacagaaggauuauugaaagacugaacagcaaaaaagggaaaaacagacugcuugauggugagagguuggcugauaggaaaauugcugagcuguucucuacaaaaacacacauuggc

SEQ ID NO: 4086 - RNA, 1932 nt, Artificial Sequence
  derived and/or modified CDS sequence (wt) from CCHFV(K323_27)__KX013472.1__Gc
uucuuagacaguauagccaaagguaugaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggauuugucacaaauguauuccccuguuuuugaguacuuaucaggagauagacagguugaagaauggcccaaggcaaccugcacaggugauugcccagaaagguguggcugcacaucaucaaccugcuugcauaaagaauggccucauucaagaaacuggagauguaaucccacuuggugcuggggaguaggaaccggcugcacaugcugcggaguggauguaaaagaccuuuuuacagaccacauguuuaucaaauggaagguugaauacauaaaaaccgaagccauaguauguguugagcucaccggccaagaaagacagugcagucugauugaggcagguacuagauucaacuuggguccugugacuaucacccugucugagccaagaaacauucagcagaagcuucccccugagaucauuacgcugcaucccaaaauugaagaaggcuucuuugacuugaugcaugugcaaaaaguguuaucugcaaguacaguguguaaacugcagaguugcacacaugguauaccaggagaucuacaaauuuaccacauuggcaacuuguugaaaggggauagaguaaacgggcaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaagaaaguugagauaucaggcuugaaauuugcaagucugacuuguacggguugcuaugcuuguagcucuggcaucuccuguaaagucagaauucauguagaugaaccagaugagcucacagugcauguaaagagcagugauccagauguuguugcagcuagcacaagccuuauggcaaggaagcuugaauuugggacagauagcacauucaaggcauuuucagcuaugcccaaaaccucuuuaugcuuuuacauuguggagagggaauacugcaagagcugcagugaagaugauacaaaaaaauguguugacacaaaacuugagcagccacagagcauacuaauugagcacaaagggacgauaauuggaaagcagaaugauacuugcacagccaaggcaaguuguuggcuggagucagucaagaguuuuuuuuauggauugaagaauaugcuuggcaguguuuuugguaguuuuuucguaggcauuuuguuauuccuugccccuuuugucuuguuggugcuuuucuuuauguuuggauggaaaaucuuguuuugcuuuaaguguugcaggaggaccagaggcuuguuuaaguauagacaccucaaugaugacgaggaaacaggcuacagaaggaucauugaaagacugaacagcaaaaaaggaaaaaacagacugcuugauggugagagguuggcugauaggaaaauugcugagcuguucucuacaaaaacacacauuggc

SEQ ID NO: 4087 - RNA, 1932 nt, Artificial Sequence
  derived and/or modified CDS sequence (wt) from CCHFV(K340_6)__KX013475.1__Gc
uccuuagacaguauaguuaaagguaugaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggauuugucacaaauguauuccccuguuuuugaguacuuaucaggagauagacagguugaagaauggcccaaggcaaccugcacaggugauugcccagaaagguguggcugcacaucaucaaccugcuugcauaaagaauggccucauucaagaaacuggagauguaaucccacuuggugcuggggaguaggaaccggcugcacaugcugcggaguggauguaaaagaccuuuuuacagaccacauguuuaucaaauggaagguugaauauauaaaaaccgaagccauaguauguguugagcucaccagccaagaaagacagugcagucugauugaggcagguacuagauucaacuuggguccugugacuaucacccugucugagccaagaaacauucagcagaagcuucccccugagaucauuacgcugcaucccaaaauugaagaaggcuucuuugacuugaugcaugugcaaaaaguguuaucugcaaguacaguguguaaacugcagaguugcacacaugguauaccaggagaucuacaaauuuaccacauuggcaacuuguugaaaggggauagaguaaacggccaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccacucuaaaagagucacagcacauggagacacaccacaauuagacuuaaaagcaaggccgaccuacggugcaggugagaucacugugcugguugagguuacugacauggaguugcauaccaaaaaaguugagauaucaggcuugaaauuugcaagucugacuuguacggguugcuaugcuuguagcucuggcaucuccuguaaagucagaauucauguagaugaaccagaugagcucacagugcauguaaagagcagugauccagaugugguugcagcuagcacaagccuuauggcaaggaagcuugaauuugggacagauagcacauucaaggcauuuucagcuaugcccaaaaccucuuuaugcuuuuacauuguggagagggaauacugcaagagcugcagugaagaugauacaaaaaaauguguugacacaaaacuugagcagccacagagcauacuaauugagcacaaagggacgauaauuggaaagcagaaugauacuugcacagccaaggcaaguuguuggcuagagucagucaagaguuuuuuuuauggauugaagaauaugcuuggcaguguuuuugguaguuuuuucguaggcauuuuguuauuccuugccccuuucgucuuguuggugcuuuucuuuauguuuggauggaaaaucuuguuuugcuuuaaguguugcaggaggaccagaggcuuguuuaaguauagacacuucaaagaugacgaggaaacaggcuacagaaggauuauugaaagacugaacagcaaaaaaggaaaaaacagacugcuugauggugagagguuggcugauaggaaaauugcugagcuguucucuacaaaaacacacauuggc

SEQ ID NO: 4088 - RNA, 1932 nt, Artificial Sequence
  derived and/or modified CDS sequence (wt) from CCHFV(Mamon)__KX013478.1__Gc
uucuuagacaguauaguuaaaggcaugaagaauuugcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguagaagaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcuggggaguaggaacuggcugcaccugcugcgggguggauguaaaagaccuuuuuacagaucacauguuugucaaauggaagguugaauauauaaaaacugaagccauaguguguguugagcucaccagccaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcaugugcaaaaaguguugucugcaaguacaguguguaaacugcagaguugcacacaugguauaccaggagaucuacaaguuuaccacauuggcaacuugcugaaaggugauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacauugaaacugauuacacgaaaaccuuccacuuccacucuaaaagaguuacagcacauggugacacaccacaauuagacuuaaaagcaaggccgaccuacggugcaggugagaucacugugcucguugagguugcugacauggaguugcauaccaagaaaguugagauaucaggcuuaaaauuugcaagucuggcuugcacggguugcuaugcuuguagcucuggcaucuccuguaaagucaggauucauguagaugagccagaugagcucacaguacauguaaagagcagugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaaugauacuugcacagccaagacaagcuguuggcuagagucagucaagaguuuuuuuuauggauugaaaaauaugcuugguaguguauuugguaacuuuuucauaggcauuuuguuauuccuugccccuuuuguccuguuggugcuuuucuuuauguuuggauggaaaaucuuguuuugcuucaaauguugcaggaggaccagaggcuuacuuaaguauagacaccucaaagacgaugaggaaacaggcuacagaaggauuauugaaagacugaacaacaaaaaaggaaaaaacagacugcuugauggugaaagguuggcugauaggaaaauugcugagcuguucuccacaaaaacacacauuggu

SEQ ID NO: 4089 - RNA, 1932 nt, Artificial Sequence
  derived and/or modified CDS sequence (wt) from CCHFV(Min)__KX013481.1__Gc
uucuuagacaguauaguuaaaggcacgaagaauuugcuaaacucaacaagcuuagaaacaagcuuaucaauugaggcaccauggggagcaauaaauguccagucaaccuuuaaaccaacagugucgacugcaaacauagcacucaguuggagcucaguggagcacaggggcaacaagaucuuagucacaggcaggucugaaucaauuaugaaacuggaggaaaggacaggagucagcugggaucuaggcguagaagaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaauccuacuuggugcuggggaguaggaacuggcugcaccugcugcgggguggauguaaaagaccuuuuuacagaucacauguuugucaaauggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcaugugcaaaaaguguugucugcaaguacaguguguaaacugcagaguugcacacaugguauaccaggagaucuacaaguuuaccacauuggcaacuugcugaaaggggauaggauaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacauugaaacugauuacacgaaaaccuuccacuuccacucuaaaagaguuacagcacauggugacacaccacaauuagacuuaaaagcaaggccgaccuacggugcaggugagaucacugugcugguugagguugcugacauggaguugcauaccaagaaaguugagauaucaggcuugaaauuugcaagucuggcuugcacggguugcuaugcuuguagcucuggcaucuccuguaaagucaggauucauguagaugagccagaugagcucacaguacauguaaagagcagugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaaugauacuugcacagccaaggcaagcuguuggcuagagucagucaagaguuuuuuuuauggauugaaaaauaugcuugguaguguauuugguaacuuuuucauaggcauuuuguuauuccuugccccuuuuguccuguuggugcuuuucuuuauguuuggauggaaaaucuuguuuugcuucaaauguugcaggaggaccagaggcuuacuuaaguauagacaccucaaagacgaugaggaaacaggcuacagaaggauuauugaaagacugaacaacaaaaaaggaaaaaacagacugcuugauggugaaagguuggcugauaggaaaauugcugagcuguucuccacaaaaacacacauuggu

SEQ ID NO: 4090 - RNA, 1932 nt, Artificial Sequence
  derived and/or modified CDS sequence (wt) from CCHFV(Nakiwogo)__KX013484.1__Gc
uaccuggauagcauagccaaggggaugaaaagucuguuaaauucuacgaacuuagagacaagccugucgauugaggccccauggggagcaaucaauguucagucaacuuuuaaaccaacaguuucagcugccaacauagcacuuagcuggaguucaguugaacacaggggcaacaaaauccuaguuucgggcaggucagagucaauuaugaaacuggaagaacggaccggcaucagcuggagccuagguguagaggaugcuucugagucaaagacgcuuacuguuucugucauggaucugucucaaauguauucuccugucuuugaguaucugucaggugauagacaaguagaagaguggccaaaggccacuugcacaggcgacugcccagagagauguggcugcaccuccucaaccugcuugcauaaagaauggccgcacucgagaaacuggcgaugcaaccccacuugguguuggggaguagggacuggcugcaccugcugcggacuggauguuagagaccuuuucacggacuacaugauggucaaguggaaaguggaauauguaaaaacagaagcuauaauguguguugagcuaacuagucaggaaaggcaguguaguuuaauugaggcagguacaagguuuaaccugggcccugugacaauaacccugucagagccaagaaauguccagcaaaggcucccuuccgaaaucguuacacugcacccuaagauagaggaaggauucuuugauuugaugcaugugcaaaaaguacuauucugcaagcacaguuugcaagcuacaagcugcacacacggugucccaggcgauuugcaggucuaccauguuggcaaccuacugaaaggagacaagguuaaugggcacucaauucacaagauagagucucauuucaacacuucauggaugucaugggauggaugugaccuagacuacuuuugcaacaugggugacuggccuucauguacauauacuggagugacacagcacaaccgugcggcauucgucaacaugcucaauauugagacugauuacacaaagacuuuucacuuccauuccaagaggguuacggcacacggugacaccccucaacuggaucugaaggcaagaccaacauauggugcaggcgaggucacuguucuaguggagguugcagaucuggagcuacacacuaagaaaauagaagugucaggguugaaguuugcaagucugaccugcucugguuguuaugccugcaguuccggcaucuccugcaaaguuagaauucaugugaaugaaccagaugaguucacaguacacgugaaaagcaaugauccagacguuguggcagcaggaucaagucugauggcaaggaaaauagaguuaggggcugacagcaccuuuaaagccuuuucaucaaugccuaaaaacucuuugugcuuuuauauaguggaaagagacuacugcagcagcugcaccgaugaugacacucagaaguguguuaacacaaagcucgaacauccacaaagcauauuaauugagcauaagggaacaauaauugguaagcaaaaugacaccuguccgaccaaaacaagcugcuggcuagaaucagucaagaguuuuuuuuauggacugaaaaacaugcuggguggcaucuucgguaaugucuucuuaggcaucuuccuauuccuugcuccuuuugcacugcugauacucuucuucuucuucggguggaggcuucuguucugucugaaguguugcagaaggaccaggggucugcuaaaguauaaacaacuuaaggaugaagaagaagccggguacaagaaaaucaucgagaggcugaaugacaaaaagggcaaaagucgacuuuuugacggagagaggcucgcugacaggaagauugcugaacucuuuucaaccaaaacucauauaggg

SEQ ID NO: 4091 - RNA, 1932 nt, Artificial Sequence
  derived and/or modified CDS sequence (wt) from CCHFV(Saf)__KX013487.1__Gc
uucucagacaguauaguuaaaggcaugaagaauuugcuaaacucaacaagcuuagaaacaagcuuaucaauugaggcaccauggggagcaauaaauguccagucaaccuuuaaaccaacaguaucgacugcaaacauagcacucaguuggagcucaguggagcacaggggcaacaagaucuuagucacaggcaggucugaaucaauuaugaaacuggaggaaaggacaggagucagcugggaucuaggcguagaagaugccucugaauccaaauuacuuaccgucucuaucauggauuugucacaaauguauuccccuguuuuugaguacuugucaggagacagacagguugaagaauggcccaaagcaacuugcacaggugacugcccagaaaggugugguugcacaucaucaaccugcuugcauaaagaauggccucacucaagaaacuggagauguaaucccacuuggugcuggggaguaggaacuggcugcaccugcugcgggguggauguaaaagaccuuuuuacagaucacauguuugucaaauggaagguugaauauauaaaaacugaagccauaguauguguugagcucaccagccaggaaagacagugcagucugauugaggcagguacuagauucaacuugggcccugugacuauuacccugucugagccaagaaacauucagcagaagcuucccccugagauuaucacguugcaucccaaaguugaagagggcuucuuugacuugaugcaugugcaaaaaguguugucugcaaguacaguguguaaacugcagaguugcacacaugguauaccaggagaucuacaaguuuaccacauuggcaacuugcugaaaggggauaggguaaacgggcaucuaauucacaaaauugaaccacauuucaacaccucuuggauguccugggauggcugugacuuagacuacuacugcaacaugggggauuggccuucuugcacauacacaggagugacccagcauaaccaugcugcauuuguaaacuugcuuaacauugagacugauuacaugaaaaccuuccacuuccacucuaaaagaguuacagcacauggugacacaccacaauuagacuuaaaagcaaggccgaccuacggugcaggugagaucacugugcugguugagguugcugacauggaguugcauaccaagaaaguugagauaucaggcuugaaauuuguaagucuggcuugcacggguugcuaugcuuguagcucuggcaucuccuguaaagucaggauucauguagaugagccagaugagcucacaguacauguaaagagcagugauccagaugugguugcagcuagcacaagucucauggcgaggaagcuugaauuugggacagacaguacauucaaggccuuuucagcuaugcccaaaaccucuuuauguuuuuacauuguggagagagaauacugcaagagcugcagugaagaggacacacaaaaauguguugacacaaaacuugagcagccacagagcauacuaauugagcacaaaggaacgauaauuggaaagcagaaugauacuugcacagccaaggcaagcuguuggcuagagucagucaagaguuuuuuuuauggauugaaaaauaugcuugguaguguauuugguaacuuuuucauaggcauuuuguuauuccuugccccuuuuguccuguuggugcuuuucuuuauguuuggauggaaaaucuuguuuugcuucaaauguugcaggaggaccagaggcuuacuuaaguauagacaccucaaagacgaugaggaaacaggcuacagaaggauuauugaaagacugaacaacaaaaaaggaaaaaacagacugcuugauggugaaagguuggcugauaggaaaauugcugagcuguucuccacaaaaacacacauuggu

SEQ ID NO: 4092 - RNA, 1932 nt, Artificial Sequence
  derived and/or modified CDS sequence (wt) from CCHFV(Ast199)__KX056051.1__Gc
uucuuagacaguauaguuaaagguaugaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggauuugucacaaauguauuccccuguuuuugaguacuuaucaggagauagacagguugaagaauggcccaaggcaaccugcacaggugauugcccagaaagguguggcugcacaucaucaaccugcuugcauaaagaauggccucacucaagaaacuggagauguaaucccacuuggugcuggggaguaggaaccggcugcacaugcugcggaguggauguaaaagaccuuuuuacagaucacauguuuaucaaauggaagguugaauauauaaaaaccgaagccauaguauguguugagcucaccagccaagaaagacagugcagucugauugaggcagguacuagauucaacuuggguccugugacuaucacccugucugagccaaggaacauucagcagaagcuucccccugagaucauuacgcugcauccuaaaauugaagaaggcuucuuugacuugaugcaugugcaaaaaguguuaucugcaaguacaguguguaaacugcagaguugcacacaugguauaccaggagaucuacaaauuuaccacauuggcaacuuguugaaaggggauagauuaaacgggcaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaagaaaguugagguaucaggcuugaaauuugcaagucuggcuugcacggguugcuaugcuuguagcucuggcaucuccuguaaagucagaauucauguagaugaaccggaugagcucacagugcauguaaagagcagugauccagaugugguugcagcuagcacaagccuuauggcaaggaagcuugaauuugggacagauagcacauucaaggcauuuucagcuaugcccaaaaccucuuugugcuuuuacauuguggagagggaauacugcaagagcugcagugaagaugauacaaaaaaauguguugacacaaaacuugagcagccacagagcauacuaauugagcacaaagggacgauaauuggaaagcagaaugauacuugcacagccaaggcaaguuguuggcuagagucagucaagaguuuuuuuuauggauugaagaauaugcuuggcaguguuuuugguaauuuuuucguaggcauuuuguuauuccuugccccuuuugucuuguuggugcuuuucuuuauauuuggauggaaaaucuuguuuugcuuuaaguguugcaggaggaccagaggcuuguuuaaguauagacaccucaaagaugaugaggaaacaggcuacagaaagauuauugaaagacugaacagcaaaaaaggaaaaaacagacugcuugauggugagagguuggcugauaggaaaauugcugagcuguucucuacaaaaacacacauuggc

SEQ ID NO: 4093 - RNA, 1932 nt, Artificial Sequence
  derived and/or modified CDS sequence (wt) from CCHFV(Ast149)__KX056054.1__Gc
uucuuagacaguauaguuaaagguaugaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggauuugucacaaauguauuccccuguuuuugaguacuuaucaggagauagacagguugaagaauggcccaaggcaaccugcacaggugauugcccagaaagguguggcugcacaucaucaaccugcuugcauaaagaauggccucacucaagaaacuggagauguaaucccacuuggugcuggggaguaggaaccggcugcacaugcugcggaguggauguaaaagaccuuuuuacagaucacauguuuaucaaauggaagguugaauauauaaaaaccgaagccauaguauguguugagcucaccagccaagaaagacagugcagucugauugaggcagguacuagauucaacuuggguccugugacuaucacccugucugagccaaggaacauucagcagaagcuucccccugagaucauuacgcugcauccuaaaauugaagaaggcuucuuugacuugaugcaugugcaaaaaguguuaucugcaaguacaguguguaaacugcagaguugcacacaugguauaccaggagaucuacaaauuuaccacauuggcaacuuguugaaaggggauagauuaaacgggcaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaagaaaguugagguaucaggcuugaaauuugcaagucuggcuugcacggguugcuaugcuuguagcucuggcaucuccuguaaagucagaauucauguagaugaaccggaugagcucacagugcauguaaagagcagugauccagaugugguugcagcuagcacaagccuuauggcaaggaagcuugaauuugggacagauagcacauucaaggcauuuucagcuaugcccaaaaccucuuugugcuuuuacauuguggagagggaauacugcaagagcugcagugaagaugauacaaaaaaauguguugacacaaaacuugagcagccacagagcauacuaauugagcacaaagggacgauaauuggaaagcagaaugauacuugcacagccaaggcaaguuguuggcuagagucagucaagaguuuuuuuuauggauugaagaauaugcuuggcaguguuuuugguaauuuuuucguaggcauuuuguuauuccuugccccuuuugucuuguuggcgcuuuucuuuauauuuggauggaaaaucuuguuuugcuuuaaguguugcaggaggaccagaggcuuguuuaaguauagacaccucaaagaugaugaggaaacaggcuacagaaagauuauugaaagacugaacagcaaaaaaggaaaaaacagacugcuugauggugagagguuggcugauaggaaaauugcugagcuguucucuacaaaaacacacauuggc

SEQ ID NO: 4094 - RNA, 1932 nt, Artificial Sequence
  derived and/or modified CDS sequence (wt) from CCHFV(Ast137)__KX056057.1__Gc
uucuuagacaguauaguuaaagguacgaaaaauuugcuaaacucaacaagcuuagaaacaagcuuaucaauugaggcaccauggggagcaauaaauguccagucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggauuugucacaaauguauuccccuguuuuugaguacuuaucaggagauagacagguugaagaauggcccaaggcaaccugcacaggugauugcccagaaagguguggcugcacaucaucaaccugcuugcauaaagaauggccucacucaagaaacuggagauguaaucccacuuggugcuggggaguaggaaccggcugcacaugcugcggaguggauguaaaagaccuuuuuacagaucacauguuuaucaaauggaagguugaauauauaaaaaccgaagccauaguauguguugagcucaccagccaagaaagacagugcagucugauugaggcagguacuagauucaacuuggguccugugacuaucacccugucugagccaaggaacauucagcagaagcuucccccugagaucauuacgcugcauccuaaaauugaagaaggcuucuuugacuuaaugcaugugcaaaaaguguuaucugcaaguacaguguguaaacugcagaguugcacacaugguauaccgggagaucuacaaauuuaccacauuggcaacuuguugaaaggggauagauuaaacgggcaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccacucuaaaagggucacagcacauggagacacaccacaauuagacuuaaaagcaaggccgaccuacggugcaggugagaucacugugcugguugagguugcugacauggaguugcauaccaagaaaguugagguaucaggcuugaaauuugcaagucuggcuugcacggguugcuaugcuuguagcucuggcaucuccuguaaagucagaauucauguagaugaaccggaugagcucacagugcauguaaagagcagugauccagaugugguugcagcuagcacaagccuuauggcaaggaagcuugaauuugggacagauagcacauucaaggcauuuucagcuaugcccaaaaccucuuugugcuuuuacauuguggagagggaauacugcaagagcugcagugaagaugauacaaaaaaauguguugacacaaaacuugagcagccacagagcauacuaauugagcacaaagggacgauaauuggaaagcagaaugauacuugcacagccaaggcaaguuguuggcuagagucagucaagaguuuuuuuuauggauugaagaauaugcuuggcaguguuuuugguaauuuuuucguaggcauuuuguuauuccuugccccuuuugucuuguuggugcuuuucuuuauauuuggauggaaaaucuuguuuugcuuuaaguguugcaggaggaccagaggcuuguuuaaguauagacaccucaaagaugaugaggaaacaggcuacagaaagauuauugaaagacugaacagcaaaaaaggaaaaaacagacugcuugauggugagagguuggcugauaggaaaauugcugagcuguucucuacaaaaacacacauuggc

SEQ ID NO: 4095 - RNA, 1932 nt, Artificial Sequence
  derived and/or modified CDS sequence (wt) from CCHFV(Ast133)__KX056060.1__Gc
uucucagacaguauaguuaaagguaugaaaaauuugcuaaacucaacaagcuuagaaacaagcuuaucaauugaggcaccauggggagcaauaaauguccaaucaaccuuuaaaccaacaguaucgacugcaaacauagcacucaguuggagcucaguagagcacagaggcaacaagaucuuggucacaggcaggucugaaucaauuaugaaacuagaggaaaggacaggagucagcugggaucuaggcguagaagaugccucugaauccaaauuacuuaccgucucuaucauggauuugucacaaauguauuccccuguuuuugaguacuuaucaggagauagacagguugaagaauggcccaaggcaaccugcacaggugauugcccagaaagguguggcugcacaucaucaaccugcuugcauaaagaauggccucauucaagaaacuggagauguaaucccacuuggugcuggggaguaggaaccggcugcacaugcugcggaguggauguaaaagaccuuuuuacagaccacauguuuaucaaauggaagguugaauauauaaaaaccgaagccauaguauguguugagcucaccagccaagaaagacagugcagucugauugaggcagguacuagauucaacuuggguccugugacuauuacccugucugagccaagaaacauucagcagaagcuucccccugagaucauuacgcugcaucccaaaauugaagaaggcuucuuugacuugaugcaugugcaaaaaguguuauccgcaaguacaguguguaaacugcagaguugcacacaugguauaccaggagaucuacaaauuuaccacauuggcaacuuguugaaaggggauagaguaaacgggcaucuaauucacaaaauugaaccacauuuuaacaccucuuggauguccugggaugguugugaccuagacuacuauugcaacaugggggauuggccuucuugcacauacacaggagugacccaacauaaucaugcugcauuuguaaacuugcuuaacauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaagaaaguugagauaucaggcuugaaauuugcaagucugacuuguacggguugcuaugcuuguagcucuggcaucuccuguaaagucagaauucauguagaugaaccagaugagcucacagugcauguaaagagcagugauccagaugugguugcagcuagcacaagccuuauggcaagaaagcuugaauuugggacagauagcacauucaaggcauuuucagcuaugcccaaaaccucuuuaugcuuuuacauuguggagagggaauacugcaagagcugcagugaagaugauacaaaaaaauguguugacacaaaacuugagcagccacagagcauacuaauugagcacaaagggacgauaauuggaaagcagaaugauacuugcacagccaaggcaaguuguuggcuagagucagucaagaguuuuuuuuauggauugaagaauaugcuuggcaguguuuuugguaguuuuuuuguaggcauuuuguuauuccuugccccuuuugucuuguuggugcuuuucuuuauguuuggauggaaaaucuuguuuugcuuuaaguguugcaggaggaccagaggcuuguuuaaguauagacaccucaaagaugacgaggaaacaggcuacagaaggauuauugaaagacugaacagcaaaaaaggaaaaaacagacugcuugauggugagagguuggcugauaggaaaauugcugagcuguucucuucaaaaacacacauuggc

SEQ ID NO: 4096 - RNA, 1932 nt, Artificial Sequence
  derived and/or modified CDS sequence (wt) from CCHFV(SK/2015/human)__KX458183.1__Gc
uuccuggauaguauaguaagaggcaugaaaaaucugcuaaacucaacaaguuuggagacaagcuuaucgauugaggcaccauggggagcaauaaauguucagucaaccuacaagccaacugugucaacugcaaacauagcacuuaguuggaguucaguugaacacagagguaauaagauuuugguuucaggcagaucagaaucaauuaugaagcuagaagaaaggacaggagucagcugggaccuuggcguagaagaugccucugaaucuaagcuacuuacagucucugucauggacuuaucucagauguacucuccugucuucgaguacuuaucaggugacagacaaguagaagaguggcccaaggcaaccuguacaggugacugcccagaaagauguggcugcacaacgucaaccugcuugcauaaagaauggccucauucaagaaacuggagauguaaucccacuuggugcuggggaguggggacuggcugcacuuguuguggauuagaugugaaagaccuuuuuacugauuauauguucgucaaguggaaaguugaauacauuaaaacagaggccauaguguguguggaacucaccagucaaggaaggcaaugcagcuugauugaggcgggcacaagguucaauuuagguucugugaccaucacauugucggaaccgaggaacauucaacauaagcucccuccugaaauaaucacauugcauccuaggauugaagaagguuucuuugaccugaugcauguacaaaaaguguugucagcuagcacaguguguaaguugcagaguugcacacacggugugccaggugaucuacaggucuaucauaucggaaauuuauuaaaaggggauaaagugaauggacaccuaauucauaaaauugagccacacuucaacacuuccuggauguccugggauggcugugacuuagacuacuacugcaacaugggagacuggccuucuuguacauauaccggaguuacccaacacaaucaugcuucauuuguaaaccuacucaacauugaaacugacuauacaaaaaacuuccacuuucacucuaaaaggguuacugcgcauggagacacaccacaauuagaucugaaagcaagaccaacuuacggcgcaggagaaaucacuguacugguagaaguugcugacauggaguuacacacgaagaaaauugaaauaucaggccuaaaauuugcaagccugacuugcacaggcuguuaugcuuguaguucuggcauuuccugcaaaguuaggauucauguggaugaaccagaugaacuuacaguacacguuaagagugaugauccagauguaguggcagcuagcucaagucucauggcaaggaagcuugaguuuggaacagacaguacguuuaaagcuuucucagccaugcccaaaaccuccuuauguuucuacauuguagaaagggaguacuguaagagcugcaguaaagaagacacacaaaaauguguuaacacaaaacuugagcaaccacagagcaucuugaucgaacauaggggaacuauaaucggaaagcagaacaauaccugcauagccaaagcaaguugcugguuagagucaguuaaaaguuucuuuuauggucuaaagaacaugcuuaguggcauuuuuggcaaucucuuucugggcaucuucuuauuucuugcccccuuuaucuuguuaauacuuuuuuucauguuuggauggaggauccuguuuugcuuuaaguguugcagaagaaccaggggccuguucaaguauagacaucucaaagacgaugaagaaacugguuacagaaggaucauugaaagacugaacaacaagaaagggaagaacaagcugcuugauggugaaagacuugccgauagaagaauugccgaacuauucuccacaaagacacacauuggc

SEQ ID NO: 4097 - RNA, 1932 nt, Artificial Sequence
  derived and/or modified CDS sequence (wt) from CCHFV(YL16070)__KY354081.1__Gc
uuccuggauagcauagccaagggaaugaaaagccuguugaacuccacgagcuuagaaacuagucugucaauugaagcuccguggggagcaaucaauguucagucaacuuucaaaccaacaguuucagcugcuaacauagcacuuagcuggaguucaguugaacacaggggcaacaaaauuuugguuucagguagaucagagucaaucaugaaauuagaagaaagaacaggagucagcuggaaccuggguguagaagaugcuucugagucaaagacgcuuacuguuuccgucauggaccugucacaaauguacucuccuguuuuugaguacuugucaggugacagacaaguggaggaauggccaaaggcaacuugcacaggugacuguccagagagaugcggcugcacuucaucaaccugcuuacauaaagaguggccacauucaagaaacuggagauguaauccuacuugguguugggggguggggacuggcugcacuugcugugggcuggaugugaaggauuuuuuuacugacuacauguugguaaaauggaaaguggaauauauaaagacagaagcuauagugugugucgagcuaacuagucaagagaggcaguguaguuuaauugaagcaggcacaagauuuaaccuaggcccuguaacaauaacccuaucagagccaagaaauguccagcagaggcuuccucccgaaauuguaacacugcauccuaaaauagaggaagguuuuuuugauuugaugcauguacaaaaaauacugucugcaagcacaguuugcaagcuacagagcugcacacacggugugccgggcgauuuucaggucuaccaugucgguaaccugcugaggggagacaagguuaauggacacucaauucacaagauagaaccacauuuuaauacuucauggaugucaugggaugguugcgaucuggacuauuucugcaauaugggggacuggccuucaugcacauacacuggaguaacacagcauaaccgugcugcauuuaucaacaugcucaacauugagacugacuauacaaaaacuuuccacuuucauucgaagagggucacggcacauggagauacuccccagcuagaccuaaaagcgagaccggcauauggugcuggcgaagucacuguucuaguggagguugcagacuuggaguugcacacaaagaaacuugaagugucagguuugaaaauugcaaguuugaccugcucuggguguuaugcaugcagcucuggcaucuccugcaaaguuagaauccauguaaaugaaccagacgaauucacagugcauguaagaaguagcgacccagauguuguagcagcaggaucaagucuuauggcaaggaaaauagaguuuggggcugacaguacauucaaggccuuuucaucaaugcccaaggacuccuuaugcuuuuacauaguagaaaaggauuacugcagcagcugcaccgacgaugacacacaaaagugugucaacacgaagcuugaccauccacagagcauacucauugagcacaaaggaacaauaauuggcaagcaaaaugacacuuguucgaccaaaacaagcugcuggcuaaaaucauuuaaggguuucuucuaugggcucaaaaacaugcugaguggcaucuuuggaaauguuuuuuuaggcauccucuuauuccuugcuccuuuuguacuacugauauuuuuuuucuuuuuuggguggaggcuucuguuuugucucaaauguugcaaaaaaacuaaaggacuguugaaauauaagcaccuuaaggacaaggaggaggcuggauacaaaaaaaucauugaaaggcuaaauggcaaaaaagguaaaagucaauuguuugauggugaaaggcuugcaaacaggaaaauugcugagcuuuuuucuacuaaaauucacauaggu

SEQ ID NO: 4098 - RNA, 1932 nt, Artificial Sequence
  derived and/or modified CDS sequence (wt) from CCHFV(Oman_812956)__KY362518.1__Gc
uuuuuugacaguauugcuaaggguaugaagaaccugcugaauucaacaagcuuagaaacaagcuuaucaauugaggcaccauggggagcaauaaacguccaaucuacuuucaaaccuacugugucaacugcaaacauagcacuuaguuggagcucaguggaacacagagguaauaagaucuugguuucaggcagaucagagucaaucaugaagcuagaagaaagaacaggaaucagcugggauuugggaguagaagaugccucugaguccaaauuacuuacuguuuccgucauggacuuaucacagauguacucuccugucuuugaguaccuaucaggugacagacaaguagaggaauggccaaaggcaaccuguacaggcgauugcccggaaagauguggcugcacaucaucaaccugccuacacaaggaauggccucacucaagaaacuggagaugcaaccccacuugguguuggggagucggcaccggaugcaccuguuguggacuagauguaaaggaccuuuuuacagauuacauguuuguuaaauggaaggucgaauauauaaaaacagaggcuauaguguguguugagcuuacuagccaagaaagacaauguagcuugauugaggcaggcacaagauucaacuuagguccugugacuaucacauuaucagagccaagaaacauucagcaaaagcucccuccagaaauugucacauuacauccuagaauugaagaagguuuuuuugacuuaaugcauguacagaagguacuaucagcaagcacagugugcaagcuacagaguugcacacauggcguaccaggagacuuacaggucuaccacaucggaaacuuacuaaaaggagacaaagugaaugggcaucugauacauaaaguugaaccacauuucaacaccuccuggaugucuugggacggcugugaccuagauuacuacugcaauaugggggauuggcccucuugcacguauacuggaguuacccaacauaaucaugcugcauuuguaaaccuacuuaacauugaaacugauuacacaaagaacuuccacuuucacucuaagagagucacugcacauggggacacuccacaauuagauuuaaaagccagaccaaauuauggugcaggugaaaucacugugcugguggaaguugcugacauggaguuacacacaaagaaaauugagauaucagguuugaaguuugcaagccuaaccugcacagguuguuaugcuuguagcucuggcaucucauguaagguuaggauccauguagaugaaccagaugagcuuacaguacaugugaagagugaagacccagacauaguugcugcuagcucaagucucauggcaagaaagcuugaauucgggacggauaguacauucaaagccuucucagccaugccuaaaaccuccuugugcuuuuacauuguugagagagaauacuguaaaagcugcaguaaagaagacacacaaaaguguguuaacgcaaagcuugagcgaccacagagcauuuuaauugagcacaaaggaacgauaauuggaaagcagaacgacacuugcacagcuaaagcaagcugcuggcuagagucagucaagaguuucuuuuauggacuaaagaacaugcuuaguggcauuuuuggcaauguuuucauagggauuuucuuauuccuugcuccuuuuauccuguuaauacuuuucuuuauguuuggguggagaauccuauucugcuuuaagugcugcaggagaacuagaggccuauuuaaguacagacaccucaaagaugaugaagaaaccgguuauaggaaaaucauugagagacuaaacaacaaaaaagguaaaaacaagcugcuugacggugaaagauuagcugauagaaagaucgcugagcuguucucuacaaaaacacacauuggc

SEQ ID NO: 4099 - RNA, 1932 nt, Artificial Sequence
  derived and/or modified CDS sequence (wt) from CCHFV(UCCR4405)__KY484029.1__Gc
uucuuagacaguacaguuaaagguaugaaaaauuugcuaaacucaacaagcuuggaaacaagcuuaucaauugaggcaccauggggagcaauaaauguccagucaaccuuuaaaccaacaguaucgacugcaaacauagcacucaguuggagcucaguggagcacagaggcaacaagaucuuggucacaggcaggucugaaucaauuaugaaacuagaggaaaggacaggagucagcugggaucuaggcguagaagaugccucugaauccaaauuacuuaccgucuccaucauggauuugucacaaauguauuccccuguuuuugaguacuuaucaggagauagacagguugaagaauggcccaaggcaaccuguacaggugauugcccagaaagguguggcugcacaucaucaaccugcuugcauaaagaauggccucacucaagaaacuggagauguaaccccacuuggugcuggggaguaggaaccggcugcacaugcugcggaguggauguaaaagaccuuuuuacagaucacauguuugucaaauggaagguugaauauauaaaaaccgaagccauaguauguguugagcucaccagccaagaaagacagugcagucugauugaggcagguacuagauucaacuuggguccugugacuaucacccugucugagccaagaaacauucagcagaagcuucccccugagaucauuacgcugcaucccaaaauugaagaaggcuucuuugacuugaugcauguacaaaaaguguuaucugcaaguacaguguguaaacugcagaguugcacacaugguauaccaggagaucuacaaauuuaccacauuggcaacuuguugaaaggggauagaguaaacgggcaucuaauucacaaaauugaaccacauuuuaacaccucuuggauguccugggaugguugugaccuagacuacuauugcaacauggggaauuggccuucuugcacauacacaggagugacccaacauaaucaugcugcauuuguaaauuugcuuaacauugaaacugauuacacgaaaaccuuccacuuccacucuaaaagagucacagcacauggagacacaccacaauuagacuuaaaagcaaggccgaccuacggugcaggugagaucacugugcugguugagguugcugacauggaguugcauaccaagaaaguugagauaucaggcuugaaauuugcaagucugguuugcacggguugcuaugcuuguagcucuggcauuuccuguaaagucagaauucauguagaugaaccagaugagcucacagugcauguaaagagcagugauccagaugugguugcagcuagcacaagccuuauggcaaggaagcuugaauuugggacagauagcauauucaaggcauuuucagcuaugcccaaaaccucuuuaugcuuuuacauuguggagagggaauacugcaagagcugcagugaagaugauacaaaaaaauguguugacacaaaacuugagcagccacagagcauacuaauugagcacaaagggacgauaauuggaaagcagaaugauacuugcacagccaaggcaaguuguuggcuagagucagucaagaguuuuuuuuauggauugaagaauaugcuuggcaguguuuuugguaauuuuuucguaggcauuuuguuauuccuugccccuuuugucuuguuggugcuuuucuuuauguuuggauggaaaaucuuguuuugcuuuaaguguugcaggaggaccagaggcuuguuuaaguauagacaccucaaagacgaugaggaaacaggcuacagaaggauuauugaaagacugaauaguaaaaaaggaaaaaacagacugcuugauggugagagguuggcugauaggaaaauugcugagcuguucuccacaaaaacacacauuggc

SEQ ID NO: 4100 - RNA, 1932 nt, Artificial Sequence
  derived and/or modified CDS sequence (wt) from CCHFV(UCCR4401)__KY484035.1__Gc
uuccuagauaguacagcuaaaggcaugaaaaaucugcuaaauucaacaaguuuagaaacgaguuuaucaauugaggcaccauggggagcaauaaauguucagucaaccuacaaaccaacugugucaacugcaaacauagcacucaguuggagcucaguggaacacagaggcaauaagaucuugguuucaggcagaucagaaucaauuaugaagcuggaagaaaggacaggaaucagcugggaucucgguguagaagaugccucugaaucuaaacugcuuacaguaucugucauggacuugucucagauguacucuccugucuucgaguacuuaucaggggacagacagguggaagaguggcccaaagcaacuugcacaggugacugcccagaaagauguggcugcacaucaucaaccuguuugcacaaagaauggccucacucaagaaauuggagaugcaaucccacuuggugcugggguguagggacuggcugcaccuguuguggauuagaugugaaagaccuuuuuacagauuauauguuugucaaguggaaaguugaauacaucaagacagaggccauaguguguguagaacuuacuagucaggaaaggcaguguagcuugauugaagcgggcacaagguucaauuuagguccugugaccaucacacugucagaaccaagaaacauccaacaaaaacucccuccugaaauaaucacacugcauccuaggaucgaagaagguuuuuuugaccugaugcaugugcaaaagguguuaucggcaagcacaguguguaaguugcagaguugcacacauggugugccaggagaccuacaggucuaccacaucggaaauuuauuaaaaggggauaagguaaauggacaucuaauucauaaaauugagccacacuucaacaccuccuggauguccugggaugguugugaccuagacuacuacugcaacaugggagauuggccuucuugcacauacacaggggucacccaacacaaucaugcuucauuuguaaacuuacucaacauugaaacugauuacacaaagaacuuccacuuucacucuaaaagggucacugcacacggagauacaccacaacuagaucuuaaggcaagaccaaccuauggugcaggcgagaucacuguucugguagaaguugcugacauggaguuacauacaaagaagauugaaauaucaggcuuaaaauuugcaagcuuagcuugcacagguuguuaugcuuguagcucuggcaucucaugcaaaguuagaauucauguggaugaaccagaugaacuuacaguacauguuaaaagugaugauccagaugugguugcagcuagcucaagucucauggcaaggaagcuugaauuuggaacagacaguacauuuaaagcuuucucggccaugccuaaaacuucucuauguuucuacauuguugaaagagaacacuguaagagcugcagugaagaagacacaaaaaaauguguuaacacaaaacuugagcaaccacaaagcauuuugaucgaacacaagggaacuauaaucggaaagcaaaacagcacuugcacggcuaaggcaaguugcugguuagagucagucaagaguuuuuuuuauggccuaaagaacaugcuuaguggcauuuuuggcaaugucuuuaugggcauuuucuuguuccuugcccccuucauccuguuaauacuauucuuuauguuuggguggaggauccuauucugcuuuaaauguuguagaagaaccagaggccuguucaaguauagacaccucaaagacgaugaagaaacugguuauagaaggauuauugaaaaacuaaacaauaaaaaaggaaaaaacaaacugcuugauggugaaagacuugcugauagaagaauugccgaacuguucucuacaaaaacacacauuggc

SEQ ID NO: 4101 - RNA, 1932 nt, Artificial Sequence
  derived and/or modified CDS sequence (wt) from CCHFV(UCCR4448)__KY484042.1__Gc
uuccuagauaguauaguuaaaggcaugaaaaaucugcuaaacucaacaaguuuagaaacaaguuuaucaauugaggcaccauggggggcaauaaauguucagucaaccuacaaaccaacugugucaacugcaaacauagcacucaguuggagcucuguggaacacagagguaauaagaucuugguuucaggcagaucagaaucaauuaugaagcuggaagaaaagacaggaaucagcugggaucucggcguagaagacgccucugagucuaaacugcuuacagucucugucauggacuugucucagauguacucuccugucuucgaguacuuaucaggagacagacagguggaagaguggcccaaagcaacuuguacaggugacugcccagaaagaugcggcugcacaucaucaacguguuugcacaaagaauggccccacucaagaaauuggagaugcaaucccacuuggugcugggguguagggacuggcugcaccuguuguggauuagaugugaaagaccuuuuuacagauuauauguuugucaaguggaaaguugaauauauuaagacagaggccauaguguguguagaacuuaccagucaggaaaggcaguguagcuugauugaagcgggcacaagguucaauuuagguccugugaccaucacacugucagaaccaagaaacauccaacagaagcucccuccugaaauaaucacacugcaucccaggaucgaagaagguuuuuuugaccugaugcauguacaaaaaguguuaucggcaagcacaguauguaaguugcagaguugcacacaugguguaccaggagaccuacaggucuaccacaucggaaauuuauugaaaggggauaagguaaauggacaucuaauucauaaaauugagccacacuucaacacuuccuggauguccugggaugguugugaccuggacuacuacugcaacaugggagauuggccuucuugcacauauacaggagucacccaacacaaucaugcuucauuuguaaaccugcucaacauugaaacugauuacacaaaaaacuuccacuuucacucuaaaagggucacugcacauggagacacaccacaacuagaucuuaaggcaagaccaaccuauggugcaggugagaucacuguacugguagaaguugcugacauggaauuacacacaaagaagauugaaauaucaggcuuaaaauuugcaagcuugacuugcacagguuguuaugcuuguagcucuggcaucucaugcaaaguuagaauucauguggaugaaccagaugaacuuacaguacauguuaaaagugaugauccagauguaguugcagcuagcucaagucucauggcaagaaagcuugaauuuggaacagacaguacauuuaaagcuuucucagccaugccuaaaacuucucuauguuucuacauuguugaaagagaacacuguaagagcugcagcgaagaagacacaaaaaaauguguuaacacaaaacuugagcaaccacaaagcauuuugaucgaacacaagggaacuauaaucggaaagcaaaacagcacuugcacagccaaggcgaguugcugguuagagucagucaaaaguuucuuuuauggucuaaagaacaugcuuagugguauuuuuggcaauguuuuuauagguauuuucuuguuccuugcccccuucauccuauuaauacuauucuuuauguuuggguggaagauccuauuuugcuuuaaauguuguagaagaacuagaggccuauucaaguauagacaccucaaggacgaugaagaaacugguuauagaaggauuauugaaagacuaaacaauaaaaaaggaaaaaacaaacugcuugauggugaaauacuugcugauagaagaauugccgaacuguucucuacaaaaacacacauuggc

SEQ ID NO: 4102 - RNA, 1932 nt, Artificial Sequence
  derived and/or modified CDS sequence (wt) from CCHFV(U2-2-002/U-6415)__AY900144.1__Gc
uuucaggacaguauagucaaaggcaugaaaaaccugcuaaacucaacaaguuuagaaacaagcuugucgauugaggcaccauggggggcaauaaacguucagucaaccuacaaaccaacugugucagcugcaaacauagcacuuaguuggaguucaguugaacacagagguaauaagauuuugguuucaggcagaucagaaucaauuaugaagcuggaagaaaggacaggaaucagcugggaucuuggcguagaagaugccucugaaucuaagcuacucacagucucugucauggacuugucucagauguacuccccugucuucgaguacuugucaggugacagacaaguagaagaguggcccaaggcaaccuguacaggugacugcccagagagauguggcuguacaucaucaaccuguuugcauaaagaauggccccauucaagaaacuggagguguaauccaacuuggugcugggggguagggacuggcugcaccuguugugguuuagaugugaaagaccuuuuuacagacuauauguucgucaaguggaaagucgaauacauuaagacagaggccauaguguguguagaacuuaccagucaggaaaggcaguguagcuuaauugaggcggguacaagguucaauuuagguccugugacuaucacacugucagaaccgaggaacauccagcaaaagcucccuccugaaauaaucacacugcauccuaggauugaagaagguuuuuuugaccugaugcauguacagaaggugcuaucagcaagcacaguguguaaguugcagaguugcacacauggugugccaggagaucuacaggucuaccacaucggaaauuuacuaaaaggagauaaaguuaacggacaccugauucauaaaauugagccacacuucaacacuucuuggauguccugggacggcugugaccuagacuacuacugcaacaugggagacuggccuucuugcacauauaccgggguuacccagcacaaucaugcuucauuuguaaaccugcucaacauugaaacugacuauacaaaaagcuuccauuuucacucuaaaaggguaacugcacauggagacacaccacaauuagaucugaaggcaaggccaagcuauggcgcaggagagaucaccguacuaguagagguugcugauauggaguuacacacaaagaagauugaaauaucaggccuaaaguuugcaagcuugacuuguacagguuguuaugcuuguaguuccgguaucuccuguaaaguuaggauucauguggaugaaccagaugaguucacaguacauguuaaaagugaugauccagauguaguugcagcuagcucaagucucauggcaaggaagcuugaauuuggaacagacaguacauuuaaggcuuucucagccaugcccaaaaccuccuuauguuucuauauugucgaaagggaauacugcaagagcugcagugaagaagacacacaaaaauguguuaacacaaagcuugagcagccacagagcauuuugaucgaacauaagggaacuauaaucggaaagcagaacaacaccugcacagcuaaggcaaguugcugguuagagucaguuaaaaguuucuuuuaugguuuaaagaacaugcuuaguggcauuuuuggcaauguuuuugugggcauuuucuuauuucuugcccccuucaucuugcuaauacuuuucuuuauguuuggguggaggauccuauuuugcuucaagugcuguagaagaaccaggggccuguucagauauaaacaucucgaaaacgaugaagaaacugguuacagaagaaucauugaaagacugaacaacaaaaaaggaaaaaacaagcugcuugauggugaaagacuugcugauagaagaauugccgaacuauucuccacaaaaacacacauuggc

SEQ ID NO: 4103 - RNA, 1932 nt, Artificial Sequence
  derived and/or modified CDS sequence (wt) from CCHFV(SPU 45/88)__KJ682809.1__Gc
uuuuuggacaguauuguuaaaggcaagaagaacuugcuaaauucaacaagccuagaaacaagcuuaucaauugaggcaccauggggggcaauaaauguccagucaacuuucaaaccaacugugucagcugcaaacauagcacuuaguuggagcucaguagaacauagagguaacaagauuuugguuucaggcaggucagagucaaucaugaaauuagaggaaaggacaggaauuagcugggaucuggguguggaagacgccucugaauccaaauugcucacugucucuguuauggacuugucacagauguauucuccugucuuugaauaccuaucaggugauagacaaguggaggaauggcccaaggcaaccugcacaggagauugcccagaaagauguggcuguacgucgucaaccugccuacacaaggaauggccccauucaagaaacuggagaugcaacccuacuugguguuggggagucggcacuggaugcaccuguugugggcuggaugugaaagaccucuuuacagauuacauguuugucaaguggaaaguugacuacauuaaaacagaagcuauaguauguguugagcuuacuagccaggaaagacaauguagcuugauugaggcaggcacaagauucaacuuggguccugugacuaucacauugucagagccaagaaacauucagcaaaagcucccuccagaaauagucacauugcauccuaggauugaagaaggcuucuuugacuuaaugcauguacaaaaugugcuaucagcaaguacagugugcaagcuacaaaguuguacacauggugugccaggagaccuacagauuuaccacauuggaaacuuguuaaaaggagacaaggugaaugggcaccugauucacaagauugaaccacacuucaacacuuccuggaugucuugggacggcugugaccuagacuacuacuguaauaugggggauuggccaucuugcucauacacuggcguaacccaacacaaucaugcugcauuuguaaacaugcucaacaucgaaacugauuauacaaaaaacuuccacuuucacucuaagagaguuacagcacauggagacacaccacaauuagauuuaaaagccagaccaacuuauggugcaggugaaaucacugugcugguggagguugcugacauggaguugcauacaaagaaaauugagauaucagguuugaaguuugcaagcuuaacuugcacaggcuguuaugcuuguaguucugguaucuccuguaagguuagaauccauguggaugaaccagaugagcucacaguacaugugaagagugaggauccagacauaguugcugcuagcucaagucucauggcuaggaagcuugaauuugggacagauagcacauuuaaagccuuuucagccaugcccaaaaccuccuuaugcuuuuacauuguggagagggaauacugcaaaagcugcaguaaagaagacacacaaaaaugugucaacacaaagcuugagcaaccacaaagcauuuuaaucgagcacaaagggacgauaauugggaagcagaacgacacuuguacagccaaagcaaguugcuggcuagagucagucaagaguuuuuuuuauggacuaaagaauaugcuuaguggcauuuuuggcaauguuuucauagggauucucuuauuccucgcuccuuuuaucaugcuaauacuuuucuucauguuuggauggaggauccuguucugcuuuaaguguugcagaagaacuagaggccuauuuaaguauagacaccucaaagacgaugaagaaaucgguuacaggaaaaucauugagaggcuaaacaacaaaaaagggaaaaacaaacugcuugacggugaaaggcuagcugauaggaaaaucgcugagcuguucuccacaaaaacacacauuggc

SEQ ID NO: 4104 - RNA, 1932 nt, Artificial Sequence
  derived and/or modified CDS sequence (wt) from CCHFV(SR3)__AJ538199.1__Gc
uuucuagauaguauagucaaagguaugaaaaaucugcuaaacucaacaagucuagaaacaagcuuaucaauugaggcaccguggggagcaaucaauguucagucaaccuacaaaccaacugucucaacugcaaacauagcacuuaguuggagcucaguggaacacagaggcaauaagguuuuggucucaggcagaucagaaucaauuaugaagcuggaagaaaggacaggaaucagcugggaucuuggcguggaagaugccucugagucuaagcuacuuacaguuucaguuauggacuugucucagauguacucuccugucuucgaguacuuaucaggugacagacaaguggaagaguggccuaaagcaaccugcacaggugacugcccagaaagauguggcugcacaucaucaaccugcuuacacaaagaguggccccacucaaggaauuggagauguaauccuacuuggugcugggguguagggacuggcugcaccuguugugguuuagaugugaaagaccuuuucacagauuacauguucgucaaguggaaaguugaguacauuaagacagaggccauaguauguguagaacuaaccagucaggaaagacaguguagcuugauugaggcgggcacaagauucaauuuagguucugugacuauuacauugucagaaccaaggaacauucaacaaaagcucccuccugaaauaaucacacugcaccccaagauugaggaagguuuuuuugaccuaaugcauguacaaaaagugcuaucggcaagcacaguguguaaguugcagaguugcacacauggugugccaggagaucugcaggucuaccacaucggaaaccuauuaaaaggggacagaguaaacggacaccugauucauaaaauugagcaacacuucaacacauccuggaugucuugggaugguugugaccuagacuacuacuguaacaugggagacuggccuuccugcacauauaccggagucacucagcauaaccaugcuucauuuguaaaccugcucaacauugaaacugauuauacaaaaaccuuucacuuucacucuaaaaggguuacugcacauggagacacaccacaacuagaucugaaggcaaggccaaccuauggugcaggugagaucaccgugcugguggaaguugcugacauggaguuacacacaaagaagauugaaauaucaggcuuaaaauuugcaggccuaacuugcacagguuguuaugcuuguaguucuggcaucucuuguaaaguuagaauucauguagaugaaccagaugaacuuacaguacauguuaaaagugaugacccagauguaguugcagcuagcucaagucucauggcgaggaagcuugaauuuggaacagacaguacauuuaaagcuuucucagccaugccuaaaaccucccuauguuucuacauuguggaaagggaauacuguaaaagcugcaauaaagaagauacacaaaaauguguuaacacgaaacucgaacaaccacagagcauuuugaucgaacauaagggaacuauaauuggaaagcaaaacaauacuugcacggcuaaagcgaguugcugguuagagucaguuaagaguuucuuuuauggucugaagaauaugcucgguggcauauuuggcaauguuuuuauaggcauuuucacauuucuuacccccuuuaucuuguuaauacuuuucuuuauguuuggguggaggauccuguuuugcuucaaguguugcagaaggaccagaggccuauucaaguacagacaccucaaagacgaugaagaaacugguuacagaaagaucauugaaagacugaacaacaaaaaaggaaaaaacaggcugcuugauggugaaagacuugcugacagaaagauugcugaacuguucuccacaaaaacacacauuggc

SEQ ID NO: 4105 - RNA, 4656 nt, Artificial Sequence
  derived and/or modified CDS sequence (wt) from DUGV(ArD44313)__NC_004158.1__GP
augucuaagaggguacugaucauagccguagugguuuaucugguauucaccacucaaaaccagauaaccggcaaccacacaacaaucaacagcagcagcccguccacaacagaggcaagcagcacgccaacagucagcagaacuccacaaacaaccaccaccuccacugcaguauccaccaccaucaccgcaaccaccacuccaacagcuucauggaccacacagagucaauauuuuaauaaaacaacacaacaccauuggagagaagaaaccaugaucucaaggaauccuacugugcuggacagacagagcagagcaaguucugugagagaacuacucaacaccaaguucuuaauguuguuagguuucauuccaaagggugaagucaaucaccuagaaaaugccugcaacagggaagggaaaaacugcacagaauuaauacugaaagaaaggauagcucgguucuuuucugagacagaaaaagagucauguuauaacacuuaccuagaaaaacaccuucgcaguguuagcccugaaguuagucucaccccuuacaggguccucgggcuaagagaagacauuuugcugaaagaaauugaccguagaaucaucagauuugaaacagacucccaaagagugaccugucucucagcaucucugcuaaaaccugaugucuuuauuagggaacagagaauugaugcuaagcccuccaacgguccuaaaauagugccuguggacagcgucgccugcaugaacuuagaagcuaacguagaugugagaucaaacaaauuagugauacagucuuugaugacuacaguuaaaauuagccugaaaaacuguaaggucguagucaauucuagacagugcauccaucagcaaacaggcucugguguuaucaaagucccaaaauucgaaaagcagcaggguggaacuuggucaagcuacaucgccgggguauacacagcaaccauugaccuguuagaugaaaacaaccaaaacugcaagcuauuuacagaauguauugucaaagguagagaguugguuaaaggacaaagugaacuuaaguccuucaauauagaaguccuccuaccgagagugaugaagacuagaagaaagcuguuagcugucacugaugguagcacugaauguaacucagggacacagcuaauugaaggaaaguccauagagguccacaaacaagacauaggagggccggggaaaaaacugaccauuuguaacggcacuaguguucucgauguaccccuggaugaaggacauggaugcuacaccauuaauguaaucacguccaaaagggcaugcagaccaaagaacagcaaguuacaguguucaauugacaaagagcuuaagccuugugacucaggcaaguguuugaguaucagccaaaaaggagcaggccacauuaaggugagcagagggaaaaccauucuuauuacugaaugcaaagaacacugccagaucccaguaccaacuggaaaaggggauauaaugguggacugcucaggaggccgucagcacuauuuggaggugaacaucguugauauccacugcccuaacacaaaauucuuaggaggaauaaugcuuuauuucuguagaaugucaagcagaccuacaguagcauugcuucuuggcaucuggauuggcugcggcuauauacucacaugcaucuucucauuuuugcuauaccacuuaauuuuauucuuugcaaacuguauaaaacagugcagaaagaaaggagagaggcuuggagaaaucugugucaagugcgagcagcaaacaguuaaccuuauggaccaagaguugcaugaccucaauugcaauuucaaucuuuguccuuauugcugcaaucgaaugucagacgaagguaugagcaggcauguagguaaguguccuaaaagauuagaaagacuuaaugaaauagagcucuaucuaacuacaagcgagugccucugccuaaguguaugcuaucaacuucuaauaagcguaggcauuuucuugaaaagaacaacuuggcugguuguacuucugguucuguuaggguuagccauuucaccaguucaaggagcuccaacagaggucaguaauguuaagcaggacggugacuacaguaucugcuauuuuauuuuugguuguuuggugacagcugcacuuuuguugaaggucaagagaacaaacucuaauggcauugugguaguggucgauagcuuuggaagguguccauacuguaaugaauucacugauucauuguuugaggaagugcuucacgauacacuaugcagucucugugucuguccuuucugugagaaacaggcucuugaucuggugacccuugaagaacaugucaaagaaugcuacaaaguugcaacuaggaaggacauauucaagauauuagggagaaaguucaccaaugcucuaguuagaagggaaaaacuguucacaacaggacugcagcucuucauaaauaaaacaaauguugucgucuuugcucucauuaugugcuucuugcuacuguuaacaggacauaacgcaagugcuuuugauucuggugacuugccagaugggguaugggaagaaucaagccaacuuguuaagucauguacacaguuuuguuauauagaagaagaugucugcuacugcccugcugaggauggcguaggaaggaaauugcuguucuucaauggccuucagaauucagugaaaagacuuucagauucucacaaguuguugacaagugucucaauugaugcaccuuggggucgaauuaauguugaaucaacuuggaaaccaacacuggcagcauccaacauugccaugagcuggagcuccacugacaucaaaggugagaaggucauacuaucaggaaggagcacauccauaauaaagcuuaaagaaaaaacuggugugauguggaagcucguugggucaggacuagcaucagaaaaaaagaaaccuuuuagguuuccgauaauggauuuugcccaagucuacaauucaguauuccaguacauaacaggugauagacuacuaagugaauggccaaaagccgucugcacaggagauuguccucauagauguggcugccaaacaucaacuuguauggccaaagagugccacacacaagaaugcgugucaacccacaugguguugggaauugguacugguugcaccugcugugguauggauguggaaaggccauuuaauaaauaucuugguguuaaguggucaacagaauaucuuagaacugagguguuggucugcguggaggucacggaggaggagaggcacugugaaauugucgaggcaggaaccagauucaacauuggcccuauaacaauaacgauuucugauccccaaaacauuggaaguaagcuuccagaaaguuuaaugacaguccaagaaauugaugacagcaacuuugucgacauaaugcauguugguaauguuaucucugcugacaacaguuguaggcuucaaagcugcacucauggcagugcggugacuaccagauuuacagcacugacagcuuuaaucaaagaugaucacaguucuggacucaaccuagcuguguuagaucccaaagucaauaguagcuggcuaucaugggaagggugugacauggacuacuacuguaauguuggcgauuggccaaccuguaccuacacugguguagugacucaaaaacucagagaguuucucaaacuugaucaacauagaaaaagauuacacacaacgcuuucauuuucacucaaaaagaaucucagcaaaaggucacacacuucaguuagacuugaaggcaagaccguaaccaggauggaggugaaagugacagcacugauugaaguugaugguauggaguuacauucaaagacaauaaggcuaagugguauaagacuaacuggacugaaaugcagugguuguuuuaguugcacuucuggcauaucaugcagcgucaaugccaaguugacuucuccagacgaauuuacacugcaucugaggagcaccagucccaaugugguaguggcagaaacuagcauaauugcaagaaaggguccaagugccacaacuagcagguuuaaaguguucucuguucgugauacaaagaaaauuugcuuugagguaguggaaagagaauacugcaaagauuguacuccugaugaacucacuacaugcacugguguugaguuagaaccuaccaaagacauauuguuagaacauagaggaacaauaguacagcaccaaaacgacacuugcaaaucuaagauugacuguuggucaaauucuauaaguucauucgcaucugguauaggagauuuuuuuaagcauuacauuggaagcauugcugucggaguacuuggcacgguucuuccuuucgcccuuuuaauucuuuuuuucauauacggugacaaaaugcuuuggccuuucaaaguuuuuuguaggccauguagaaggugcuguagaaaaaaugaaggauacaacaaacuggcugaagaagaagagcugagagacauaauuagaaaguucaguaaaaguggugaacuuaucaacaaagaugcaaaagauaagagaacucuugcaagacuauucaugucugacaacccaaaauuaaaaaaggaaaaaaaacuuucugaaauugcuuaa

SEQ ID NO: 4106 - RNA, 4656 nt, Artificial Sequence
  derived and/or modified CDS sequence (wt) from DUGV(IbAr1792)__KU925456.1__GP
augucuaagaggguacugaucauagccguagugguuugucugguauucaccacucaaaaccagauagccggcaaccacacaacagccaacagcggcagcccguccacaaaagaggcaagcagcaugccaacagucagcgacacuccacaaacaaccaccaccuccacugcaguguccaccaccaucaccgcaaccaccacuccaacagcuucauggaccacacagagucaauauuuuaauaaaacaacacaacaccauuggagagaagaaaccauggucucaaggaauccuacugugcugaacagacagagaagagcaaguucugugaaagaacuacucaacaccaaguucuuaauguuguuagguuucauuccaaagggugaagucaaucaccuagaaaaugccugcaacagggaagggaaaaacuguacagaauugauacugaaagaaaggauagcucgguucuuuucugagacagaaaaagagucauguuauaacacuuaccuagaaaaacaccuuugcaguguuagcccugaaguuagucucaccccuuacaggguccucgggcuaagagaagacauuuugcuaaagaaaaucgaccguagaaucaucagauuugaagcagacucccaaagagugaccugucucucagcaucucuacuaaaaccugaugucuuuauuagggaacagagaauugaugcuaagcccuccaacgguccuaaaauagugccuguggacagcgugcgcugcauaaacuuagaagcuaacguagaugugagaucaaacaaauuagugauacagucuuugaugaccacaguuaaaauuagccugaaaaacuguaaggucguagucaauucuagacagugcauccaucagcaaacagguucugguguuaucaaagucccaaaauucgaaaagcagcagggugggacuuggucaagcuacaucgccgggguguacacagcaaccauugaccuguuagaugaaaaaaaccaaaacugcaagcuauuuacagaauguauugucaaagguagagaguugguuaaaggacaaagugaacuuaaguccuucaauauagaaguccuccuaccgagagugaugaagacuagaagaaagcuguuagcugucacugaugguagcacugaauguaauucagggacacagcuaauugaaggaaaguccauagagguccacaaacaagacauaggagggccagggaaaaagcugaccauuuguaacggcacuaguguucucgauguaccccuggaugaaggacauggaugcuacaccauuaauguaaucacguccaaaagggcaugcagaccaaagaacagcaaguuacaguguucaauugacaaagagcuuaagccuugugacucaggcaaguguuugaguaucagccaaaaaggagcaggccacauuaaggugagcagagggaaaaccauucuuauuaccgaaugcaaagaacacugccagaucccaguaccaacuggaaaaggggauauaaugguggacugcucaggaggccgucagcacuauuuggaggugaacaucguugauauccacugcccuaacacaaaauucuuaggaggaauaaugcuuuauuucuguagaaugucaagcagaccuacaguagcauugcuucuuggcaucuggauuggcugcggcuauauacucacaugcaucuucucauuuuugcuauaccacuuaauuuuauucuuugcaaacuguauaaaacagugcagaaagaaaggagagcggcuuggagaaaucugugucaagugcgagcagcaaacaguuaaccuuauggaccaagagcugcaugaccucaauugcaauuucaaucuuuguccuuauugcugcaaucgaaugucagacgaagguaugagcaggcauguagguaaguguccuaaaagauuagaaagacuuaaugaaauagagcucuaucuaaacuacaagcgagugccuucuugccuaagguguaugcuaucaacuucuauaagcguaggcauuuucuugaaaagaacaacuuggcugguuguacuucugguucuguuaggauuagccauuucaccaguucaaggagcuccagcagaggucaguaauguuaaacaggacggugacuacaguaucugcuacuuuauuuuugguuguuuggugacagcugcacuuuuguugaaggucaagagaacaaacucuaauggcauugugguaguggucgauagcuuuggaagauguccauacuguaaugaauucacugauucauuauuugaggaagugcuucacgauacacuaugcagucucugugucuguccuuucugugagaaacaggcucuugaucuggugacccuugaagaacaugucaaagaaugcuacaaaguuacaacuaggaaggacauauucaagauauuagggagaaaguucaccaaugcucuaguuagaagggaaaaacuguucacaacaggacugcagcucuucauaaauaaaacaaauguugucgucuuugcucucauuaugugcuucuugcuacuguuaacaggacauaacgcaagugcuuuugauucuggugacuugccagaugggauaugggaagaaucaagccaacuuguuaagucauguacacaguuuuguuacauagaagaagaugucugcuacugcccugcugagaauggcguaggaaggaaauugcuguucuucaauggccuucagaauucagugaaaagacuuucagauucucacaaguuguugacaagugucucaauugaugcaccuuggggugcaauuaauguugaaucaaccuggaaaccaacacuggcagcauccaacauugccaugagcuggagcuccacugacaucaaaggugagaagguuauacuaucaggaaggagcacauccauaauaaagcuuaaagaaaaaacuggugugaugugggagcuugggucagaacuagcaucagaaaaaaagaaacuuuuaguuucgauaauggauuuugcccaagucuacaauucaguauuccaguacauaacaggugauagacuacuaagugaauggccaaaagccgucugcacaggagauuguccucauagauguggcugccaaacaucaacuuguauggccaaagaguggccacacacaagaaacuggcggugcaaccccacaugguguuggggaauugguacugguugcaccugcugugguauggauguggaaaggccauuuaauaaauaucuugguguuaaguggucaacagaauaucuuagaacugagguguuggucugcguggaggucacggaugaggagaggcacugugaaauugucgaggcaggaaccagauucaacauuggcccuauaacaauaacgauuuccgauccccaaaacauuggaaguaagcuuccagaaaguuuaaugacaguccaagaaauugaugacagcaacuuugucgacauaaugcauguugguaauguuaucucugcugacaacaguuguaggcuucaaagcugcacucauggcagugccggugacuaccagauuuacagcacugacagcuuaaucaaagaugaucacaguucuggacucaaccuagcuguguuagaucccaaagucaacaguagcuggcuaucaugggaagggugugacauggacuacuacuguaauguuggcgauuggccaaccuguaccuacacugguguagugacucaaaacucagagaguuucucaaaccugaucaacauagaaaaagauuacacacaacgcuuucauuuucacucaaaaagaaucucagcaaaaggucacacacuucaguuagacuuaaaggcaagaccuaaccaggauggaggugaagugacagcacugauugaaguugaugguauggaguuacauucaaagacaauaaggcuaagugguauaagacuaacuggacugaaaugcagugguuguuuuaguugcacuucuggcauaucaugcagcgucaaugccaaguugacuucuccagacgaauuuacacugcaucugaggagcaccagucccaaugugguaguggcagaaacuagcauaauugcaagaaaggguccaagugccacaacuagcaaguuuaaaguguucucuguucgugauacaaagaaaauuugcuuugaggugguggaaagagaauacugcaaagauuguucuccugaugaacucacuacaugcacugguguugaguuagaaccucccaaagacauauuguuagaacauagaggaacaauaguacagcaccaaaacgacacuugcaaaucuaagauugacuguuggucaaauucuauaaguucauucgcaucugguauaggagauuuuuuuaagcauuacauuggaagcauugcugucggaauacuuggcacgguucuuccuuucgcccuuuuaauucuuuuuuucauauacggugacaaaaugcuuuggccuuucaaaguuuuuuguaggccauguagaaggugcuguagaaaaaaugaaggauacaacaaacuggcugaagaagaagagcugagagacauaauaagaaaguucaguaaaaguggugaacuuaucaacaaagaugcaaaagauaagagaacucuugcaagacuauucaugucugacaacccaaaauuaaaaaaagaaaaaaaacuuucugaaauugcuuaa

SEQ ID NO: 4107 - RNA, 4884 nt, Artificial Sequence
  derived and/or modified CDS sequence (wt) from NSDV(Jilin)__NC_034391.1__GP
auggugucguuggaaaaaggguugauccucuugcugcugaugcacaucgcaauugccuccaccggagggucccuuggguugccuggccuaaauggugaggaccacacugacgauccagagguugguggcgaugguccaacugaggaguacacagaagaugacccugaaucaacaacggucucgauaccuacgacucccccagucuuaggacaggggacagaagaggugccugcaacuucuggagaggcggaagcaggguauucuaccacggaugugccggacacugugucugaaaagguggaagaugaacaggacacgaccccuagcacgcaggugaccccagaccagccagaacaaaguacgacuaguuugccugaccccuggacagcaaucucgacaaggauugguagggagcuauuaagcguggagucugacaccacaaagucaagcuuggucacuguaggacauccucaacagccaauauucuuggaugggcagccgguagaagaagugacucauccagucaaugaaagagacguuacugaagcucugaggaaguaugacaaaaugaaaaaacugcuuagccaaagaauuuuaucaaaaaugggcauggccagagacuucacagaugaggaguuagacgucuggugucacgagcgguuugacaacuguagcucuaaugacauugaaaauagaaucagggauuuuuuucucaucagugaucagacugagugcuuugaugaagugcuagugaaaaggcuaugugaaucaaccaacccuauuguaggcgagccuuggcagguggcagguaucaaggaagaaauuguucggagagaaauggguagaagaaucuuuagauucuucacuccaacuuugaaggugacaugugugucaggcucauugaauccuucagaccaguuugugagguucuaugauccugucauagaacgaacuucaggccccacuauccaaaacuaugauagcaugcacugcuuaaacauagagaauggguuagcuaaaccauccaaaaugguuguucuuaauguauuaaugacaacaguagagguuagacuggaauccugccgugcguucauaaaugcacaucaaugcauuuacacacaacaugcagaugggcaagugauggugcccacuuucguggaccacagugguacaaggagaaccauuggugcguauacaaugagcuucaacuugacugaugaaagaaauagagcaugcaucaucagaacaacuuguguggucaaaggaaaagagguaaagaagggacagagucaauugagagguuucccaacaaguaucagacucuucaagucugugacaggcaaaagaaggcucauggcagaagaaggagacuggacugacugcggaucuggcacacagcuugauaugacaauggcugugucuguacacaaugacaaaaaaggaggaccugguaagaagcucaccauaugcaaugguaccacagucucagauucaacacucaaugaagggcuuggauguuacacgauuaacaaggugauaacaggaaaggcaugcaaaguaggaaacuccacaggauccugugaggugcaaacagagcuacagaagugcgagacuggaaaaugcauacuggugaaacagaaaagcaaaggaguggugaaacugaaaagaggaaagacuguaaucauaacugaaugccaaggaagcugccucuuugccaucccacaggacacaggagacaucacaauugacugcucuggaggaaggcagcauuaccuggaaauuaauauaguugacauacacuguccagggaaagacaaauggaaaggguuuaugcucuacauaugcagggugucaagcaggccuuuaauugccuugacauuuggauuguggcuugcagcaggcuaucuaauaacaugccuuguuuccuuuaucaucuacaaugcuguccuacuucuuaguauugcuaucaaaaaagugaggcaagggagagaaaagaaaggagaccugugcauaaaaugugaacagcacugcaugaaccuguaugaucaagaacuacaugaacugaacugcagcuucaaccucugcccguacugugccaauaggcuuucagaugaaggacuacccagacacguaccaagaugcccaaaaaaaucagaaagauuggaggagauugagcucuacaucaauuauaccagggucccgugcauucugagauggauacuaucaaccucuguccaaguagggacggccgugaagagacugucuugguucagugugcuaguaacccuuuuuauucugacaauuucaccggugcagggauucccauuggagaguccaccuauuggcgcagcaacugacaguagaaucauguaugggguagugggguucauguuugcacuaauaaugaugcuuaaucuuaaaaaaucacacuacgguuccaucuuucaugugaucgauggcuucggacguugcaaucucugugacacaagaauugacagcuugauggaagaaacugcccacgaucucuguugcauguuugacuguugccccuacugucaccgagugucagaaaguaauggaucccacugcuuccacgugaggauauguguggccaaagagauuuccaaaaagauguugaaggcaggaggaagauuguucaccaacaaacuugucucuagagaagggacuuuugccaacaggauccaacuccuuuauagaagguccaaaguuguaagcacacuugugguuacaguccuucuacuucuuguccuuuugaagccaaccacugccuuugacucaggcccccuucccgacggcaccugggaagaagaagaaaaacuugucaggaacuguggacaagaaugcauucuagaucaaggcgagugccuaugcccaggagagcacagagccgggagaaaacuccuuuuccuaaaugggcuccaagacgccgcacguagaaugacugaaucucacagacuccucacaaguguuuccauagacgcccccuggggugcaauaaauauagaguccacuuucaagccuguacuugcugcaucaaacaucgaccugagcuggaacucagcagaagaacaaggagacaagauuauacuuucuggaaggucaacaggaaucauaaaacuccaggaaagaacuggucugauguggaagaugucaucagaaaaggcaucagaaagcaaaaaccuucuuguuucagugauggauuuuucccagcucuacaauuccauauuucaguauauaacgggugacaggagucuuucagaauggccaaaagcugucugcacaggagauuguccggauaggugcggcugucaaacaucuacauguuaccacaaagaauggccgcacacuagaaacuggagaugcaaucccacuuggugcuggggcaucgggaccgguugcaccugcugugggauggauguugagagguacuuuaauaaauacuucggugugaaaugggccuuagaauauguuagaacugauguaguaguguguguggaacucacaaaugaggaaagacauugugaccuugugcaggccggaagccgcuuuuccauagguccugugucuguaacucugucugacccccagaauguggugaaccgucucucgagcaacaucaugacaauucaagaaauugcugauaacggcaucuuggacuugaugcaugugagcaaagucauauccgcagagaaugccugcaaacuucagagcuguacacauggaagcccaggagaucuccaaauccuucacacugacaaccuaauaaagggugacaugucaggagguaucaaccucgcucaccuggacccacaagucaauacaagcuggaugucgugggaagguugugacuuagauuauuacugcacaguuggugauuggccuagcugcacguacaccggagugaauucuauaaauacagauaguuucaccaaucucauaaacacagagaccgauuacacaggcaaguuccacuuucacuccaaaaggauuucagcuagagaugacacuuugcaaauggaucugaaagcaagaccuaacuccggaggcggugaaaugacaguuuugguagagguuaauggguuggagcugcauucaaaaaggauaagucucaaagggcuacggcuaacuaauuugaagugugaugguugcuuugccugcagucaaggccugacaugcacgauaacugcaaaguuagagucaccggacgaauuuaccauccaccugagaagcaccaguagggacguggugguugcugagaccaguguaacagccaggaagguagagacaggagcuaggagcggcuucagagccuuugcaguaagggauguaaagaaguugugccuggaagugguugagaaggacuacuguccuuccugcaccguagaagauuugaagauauguguugaugugucucuugagcccccuaaagacauacucauugagcacaaagggaccaucauacagcacuacaacaaaaguugugaugagggauauaauugcuggguuggaucuguuucuggauucuuuguuggagugaaagacuuuuuugaaaagaaccuuggagguguacuuauuggucuuguaagcacaauacuuccuuuagugcugacaguucuguucuuuauuuauggcaagaagcuguucugccugugccgacugugccacaagaaauguuguagaggcucaggaaggggaagagauggcuacaguagauuaucacaagaggaggaaaucaaggaaauaauaaaaaaauucagcaggaacggcgaacuacuagggaagggugaaaaugacaaaagaacuguggcaaggauguucauggaugggcaaaguacaaagaaggcaaucaaggaaguagcuuaa

SEQ ID NO: 4108 - RNA, 4884 nt, Artificial Sequence
  derived and/or modified CDS sequence (wt) from NSDV(708)__EU697952.1__GP
auggugucguuggaaaaaggguuuuucuuccuacugcuguugcacaucguuacggccuccacaggaggacccccuggguugcccggaccaaaugguaaggaccagacugaugguccggaagguggcggugaugguccuacugaggaauacacagaagaugauuuugagucaacaacauucucgauacccacgacccccccagucucagaacaggaugcuaaagaagugucugcaacuucggaagaggcagaaguggaggauucaaccuugauugugccaaaaacuaugucugaaaaagugggagaugaacaaagcacaacuucgaacaugcaggugaccacaagccaaccagaacaaagcacaacuggcaugccuggucccuggauggcaagcucaauaaagauagguagagaguuguugaguguagagucugacaccacaaagucaagccuggucacugugggguauccucaacagccgauauuccuugaugggcagccuguagaagaggugacccacccugucagugaaagagauguugccgaggccuugagaaaguaugacaaaaugaaaaaacuccuuagucaaagaauuuuaucaaagaugggcauggccagagauuucacagaugaugaguuggaugccuggugucaugagcgauuugacaacugcagcuccaaugacaucgagaauagaauuaaggacuuuuuccucaucagugaucaaacugagugcuuugaugaagugcuggugaaaagguugugugaaucuaccaaucccauuauaggugagccuuggcagguggcagguaucaaggaggaagucgugcguagagaaaugggcagaaggaucuucagauucuucacuccaacccuaaaggugacaugugugucaggguccuugaauccuuccgaccaguuuguaagguucuauaauccuguuauagaacgaacuucaggcccuacuauccaaaacuaugacagcaugcacugcuuaaauauagagaacgguuuaauuaaaccauccaaaguggucauccuuaaugugcuaaugacaacaguggaagucaggcuggaaucuugccgugcauuuguaaaugcacaccagugcauuuacacacaacaugcagaugggcaagugagaguacccaccuuuguagaccacaguggcacaaaaagaaccauuggugcuuacacaaugagcuucaaccugacugaugaaaggaacaaagcaugcaucaucagaacaacuugugugguuaaaggaaaagagguaaagaaaggccaaagucaguugagagguuucccaacaaguaucagacuuuuuaagucuguaacaggcaaaagaaggcucauggcagaagaaggagacuggacugacugcggaucuggcacacagcuugauaugacaacagcugugucagugcauaaugauagaaaaggaggaccuggaaagaagcucaccauuugcaauggcaccacagucucagauucaacacucaaugaaggacuuggauguuacacgauuaacaaagugaugacaggaaaagcaugcaagguggggaacuccacaggauccugugaagugcaaccugagcuacagaagugcgagaccggaaagugcauacugguaaaacagaaaaauaaagggguggugaaauugaaaagagggaagacuguuaucauaacugagugccagggaagcugccuuuuugccaucccgcaggacacaggggacaucacgauugacugcucugggggaaggcaacacuaucuggagguuaacauuguggacauacacuguccagggaaagauaaauggaaaggguuuaugcucuacaugugcagggugucaagcaggcccuugauugcuuugacauuuggauuguggcuugcagcaggcuaucuaauaacaugccuuguuuccuuuaucaucuacaaugcuguccuacuucuuaguauugcuaucaaaaaagugaggcaagggagagaaaggaaaggugaccuguguauaaaaugugaacaacacuguaugaaucuguaugaucaagaacuacaugaacugaacugcagcuucaaccucugcccuuacugugccaacaggcuuucggacgaaggacuuccuagacaugugccaagaugcccaaaaaaaacagagagauuggaagaaauugagcucuacaucaacuauacaagaguuccuugcauucuuagauggauacugucaaccucuguccagguaggaacggcugugaagagauuaucuugguucaguguguuggugauccuuuuuguucugacaauuucaccaguacagggguuccccuuagagaacacacccauugguucaacaacugacaguagaaucauuuacggagugguaggauucauauuugcacuaauaaugaugcucaaucuuaaaaaaucacacuacggcuccaucuuccaugugaucgauggcuucgggcguugcaaccuuugugauacaagaauugacagucugauggaagaaaccgcccacgaccuuuguugcauauuugacuguugcccuuacugucaccgagugucagagaguaaugggucccacugcuuccaugugagaauguguguagccaaagaaauuucuaaaaaaauguugaaggcagcaggaagacuguucaccaauaagcuuguuucuagggaagggauuuuugcuaauaggguccaacuccuuuauagaagguccaagguugugagcacauuugugguuacaguucuucuacuucucgucuuuuuaaggccagcaacugcuuuugacucaggcccucuucccgauggcaccugggaagaggaagaaaggcucgucagaaacugugggcaagaauguguacuggaucaagaugagugucugugcccaggggaaaacagagccgggagaagacuucucuuucuaaauggacuucaagaugcuguacguagaaugacugaaucucacagacuucucacaaguguuucuauagaugccccuuggggugcaauaaacauagagucuacuuucaagccuguacuugcugcaucaaacaucgaccuaagcuggaacucagcagaagaacaaggagacaagauuauacuuucuggaagaucaacaggaaucauaaaauugcaagaaagaacuggucuaauguggaggaugucaucugaaaaagcaucagaaaguaaaaaccuucuuguuucugucauggauuucucucagcucuauaauuccauauuucaauacauaacaggugauagaagccuuucagaauggccaaaagcugucugcacaggagauuguccggacaggugcggcugucaaacauccaccuguuaccacaaagaauggccucacaccagaaacuggaggugcaacccuacuugguguugggguaucgggacugguugcacuuguugugggauggaugucgagaaguacuucaacaaauacuucggugugaagugggcucuagaauauguaagaacugaugugguaguguguguagaacucacuaaugaggaaagacacugugaccucgugcaggcuggaagccguuucuccauaggcccugugucugugacacugucagauccccagaauguggugaaccgucucucgaguaacauuaugacaauucaagagauugcugauaacgguaucuuggacuugaugcaugugagcaaagucauuucagcagagaacgccuguaaacuucaaagcuguacgcaugguaguccuggggaccuccagauccuucauaccgacaacuuaauaaagggugacaugucaggcgguaucaaccucgcccacuuggacccacaagucaacacgagcuggaugucaugggaagguugugacuuggauuauuauugcacgguuggugacuggccuagcugcacauacacuggaguaaacuccauaaauacagacagcuucaccaaucuuauaaacacagaaacugauuacacaagcaaguuccauuuucacucaaaaaggaucucagccagggaugauacucugcagauggauuugaaagcaaggccaaauacugggggcggugagaugacaguuuuaguagaagucaaugggcuggaacugcacucaaaaagaauaaaccucaaagggcuacgacugaccaaucugaagugugacggguguuucgccuguagccaggguuugacauguacaguaauugccaaacuggugucaccagaugaguucaccauccaccuaagaagcacuagcagagacgugguaguugcugaaaccaguauaaccgccagaaagguagauacgggagcuaggagcagcuuuagagcuuucgcagugagggauguaaagaaguugugccuagaagugguugagaaggacuacuguccuucuugcaccguggaugauuugaagauguguguugaugugucucuugagcccccuaaagacauccuuauugagcauaagggaacuauuauacagcacuacaacaaaagcugugaugaaggguauaacugcuggguuggaucuguuucuggauuuuucguuggggugaaagauuucuuugaaaagaaccuggggggugugcuuauuggacuugugggcacaauacuuccuuuaguauugacaauucuauucuuuauauaugggaaaaaauuauuuuacuugugcagacugugccauaagaaauguuguaaaggcucaggaagagggagagaugguuacagcagaauaucacgagaagaggaaaucaaggagauaauaaaaaaauucagcagaaacggugaacuucuugggaagggcgagaaugacaagagaacuguggcaaggauguucauggaugggcaaagcacaaaaaaggcaaucaaggaaguugcuuaa

SEQ ID NO: 4109 - RNA, 4875 nt, Artificial Sequence
  derived and/or modified CDS sequence (wt) from NSDV(779)__HQ286599.1__GP
auggcauuaguggcaaaggguuuaauccucaugcuacuacuauauauguucaaggccucugaagucaaccuugaacucccuaguuggaacagcacugaagggacagaguaugcugaugaacugcccacugaaccuccuucggaagaggagcccaaacuagcagcaguuagcacggucaccacaccagcaccucccaaagagucuacugaagacaccaucgagagcccugauggaggggaaacaauggcacccacaaccccagcaccugugacugauucagccaguaaacuggaagaggagccaggcacaacccagcaggcccagucaacucaaaugcagaacagccaggcaccgauaggaaugccugaagccuggucgacaagucccucgagaguugguagaaaaccucuaagugcuagcccugaugugucugagccagaccagaacacagaagcacaaacacauccaccagucuuccuugacggacggccuguagaagaagaagaacacucaguuggcacaagagauguagcuagugaucuaagagaauacaaucaaaugaaacaacucuugagccaaagaauacuagcaaagauggguauggcuguagacuuuaccgaugaugaguuggacacuugguguuacagaagauacagcaauuguagcucaaaugacauugaaucaagaauuagggacuucuuccucauuacugauaggucugagugcuuugaugaaguccuggugaaaagauugugugagaccaccagcccgauuauagauagggcuuggaagauagcaggacucaaagaagaaguugucuugagggagaugggaagaaggaucuuuagguuuuuuacaccugcccuaaaagugacaugcaugucuggcucauuaaaucccucuaaucaauuuguaagguucuacaaucccacuuuagaaaggacaucaggcccuaccauccaaaacuacgauggcaugcacugucuaaacauagagaaugggcucaucaaaccuuccaaagugguuguuaucaauguucugaugaccacaguugacaucagacuggaauccugccgagcauucauaaaugcucaacaguguacuuauacccaacaugcugauggacuggugagggugccuaccuuuguggguccucauggugaaaagaggauuauuggugccuauaccaugagcuucaaccuaacugaugaaaagaacaaagccugcacaaucaagacaacuuguguuguuaagggaaaggaaguaaaaaagggacaaagccaacuuagagguuuuccuacaacuaucaggcucuuuaagucuguaacaggaaagagaaggcucaugucaaaugaagaagaguggacugaaugcgguucagggacgcaacuaaacauggcaacagcugucucagugcacaacgacaagcuaggaggaccugggaaaaagcucacuaucugcaauggaacaacagucucagacauugcucuaaacgagggucuugggugcuacacaauaaacaagaucauuacagggaaggucugcaagacaggcaauacaacagguucuugugaagugcaaccagagcugcagaaaugugagacaggaaaaugcauacugaucaagcaaaagaacaaggguguugugaaauugaagaggggcaagacugugauuauaacggaaugccaaggaagcugucuuuuugcaauaccacaggacacgggagacauuacaauugacugcucugguggaagacagcauuaccuggagaucaacauuguagauauacacugcccagggaaggauaaauggaagggcuucaugcucuacauaugcagagucucaagcagaccacucguugcucuaacauuuggaauauggcuuacagcaggcuacuugauaacuugucuggccuccuucauccuguacaaugccauacugcuuauuagcauugcaaucaagaaacugaaacagaagagagaaaaaaaaggugaccuauguauaaagugugagcagcacugcaugaaccuguaugaucaggaauugcacgagcuaaacugcagcuuuaaccuauguccuuacugugcuaauaggcucucagacgaugggcucccaagacacgugcccagaugucccaaaaggggagagagguuagaagaaauugagcucuauaucaauuauacaagaguacccugucuucugcggugggcgcucucaacuucuguccaaguuggcacaguuauuaaaagauugucuugguucggcgugcuacuaacacuauucuucuugacuauaucuccugugcagggcuuuccacuggaaaauccacccaucggcacagcaacugacagcaacaucaucuacggacuggccggguucauauuugcgcucgugcuaaugcugaaucuaaaaaaaacacacuauggaucuguuuuccacgugauugacggccuuggacucugcagucucugcgauacaaggaucgauagucugauggaggagacugcucaugagcuuugcugugccuuugacugcugucccuacugucaucaggugucugaaagcaacgguucucacuguuuucacaugaggaucuguguguccaaagaaauaucaaagaagaugcuaaaagcagcaggcaaauuauuuaccaacaaacuugucucaagagaaggcuuuuuugccaacaaaauccaacucuuguaccagaggucuaagguugugagcacacuuauuuuaacaguccuucugcucuuaauuaucuugaagccugcagcagccuuugacucagggccucuucccgacgguaccugggaggaagaagagagucucauaagaagcugcgaucaagagugugugcuugaacaggaugagugccugugucccggagaacauagggcuggaaggaggcuccuuuuucugagcggccuucaagaugcugcaaggaggaugacagagucucacagacuacuuacaagugucucgauugaugcgcccuggggugcgauaaacauugaauccacuuucaagccucuucuugcagcauccaacauugacuugaguuggaacucagcagaagaacagggagacaaaauuguacugucagguagauccacagguaucauaaagcuacaagagaggacuggucugauguggaaaaugucaucugaaaaggcuucugaaaguaaaaaucuucuugugucuauaauggacuucucacagcuuuacaacucaauuuuccaguacaucacaggugacagaagccuuucggaauggccaaaggcuguaugcacaggagagugcccugacagaugugggugucaaaccuccacuuguuaucauaaagaguggccccacaccaggaacuggagauguaacccuacguggugcuggggcaucggaacuggguguacuuguuguggaauggauguugaaagguacuucaacaaguacuuugggguaaagugggcauuggaguauguaagaacugauguggugguuuguguggagcugaccaaugaggaaagacacugugauuuaguucaagcuggcagucgcuuuucuauagggccagucucugugacacugucagacccucaaaaugugguaaacagacuaucaaguagcauaaugacaauacaggagauaucagacaacgggaucuuagaugucaugcauguuaguaaaguaauuucagcagaaaaugcuugcaaacuucaaaguugcacacaugggagcccaggagaucuccagauccuucacacugacaacuuaauaaaaggugaaaugucauccggcauaaaucuugcucaccuggacccucagguuaacacaaguuggaugucgugggaggguugcgaucuagacuacuucuguacagugggagauuggccuagcugcacguauacaggagugaacuccauaaauacagacagcuucacaaaccucauaaacacagaaacugauuauacaagcaaguuucauuuccacucaaaaagaauuucugcuaggggugacacucugcagauggauuuaaaagcaagaccaaacguuggagguggagaaaugacaguucugguggaagugaauggccuggagcugcacucaaaaaaaauaagccuuaaaggauuaaagcugucuaaccucaagugcaguggaugcuuugcuuguaguccuggucugucgugcacagugauugccagauuagaaucaccagaugaguucacuauacauuuaagaagcaccagcagagauguggugguugcugaaaccagugugacagcuagaaaggcagaaacgggggccaagagcaguuuuagggccuuugcugugaaagauguuaaggagauaugucuagagguggucgagaaggaauauuguccgucuugcuccauagaagacuugaaaauuugcauuagugucacucuugagccuccaaaggacauucucauugagcauaaaggcaccauuguacagcauuacaauaaaagcugugaugagggcuacaacugcuggauuggaucugucucuggguuuuuuguagggguuaaggauuuuuuugaaaaaaacuuugggagugugaucauuggaauugucagcacaguucuucccuugauacucacuguuuuguucuuugucuauggaagaaggcuauuuugucugugcagguuaugucacaagaaaugcugcagagguucaucuagaggaagagacgguuacagcagacugucacaagaagaagaaauaaaagaaauaauaaaaaaauucaacagaaauggagaguuacugggaaggggcgagaacgauaaaagaacuguagcaaggauguucauggauagccaaagugcaagaaaagcaguuaaagagguugccuag

SEQ ID NO: 4110 - RNA, 4302 nt, Artificial Sequence
  derived and/or modified CDS sequence (wt) from BUNV__NC_001926.1__GP
augagaauucuaauacugcuuuuagcagucacucaacuggcugugaguagcccaguuaucacuagaugcuuucauggugggcaacugauugcagaaaggaaaucccaaacaucgauuucagaauucugcauuaaagaugacguuucuauguuaaaaucagagauugucuacacaaaaaaugauacugggauuuuuggccacaguaaaguguuucgucacuggacgaucacagacuggaaagcaugcaacccuguuguuacggccggugguaguauaaauguuauagagguugauaaaaaucuaaaccuuguaacuagaaauuaugugugcacaggggauugcacuauaacaguugauaggaaaaaugcccaaauuauauuucagacagacaaacuuaaucauuuugaagugacaggaacuacuaucagcacuggcugguuuaagucuaaagcaucuguuacucucgauagaacaugugaacauauaaaaguaagcuguggaaagaaaacauuacaauuccaugcuugcuuuaagcaacacaugucuuguguucgauucuuacacaggagcauacuaccagggucaauggcaauuucgaucugccaaaauauugagcugauuauaauaacaauauuggcauuauguauauuuauaauuaugauaaucuuaacaaaaacauacauuugcuacguguugaucccaguguuuaugcccauagcuuuugcuuauggaugggcguacaacaggaguuguaagaaaugcacuuguugcggauuggcauaucaucccuuuacaaacuguggcucauauugugucuguggcuccaaauuugaaacaucggacagaaugaggaugcaccgagaaucaggguuaugucaggguuuuaaaagccugagaguagcaagaaggcuuugcaaaucaaaaggcucaucauugaucauauccaucuuacucucagugcugauucuauccuuuguaacacccauagaagggacucucacaaacuacccuacugaucagaaauauacuuuagaugagauagcagauguccuucaagcuaaaacacaugaagauucuacaaaauacuauauaauauuauauacaucacucuucggugcaggucugaccaucauuuuugcaggaguagcauugggguuaacaauuauacuagaaguauuaaccaagauuaauguuauuuuuugcaacgaaugcaacauguaccauagcaaaaaaucaaucaaauauguaggugauuucacuaauaaauguggguuuuguacgugugggcugcuagaggauccagaggguguuguuguacauaaagcuaaaaaauccuguacauauucauaucagauuaacugggucagaggcaucaugauauuuguugccuuuuuauuuguaauacagaauacaauuauaauggucgcagcagaagaagacugcuggaaaaaugaagaauuaaaagaagauuguguagggccuuuaauugcaccuaaggauuguacugauaaagaccauaaaaccuacuugagugaggcuucauuguuagcaacagcaaagaaaauaacucagguggaugcugaaaauguggagauauuggggaaaacuauggaaucagcaauuagaguaauugaaagacagaagacauaccacagaaugcacuugcuugaggcaguauuucuaaauaagcacugcgauuauuauaaaauguuugaacauaacaguggauauucccaaguaaaguggaggaugaugauaaaaacacaacacuuugauaucugugccuuacaagcaaauagcccguuuugugcucagugcauugcugacaauucuugugcgcaagguucuugggaauuugauacacauaugaacuccacauauucaaguaaagucgacaauuuuaaacaugacuucucucuauuccucagaaucuuugaagcagcauuuccaggcacugcuuauguucacuugcuaacaaauauaaaagaaaagaagcccuaucaggcagucagcaugauugagaaaauaaagaagaaguuuccgaauaauaaacugcuuauuggauauuuagauuuuggcaaguacuugcuaggcuuaagucaugcaagcacauacgaguugcaacagagacaacuagauaaguuauaucagccaacagaauuaacccgaucugguggucaacaaacaucauuagcaaauucuguaguaggucaagcaacgaaagaauguaaaaaguacaaagauguuaguugcuuaagcccaagauuuggaauuccgcuggaagauuuaauaagcugcugugaccaaccaaauuacaauauuuauaaaaagccaaaaaaagucuacaaagcucaugacaaagaagaaacauggugcauuaaugaucagcauugccuaguagacuuugucccagcugaagccgauacuguagaaaaauugaaaccuaugaaauguugguuaguugacccuggcaagaaugaugaugucuacucuauugcaauaaaaacauguagagugguugauaagggaguuuguacuguuaauucacaaaaauggaauauaaucaaaugugauucugguccgcucuacuacagugaccacauaccaggggaagauacaggcaaugauauaggacauuauuguguaucagcaggaugcaaaacugacagauacccaauuaauccugauguuguuacugacugugugugggaauuuacuucuaggaaaucacaauauauaggcaagaucuccaugcagucucuugaagauuacgaaaaggcuuuaacugacagauugacccauaccuuggaaaccuauaguuuugccccguuagaaaaucucccgcauauaaaaccaguuuacaaauauauuacugcacaaggagucgaaaacucagacgguauagaaggggcauucauaacagccaguaucccagccgcugggggcacuagcauaggcuacaauguuagaucaaaagauggcuucccacuccuugaucuaauaguuuuugugaagagugcugugauaaaaagcacauacaaccauauauaugauacugggccaacaauuagcauaaauacaaagcaugacgaacauugcacuggccaauguccaagcaauauagaacaugaggcuaacugguugacauuuucacaagaaagaacuagcagauggggaugcgaagaguuugggugcuuggcugucaacacagguuguguguuugggucuugucaagauguaauuagaccagaaacaaaaguuuacaggaaagcuguagaugaaguuguuauuuuaacaguuuguauuacauauccaggacacacuuuuugcacagaaauuaaugccauagagccaaaaauaacggaagaaauugaacuccaguuuaaaacaguugacacgaaaacacuaccauauauaguagccguaaacaaucauaaacuuuauaguggucagauaaaugauuuagggacauuugggcaaaugugcggaaauguccaaaaaacaaacagcagcauuuuaggaacugggacaccaaaauuugauuauacuugccauggugcuaguaggaaggauaucauuguuaggagaugcuauaauaacaauuuugacuccugcaaacuucuaaaggaagaaacacagcuuauauuuaaugaugaccaugauacaauaacuguuuauaauacaaaucacuuaauuggugaguuagcuauaaaauugauauuaggggauauccaguauaaauuauucacagaaacauuggaccuccagauugaugcgaaauguguuggcugcccugauugcuuugagagcuauuccugcaauuuccaaauaguaucaaauauagacacaaucugcagccuugaagggccuugugacacauuccauaauaggaucucaauuaaagcaaugcagcaaaauuaugcuguaaaacucuccugccagaaggauccaagaccaucagggacuuuuaaaauuugcaacagggaauauacuguugucuuccauacaguagcaaaagaugacaaaauagaaauaaauguuggagaccagacuucauucauuaaagagaaagaugacaggugcaaaacauggcuguguagggucagagaugaagguauuaguguaauuuuugaaccaauuaaagccuucuuugggaguuauuucagcaucuucuucuacauaauuguuguuguaguagugggauuuuuaauaauauauauuuuuaugccaauguuuaugaaguuaaaggaaguguugaaagcaaaugagaagcuuuacuugcaagaaauuaagcaaaaguga

SEQ ID NO: 4111 - RNA, 4311 nt, Artificial Sequence
  derived and/or modified CDS sequence (wt) from BUNV(SFCrEq231)__KP063893.1__GP
augaagaugauucuucuaauaauaauacuaugugugaaccuugcugcugccaauccaguagcaacaagauguuuccauggaggucaauuaauagcagagacaagaucugcaacaucgauuucagaguucuguuuaaaggaugacguuucuaugauaaaaucggagauaaccuauacaaaaaaugauacuggcaucuucggccauagcaaaauauacaagaguugguuaauaaaagauuggaagcuuugcaacccaguaccaacugcagguggaaguauaaauguuauagaagugaacucugauuugaguuuaacuacaaaggcauauguuuguagcagagauuguacuauaacaauagacaaagaggaggcucagauuauauuccaaacagacaaacucaaccauuuugagguaucuggcacaacccugaguucagguugguucaaaacaaaagcuucuguaacauuggauagaacuugugagcauauaaaaguaacuuguggcaaaaaaacauugcaguuucaugcuuguuuuagacaccacaugucauguguaagauuuuuccacaacacaauauuacccgguacuauggucaauucaaugugucaaaauauagaacuaauuauaauauuaggcuuaacauuaaucauauuuacauuaaugguuauacugacaaagaccuauaucuguuauauucuaaugccacuauuuaugccuauugcauaugcuuaugggugggcauacaacaaaaguugcaaaaaaugcaauugcuguggucuagcauaucacccauuuacuaauugcggaucccauugugucuguggcuuaaaguuugaagcuucagauaggaugaggauacacagagagucuggccucugccaaggcuauaaaagcuuaagaauagcacgauuauuauguaaauccaaaggcucauccuuaauaauuuccacccuacuaucuaugcuacuucuaaguuuuaucacaccaauugagggaacaaugacaaauuacccagaaacaaggcaauacucucuugaagagauugcugauguuguugaggggcuuuuaucagagcaaaauauuaaagaauauguuguuuucuauacaucauuauucgggagcuuaauauuacuauuggcauucauuuuaucaaucacucugacaaaaguaacuaaugcucuagccagaacaaauguaauuuacugugaagaaugcucaauguaccaugcaaagaaaggcauaaaguauaauggugauuucacaaacaaauguggauuuugcacuugugaugaacaggaagaugaagagggcauaauaauacauaaaguaaguaaaaaaugcacauauagauaucaacuacagugggcuaagaucauuaugauaauauuaguuauguuguugaugaugcaaaauacaauacuuauuguugcugccgaaacagacuguuggacuaagaauucacuagaguuagauuguauugggccucuacucaccaucagugauugcucaaacaaagagaguaaaaauuaugaagaagaagcagcaaaacuuguuagucaauccaaaauaacacaggcagaugcagaacagguuacaauauuaggcaacacaauagauacagcacucaaagcaaucagaucacaaaaaacauaucaaacuaugcauuuauuggaaucaguguuuuugaugaagaauugugauuauuauagcaguuuugaacccaauaguggauacucucaggcaaaauggagauuaauugcaaagacaagucacuuugacauauguucuagacauagcaugcaccauuucugcagaugugucgcagauggcaccaaaugccaaaacggugauugggauuuugcuggagagaugaauaauauauacaguacuaaaaaugacuuuuaccuucaugacuugaauuuauuuuucaccuuacaugagacagccuuuccagguacaacugaauccuuauuuuaucagcugauugcaaaaaagaacacuacaggugcuucuaagcugcuugggaaauuaauuacaaaauaugguaacaacaagcuguucguugggauauggaaauucggccaauauuuauugacuuuaccauauguaaauacaacagaguuauccaagacuaggagagagacaauauugaaaacacaucagaucuugacaagaucucagggaggaagaucagaaucuaugucuagugcugaggugggucaaauagcuaaagaaugugcuaaugcaaagaauguugguugcauuaguccuagguuugggaucccuauugguaaucuaacugcuugcggaaauagcccuaauuauaaaauauauaaaacaccuaacaagaucuauaagucaaacaacagaggugaggugugguguucagaagauguucauugccuggccgauuuugaaccugcugacacagaaguagucaacaaaguuaagaagaugacaugcuucuugucugaugugaacacuagagcagauauuuucucuauugcaauuucugcaugcagaaugguugauaaaggaguguguacuguuaauggugcaaaauggaauauauugaagugugagaguggucuuuauuauuuuacugaucauagggaaggacaagacacuggaaaugauuuuggagaauauugcaucucucauaguugcaauacagagagguacccaaucaacccagacauauuaaaagaguguauaugggaauaucacucuaggaaaucaaaauauaucucaacuaucaacuuagaaucccuagaggaauuuaaaagggcaauguccgauaaauuaucucacacuuugaugguuuauaacuuuaaaccgacugcaaacuuaccacacauaaaaccaaguuauaaguuuauuacugcaaaugguauugaaaacucagauggcuuagaaucagcauauauacuuucaaguauuccagcuauaggaggaaugaguauagguuauaauauccaaacaaaagacaauuuccccuuacuagauuuaauagucuuuguuaaaagugcagugauaaaaacaacauacaaccauauuuaugauacuggucccacaauaggaauuaauacaaaucaugaugaacacugcacagggcccuguccuacgauaauaccacauaaagagaauuggcuaacauucucacaagaaagaacaaguaggugggguugugaggaauuuggaugucuagcaaucaauacuggguguguauuuggaucaugucaagauguaauacaucccgagacaaagaucuaucggaaagcuguugaagaggagguuguucuaacuguuuguauaaauuuuccaggcaauacauucuguacagagauaaaugcaauugagccuaaaauuacagaugagauagaacuucaguuuaaaaccguugauacaaaaacauuaccaaauuugcuagcaguucagaaucauaaguuauauaguggucagauaaaugauuuagggucauuuucccaaggaugugggaauguucaaaaaacaaaucagucaauacuuggugcugggacaguaaaguuugauuaugugugccauggugcaagcaggaaagauauaauaguucguagaugcuacaccaacaauuaugauucaugcaaacuacucaaagaagagagaucccugauauuugcugauaaccaugaaacuuuagaaguugcaaacacuaggcauuugauuggagaauugcaauucaagauuauguuaggagauauucgauauaaggccuuugcagaaaagccugagcuggaaauugaugcaaaauguguuggaugcccaucauguuucgaaagcuauucauguaauuuccaaauagugacuagcauagauacagucugcucuguugagggaccuuguaccuuguuucauaauagaauuauuaucacagcugcaaaacaaucauauggaguuaaaaugaguugcaagacaaagccaggaccaguugaagaauucacaauauguaaucggaauuauagaguaaguuuugcuacuauugauaaaaaugauaaaauugagauaaacacaggggaucaaacuucuuacauaguugagaaagauagcagauguaaaacaugguuaugcagagucagagaugaagggaucagugucaucuuugagccucuaaaagcauucuuugguaguuacuuuaguauagccuucuauauuaucauaggaauugcugcuuuauuccucauaauauauauuuuccuacccauguuuuucaaacuuagagauguuuugaaaaagaaugaguauuuauauuugcaagaauuaaaacauaaguaa

SEQ ID NO: 4112 - RNA, 4302 nt, Artificial Sequence
  derived and/or modified CDS sequence (wt) from BUNV(GSA/S4/11232/WT)__KM507339.1__GP
augaggauucuaauacugcuuuuagcaguuacuaaacuggcuguggguagcccaguugucacuagaugcuuucauggugggcaacugauugcagaaaggaaaucccaaacaucaaucucagaauucugcauuaaagaugacguuucuauguuaaaaucagagauugucuacacaaaaaaugauacugggauuuuuggccacaguaaaguuuuucgucacuggacaaucacagacuggaaagcaugcaacccuguuguuacagccggugguaguauaaauguuauagagguugauaaaaaucuaaaccuuguaacuagaaauuaugugugcacaggggauugcacuauaacaguugauaaggaaaaugcccagauuauauuucagacagacagacugaaccauuuugaagugacaggaaccaccauuagcacuggcugguuuaaguccaaagcaucuguuacucucgauagaacaugcgaacauauaaaaguaagcuguggaaagaaaacauuacaauuccaugcuugcuuuaagcaacauaugucuuguguucgauucuuacacaggagcauacuaccagggucaauggcaauuucgaucugccaaaauauugaguugauuauaauaacaauauuagcauuaugcauauuuauaauuaugauaauauuaacaaaaacguauauuugcuacgugcugaucccaguauuuaugcccauagcuuuugcuuauggaugggcguacaacaggaguuguaagaaaugcacuuguugcggauuggcauaccaccccuuuacaaacuguggcucauauugugucuguggcuccaaauuugaaacaucagacagaaugagaaugcaccgagaaucaggguugugccaggguuuuaaaagccugagaguagcaagaaggcuuugcaaaucaaaaggcucaucauugaucauaucuaucuuacucucaguguugauucuauccuuuguaacacccauagaggggacucuuacaaauuacccuacugaucagaaauauacuuuagaugaaauagcagauguccuccaggcuaaaacacaugaagauucuacaaaauacuauauaauauuauauacaucacuuuuuggugcagguuugacuaucauuuuugcaggaguagcauugggauuaacaauuauacuggaaguauuaaccaaaauuaauguuauuuucugcaacgagugcaauauguaccauagcaaaaaaucaaucaaauauguuggugauuucacuaacaaauguggguuuuguacaugcgggcuacuagaggauccagaggguguuguuguacauaaagccaagaaauccuguacauauucauaucagauuagcugggucaaagguaucaugauauuuguugccuuuuuauuuguaauacagaauacaauuauaauggucgcagcagaagaagacugcuggaaaaaugaagaauuaaaagaggauuguguagggccuuuaauugcaccuaaggauuguacugauaaagaucguaaaaccuacuugagugaggcuucauuguuagcaacagcaaagaaaauaacucagguggaugcugaaaauguagagauauuggggaaaacuauggaaucagcaauuagagugauugaaagacagaagacauaccacagaaugcacuugcuugaggcaguauuccuaaauaagcacugugauuauuauaaaauguuugaacauaacaguggauauucccaaguaaaguggaggaugaugauaaaaacacaacacuuugauaucugugccuuacaagcgaguagcccauuuugugcucaguguauugcugacaauucuugugcacaaggcucuugggaauuugacacacauaugaauuccacauauucaaguaaaguugacaauuuuaaacaugacuucucucuauuccucagaauuuuugaagcagcauuuccaggcacugcuuauguucacuugcuaacaaauauaaaagaaaagaagcccuaucaggcagucaguaugauugagaaaauaaagaagaaguuuccgaauaauaaauugcuuauuggauauuuagauuuuggcaaguacuugcuaggcuuaagucaugcaagcacauacgaguugcaacagagccaacuagauaaauuauaucagccaacagaacuaacccgaucugguggucaacaaacaucauuagcaaguucugugguaggucaagcaacgaaagaauguaaaaaauacaaagauguuaguugcuuaagcccaagauuuggaauuccgcuggaagauuugauaagcugcggugaccaaccaaauuacaauauuuauaaaaagccaaaaaaagucuacaaagcucauaacaaagaagaaacauggugcauuaaugaucagcauugccuaguugacuuugucccagcugaagcugauacuguggaaaaauuaaaaccuaugaaauguugguuaguugacccuggcaagaaugaugauguuuacuccauugcaauaaaaacauguagagugauugacaaagggguuuguacuguuaauucacaaaaauggaauauaaucaagugugauucugaucugcucuacuacagugaccauguaccaggggaagauacaggaaaugauauaggacauuauuguguaucagcuggaugcaaaacugacagauacccaauuaauccugauguugucacugacuguguaugggaauuuacuucuaggagaucacaauauauaggcaagaucuccaugcagucucuugaagauuacaaaaaagcuuuaacugacagauugacccauaccuuggaaaccuauaguuuugcaccauuagaaaaccucccgcauauaaaaccaguuuacaaauauaucacugcacaaggagucgaaaacucagacgguauagaaggggcauucauaacagccaguauuccagcugcuggggguacuagcauaggcuacaauguuaggucaaaggauggcuuuccacuccuugaucuaauaguguuuguaaagagugcugugaucaaaagcacauacaaccauauauacgauacugggccaacaauuagcauaaauacaaaacaugacgaacacugcacuggucaaugucccagcaauauagaacaugaggcuaauugguugacauuuucacaagaaagaacuagcagauggggaugugaagaguuugggugcuuggcugucaauacagguuguguuuuuggguccugucaagauguaauuagaccagaaacaaaaguuuacaggaaagcuguagaugaaauuguuauuuuaacaguuugcaucacauauccagggcauaccuuuuguacagaaauuaaugcaauagagccaaaaauaacagaagaaauugagcuccaguuuaaaacaguugacacgaaaacacuaccguauauaguagcuguaaauaaccauaaacucuauaguggucagauaaaugacuuagggacauuugggcaaaugugcggaaauguccaaaaaacaaacagcagcauuuuaggaacugggacaccaaaguuugauuauacuugucauggugccagucggaaggauaucauuguuaggagaugcuauaacaauaauuuugacuccugcaaacuucuaaaggaagaaacacagcuuauauuuaaugaugaucaugauacaauaacuguuuacaauacaaaucacuuaauuggugaguuagcuauaaaauugauauuaggggauauccaauauaaauuguucacagaaacauuggaccuucagaucgaugcgaaauguguuggcugcccugauugcuuugagagcuauuccugcaauuuccagauaguaucaaauauagacacaaucugcaaccuugaaggaccuugugacacauuccauaauagaauaucaaucaaggcaaugcagcaaaauuaugcuguaaaacucuccugccagaaagauccagggccaucagggacuuuuaaaauuuguaacagggaauauacuguuguauuccauacaguagcaaaagaugauaaaauagaaauaaauguuggagaccagacuucauucauuaaagagaaagaugacaggugcaaaacauggcuguguagggucagagaugaagguauuaguguaauuuuugaaccaauuaaagccuucuuugggaguuauuucagcaucuuuuucuacauaauuauuauuguaguagugggauuuuuaauaauauauauuuuuaugccgauguuuaugaaguugaaggaaguguugaaagcaaaugagaagcuuuacuugcaggaaauuaagcaaaaguaa

SEQ ID NO: 4113 - RNA, 4302 nt, Artificial Sequence
  derived and/or modified CDS sequence (wt) from BUNV(MGD/S1/12060/WT)__KM507340.1__GP
augaggauucuaauacugcuuuuagcaguuacuaaacuggcuguggguagcccaguugucacuagaugcuuucauggugggcaacugauugcagaaaggaaaucccaaacaucaaucucagaauucugcauuaaagaugacguuucuauguuaaaaucagagauugucuacacaaaaaaugauacugggauuuuuggccacaguaaaguuuuucgucacuggacaaucacagacuggaaagcaugcaacccuguuguuacagccggugguaguauaaauguuauagagguugauaaaaaucuaaaccuuguaacuagaaauuaugugugcacaggggauugcacuauaacaguugauaaggaaaaugcccagauuauauuucagacagacagacugaaccauuuugaagugacaggaaccaccauuagcacuggcugguuuaaguccaaagcaucuguuacucucgauagaacaugcgaacauauaaaaguaagcuguggaaagaaaacauuacaauuccaugcuugcuuuaagcaacauaugucuuguguucgauucuuacacaggagcauacuaccagggucaauggcaauuucgaucugccaaaauauugaguugauuauaauaacaauauuagcauuaugcauauuuauaauuaugauaauauuaacaaaaacguauauuugcuacgugcugaucccaguauuuaugcccauagcuuuugcuuauggaugggcguacaacaggaguuguaagaaaugcacuuguugcggauuggcauaccaccccuuuacaaacuguggcucauauugugucuguggcuccaaauuugaaacaucagacagaaugagaaugcaccgagaaucaggguugugccaggguuuuaaaagccugagaguagcaagaaggcuuugcaaaucaaaaggcucaucauugaucauaucuaucuuacucucaguguugauucuauccuuuguaacacccauagaggggacucuuacaaauuacccuacugaucagaaauauacuuuagaugaaauagcagauguccuccaggcuaaaacacaugaagauucuacaaaauacuauauaauauuauauacaucacuuuuuggugcagguuugacuaucauuuuugcaggaguagcauugggauuaacaauuauacuggaaguauuaaccaaaauuaauguuauuuucugcaacgagugcaauauguaccauagcaaaaaaucaaucaaauauguuggugauuucacuaacaaauguggguuuuguacaugcgggcuacuagaggauccagaggguguuguuguacauaaagccaagaaauccuguacauauucauaucagauuagcugggucaaagguaucaugauauuuguugccuuuuuauuuguaauacagaauacaauuauaauggucgcagcagaagaagacugcugggaaaaugaagaauuaaaagaggauuguguagggccuuuaauugcaccuaaggauuguacugauaaagaucguaaaaccuacuugagugaggcuucauuguuagcaacagcaaagaaaauaacucagguggaugcugaaaauguagagauauuggggaaaacuauggaaucagcaauuagagugauugaaagacagaagacauaccacagaaugcacuugcuugaggcaguauuccuaaauaagcacugugauuauuauaaaauguuugaacauaacaguggauauucccaaguaaaguggaggaugaugauaaaaacacaacacuuugauaucugugccuuacaagcgaguagcccauuuugugcucaguguauugcugacaauucuugugcacaaggcucuugggaauuugacacacauaugaauuccacauauucaaguaaaguugacaauuuuaaacaugacuucucucuauuccucagaauuuuugaagcagcauuuccaggcacugcuuauguucacuugcuaacaaauauaaaagaaaagaagcccuaucaggcagucaguaugauugagaaaauaaagaagaaguuuccgaauaauaaauugcuuauuggauauuuagauuuuggcaaguacuugcuaggcuuaagucaugcaagcacauacgaguugcaacagagccaacuagauaaauuauaucagccaacagaacuaacccgaucugguggucaacaaacaucauuagcaaguucugugguaggucaagcaacgaaagaauguaaaaaauacaaagauguuaguugcuuaagcccaagauuuggaauuccgcuggaagauuugauaagcugcggugaccaaccaaauuacaauauuuauaaaaagccaaaaaaagucuacaaagcucauaacaaagaagaaacauggugcauuaaugaucagcauugccuaguugacuuugucccagcugaagcugauacuguggaaaaauuaaaaccuaugaaauguugguuaguugacccuggcaagaaugaugauguuuacuccauugcaauaaaaacauguagagugauugacaaagggguuuguacuguuaauucacaaaaauggaauauaaucaagugugauucugaucugcucuacuacagugaccauguaccaggggaagauacaggaaaugauauaggacauuauuguguaucagcuggaugcaaaacugacagauacccaauuaauccugauguugucacugacuguguaugggaauuuacuucuaggagaucacaauauauaggcaagaucuccaugcagucucuugaagauuacaaaaaagcuuuaacugacagauugacccauaccuuggaaaccuauaguuuugcaccauuagaaaaccucccgcauauaaaaccaguuuacaaauauaucacugcacaaggagucgaaaacucagacgguauagaaggggcauucauaacagccaguauuccagcugcuggggguacuagcauaggcuacaauguuaggucaaaggauggcuuuccacuccuugaucuaauaguguuuguaaagagugcugugaucaaaagcacauacaaccauauauacgauacugggccaacaauuagcauaaauacaaaacaugacgaacacugcacuggucaaugucccagcaauauagaacaugaggcuaauugguugacauuuucacaagaaagaacuagcagauggggaugugaagaguuugggugcuuggcugucaauacagguuguguuuuuggguccugucaagauguaauuagaccagaaacaaaaguuuacaggaaagcuguagaugaaauuguuauuuuaacaguuugcaucacauauccagggcauaccuuuuguacagaaauuaaugcaauagagccaaaaauaacagaagaaauugagcuccaguuuaaaacaguugacacgaaaacacuaccguauauaguagcuguaaauaaccauaaacucuauaguggucagauaaaugacuuagggacauuugggcaaaugugcggaaauguccaaaaaacaaacagcagcauuuuaggaacugggacaccaaaauuugauuauacuugucauggugccagucggaaggauaucauuguuaggagaugcuauaacaauaauuuugacuccugcaaacuucuaaaggaagaaacacagcuuauauuuaaugaugaucaugauacaauaacuguuuacaauacaaaucacuuaauuggugaguuagcuauaaaauugauauuaggggauauccaauauaaauuguucacagaaacauuggaccuucagaucgaugcgaaauguguuggcugcccugauugcuuugagagcuauuccugcaauuuccagauaguaucaaauauagacacaaucugcaaccuugaaggaccuugugacacauuccauaauagaauaucaaucaaggcaaugcagcaaaauuaugcuguaaaacucuccugccagaaagauccagggccaucagggacuuuuaaaauuuguaacagggaauauacuguuguauuccauacaguagcaaaagaugauaaaauagaaauaaauguuggagaccagacuucauucauuaaagagaaagaugacaggugcaaaacauggcuguguagggucagagaugaagguauuaguguaauuuuugaaccaauuaaagccuucuuugggaguuauuucagcaucuuuuucuacauaauuauuauuguaguagugggauuuuuaauaauauauauuuuuaugccgauguuuaugaaguugaaggaaguguugaaagcaaaugagaagcuuuacuugcaggaaauuaagcaaaaguaa

SEQ ID NO: 4114 - RNA, 4308 nt, Artificial Sequence
  derived and/or modified CDS sequence (wt) from Ab-BUNV(Cu20-XJ)__KJ710423.1__GP
auggcgauuucuauugucuugaugaucaucuucucaaccaccucuugccuagcaagagcagcaccaucaauaucaaaauguuuccaagauggagugcugauagcagagaagaagagcucaucaggaauaucagaguucugcauuaaagaugauauuuccauacuaaagucagagauaaauuauucaaaaaaugacacagggauauucaugcauagcaaaguuuucaggcauuggacaguagcagauuggaagcaaugucaacccauuccaucugcagguggcagcauaaaugucuuggaaguugacaaaaaucuaaaccuuguugcuaaaaauuauauguguacuagaccuugugucauaaccauugacaaggagaaugcgcaauuacuguuucagacagaacaacugaaccaguuugagguuacgggaacaacaaucagcacagguugguuuaaaucaaaaacuucugugucccuugacaacacaugugaacauauuaaagugacuuguggcaaaaaaagcuugcaauuccaugcuugcuuuaagcaacauaugucaugcguuagguucuugcacagaaguguucugccagguuacauggcaaauucaauaugccaaaacauagaacucauuauaaucaucacauuaaccuuagcuauuuucauauucauguguauaauaacaaggacauacauuuguuacaucaugcugccccuguuugccccaauagcuuauauauauggaugguuauauaaccgcaguuguaagaaauguauauguugcggauuagcauaucauccuuucacaaauuguggguccuacuguguuugugguucccgcuuugaaacaucagaucgcaugcgccuucauagagaaucuggcuugugucagggcuucaaaucacuuagaguagcaaggacacuaugcaagucaaagggaucaucuuuaguuauaucagugcuaacugcaaugcuuauacuuucauuugucacaccccuugaagcuaucucaacaaauuaccccacagauaggaaguauacacuaaaugaggugaaugauauaguccuugggaaagggacggaaaaugagcugaagacaucaauauuggcauuaguguccauuugcgguauagggaucauuaucauauuuauagcauugacaaugcuuuuagacauuguguuggaagcuauagcuaaaaggagcacaauauuuugcacagaaugcaacuuaauacaugacaaaaaggcaaugaaauuugucggagauuucacaaacaaauguggguuuugcccauguggugaauuagaagacccagaggggcuaguuauacauacaacaagaaagucuuguacauauuauauuaaaauuagaaaccucaagcuaauuaugcuuguguuuucaauugccauuuuaaugcaaaauacagcaaugcuugucguugcugaugagaauugcuggacgaacacagaaaucaaggcagacuguguugggccauugauugggcccacaacgugcacuaauaaagggucaaaaacauacaaggcaguggcacaagagcugguuacaucaaacaagauaacacaauuggaugcugacaaguacacauuauuaggugacacaauagagagugcacugagugcuauaacagagcaaaaacauuauucugcaauacaucuacuagagacaauuuuccugaugaaacacugugauuauuauaaaguuuaugaacauaauaguggguauucccaaacaaaguggaggcuaauugccaagacaaauaguuuugacaucugcucuauaccaucuacaccaaauuuuugcaaaugcuugucagauuccagcugcuccacaaguacuuugaacuuugcaacgucaaugaacucuacuuacacuagcaaagcagaauacuuuaaucaugacuuuacuuuguuuuuaaauauauuugaggcugcauucccagggagugccacagcauucuuauucaagaaaauaaaagaaaaagcuccuuaucaggcuuuugaaaugauggguaaaauugcuaauaaguacccaaauaauaaguuauugguaguguugcuaaaauauggucaguauaugguuggucuaagucaugcuucaacuuaucagcucaagcaagaauggauugcuaaaucgcuaagcuuagugaggucaacaaaaacaggccuuaagauggcaaugacaaaugcagagccuggcccugccacuaaggaauguucagaugcaaaaacuauugcaugccugacucccaaauuccagguagagguuaacaaccucaugaguuguggugcuuccccuaauuuuaaaauauauaugaagagcggagagcucuacaaggcucaugauaggaacucaguguggugccuaaaugauaugcauugccuaacaccauauaccccagcaaaugcugagcuuguugcaacaaugaagaagauggaaugcuggcaagacaauccuaaacaaccuacaaaugauuaugcaacaccaagaagaagcugucaaaugaaggacagggguuuaugcaacguaggagccgauaaguggaaaguuauaaaaugugaugaugauuugauguuuuacacagaugcacuagagaguccagauccagcugcagacauagggcaauauugcuucucagaaaaaugccaaauagaaagauacccaauaaauccaacuagcuuaacaaauugugaaugguuguauagagcugugaagccucaauauauaaaaaggcugucauuacagacaauagaagaauauaagaaagcaauuacugacaaauugacacacacucugcaguuguaucauuuugcaccacuagaaaacuugccacauauuaggccuacauaugaguacauuacagcacagggcacuuacacagcagauggcauagaaggugcaaguauaauaacaucaauaccagcauugaguggaacaagugugggauuuaaaauaaaugcaaaagaugggacagcacuccuugauauaguuguguacauuaagucaucuguggugaaaaguguuuauaaucacauuuaugauacagggccuacuauuaacauaaacucaaaacaugaugaauugugcacuggacaauguccaaaaagaauaccugcagacccaaacuggcucacauuuucccaggaaagaacuaguagguggggcugcgaagaauuuggguguuuagcaauaaacacagguuguguauaugguuccugucaagauguaaucagaacagaaacaaagguuuauaggaaagcaaaugaggaaacagugauguugacuguuuguauaacauacccagggcauacguucugcacagaugugaaugcacuagagcccaagauaaccgaugaauuggaacuccaauuuaaaacaauagacauaaaaaguuuaccaaauuuaguggcuauaacuaaucauaaauuguauacagggcaaauaaaugaucuuggaaccuuuggccaaaugugugggaauguccaaaagacaaacacaaguauacugggugcaggcaccccaaaauucgauuacaccuguuauagcgccaguagaaaagauauaauaauucgcagaugcuacaauaacaauuaugacucuuguaggcuucuaaaacaggaaggggaucuccuguuugaugacaaccaugagacauugauaguguauaacaacaaaaggcugaauggagaacugacaaugaaguugcuccuuggagauauacaauacaagcucuacacagaaaacauggagcuugagcuggaagcaaaauguguuggauguguaggcugcuuugagagcuaccaguguaacuuacaaaucacauccagcuuagaugggaauugugccauaucaggacccugugagaccuuccaugacaggauccagauaaaaacgacaaaaaaagacuaugcauuaaagcuagcuuguacaaaggauccuggcgauaaggccacauuuagaguaugugguaaagacuaugauuucaacuuccacacaguuguaaaaaaugacaaaauugaagucaauguuggggaugaaacuucauauaucaaagaaaaggaugcuagauguggaacauggcuauguagggugagagaugaaggucuaaguguaaucuuugagccucugaaaaacuucuuuggcaauuauuugaauauguuccucuacauacuuggaggaguucuuuuacuguuuuuaucacuuuauauuauaaugccaguaugugcgagacuaagagaugaauuaaagaagaaugaaaaauuacaccagauggagaugaagaaaagauaa

SEQ ID NO: 4115 - RNA, 4305 nt, Artificial Sequence
  derived and/or modified CDS sequence (wt) from ANADV(EIV-13128Kam)__KT313718.1__GP
auguuuuuaauucuugucuuauugauaccauucuauaucacagcuacuccagugacaacaaggugcuuccaugggggccagcugauagcagaaagcaaaucuuugacagcaaucucagaguuuugccuaaaagaugaugucucaacugucaaaucugaaauaacauaccugaaaaaugacacaggaauauuugcucacagcaagguauuaaggaauuggauaauaaaagacuggaaaaauugcaauccuguaccaacagcaggaggcaguauaaaugucauagagguaaauacagauuugagccuauccacaaaaacauauguaugcagccgagauuguacaaucacaguugauaaagaggaugcccaaauaauuuuucaaacagacaaauuaaaucacuuugaaguuucaggcaccacacuaaguucaggcugguucaagacuaaggcaucaguaacauuagauagaacaugugagcauauaaaagugacuugugggaaaaagacacuacaauuccaugcuugcuuuaagcaucacaugucaugcauaagauucuuccacaauacaauacucccagggacaauggcuguaucuauaugccagaauauagagcucauuauaauaacaagcuuaaccuugauuaucuucauauugauggugauacugacaaaaacauauauaugcuauguuuuaaugccuuuauucaugccaguagcauauuuguauggcugggcuuacaauaggaguugcaaaaaguguucauguugugggcuugcauaucauccauucaccaauugugguucccauuguguaugugggcugaaauuugaagcaucagacagaaugaggauacaucgggaaucaggauugugucagggauauaagagcuuaaggguggcaaggcugcuaugcaaaucaaaaggcucuucuuuaauuaucucuauauuacugucagugcuaauuuuaagcuuuguuacaccuauagagggaacacuaacaaauuacccagaaucaaagaaauacaguuuggaagagauagcugauguuauagaaggauucauugcugagaaagggauaaaagaauauauugugcuauauacuucaauauuuggugcuuuauuauuguuaauagcauuaaucaucacagucucuuuaaacagaauuacagaauaucuaacuaaucuaaaugucauuuauugccaugaauguuccauguaucauuccaaaaagaauauaaaauacauuggugacuuuacuaauaaauguggguucugcacauguggcgaauuagaagaucaggaaggucucaauaugcauaaaguaagcaaaaagugcauauaccgauaucaguuaacuuggucuaaagugauuaugacaaucuuagucugucuauuaaucgcucagaacacugugcugauuguagcagcaaaugaugacugcugggcuaaacaaucauuagaaauagaaugcgucggacccuuacagcagguagaugcuugugaggauaagucaaguagaucuuacaauggagaggcaaaaaaacuaguugggacaucaaagguaacagaauuagaugcuggacaagugaaucuucuuggucaaacuauagaaucagcaaucauugcaauaaggaaacaaagaacauaugcaacuaugcauuuccuugaaucaguauuuuuaggaaggcauugugauuauuacaaaguauuugaacauaauagugguuacucucaagcaaaauggagguugcuagccaaaacaaaucacuuugauaucugcucaaggcauagcacacaucauuuuugcagaugcaugucagauggaacaaaaugcgaaaaugggaauugggauuuugcaggugaaaugaauacuacuuaccauucaaaaagagacuucuuuaaacaugauuuuaauuuauuuugcacuuugcuugaaaaugcauucccuggcacaacagagucccuuuauuaccaacuuuugucaaagagaaacacaacaggggcaucaaaauuauuagggaaguugauuacaaaauuugggaacaacaaucucuuuguagggaucuggaaauuuggccaauuuuuguuguccuuacccuaugucaacaauacagaguugagcgcacuacaauccucaaagauauuggaaaguccagaaccucuccuuaggucagcuagugggagacaagaaucauuaucuaguaccacuccuggggaggcaucuaaagaauguagaaaugcaaagaaaauuucaugcauaagcccuagauuuggaguuccuauggaaaacuugacugcauguggagaauccccaaauuauaagauauauaaaacaccaaccaggauuuacaaaucaaacaauaagggagaaauauggugugcaggugauguccauuguuuucaggaauuuacgccaguacuacaagaagugguugacaaguuaaagaaaaugacaugcuuuuuaacagagccugaggcagaggaggaugcauucucaauugcuauagcuaugugcaaaauucuagacaaaggaguuugcacuauaaacagcgaaagguggaacaucauaaaaugugauaguggucuuauguauuauacagaccagagagauggacaagauacagggaaugauuuuggggaguacuguauaucacacaauuguaagacagaaagguucccuaucaauccgucuauaauaagugauuguauaugggaauaccauucuaggaaauccagguauauuagcaccuugaauuuagaaaguuuagaagaauucaaaagggcuauuucagaaaagcucucacauacacucguaguguaucaguuuaagccaacaucuaaccuuccccauaugaagccaguguauaaauauauuacagcacaagggguugaaaauucugauggaauagacucagcauuuaucacagccaguaugccagcucucaguggaacuaguauaggauauaauguaaugucuaaagauaauuuccccuuauuugauauaauuauauuuauaaagagugcaguuauuaagaccacauacaaucauauuuaugacacaggccccacuauugguauuaauguaaugcaugaugaacauugcacaggacaguguccgauagaaauaccccacaaagaaaacugguugacauucucucaagagagaacaagccgaugggguugugaggaauuugggugcuuagcuauaaauacagguuguguguuuggaucuugccaagauauaaucaggccugagacuaagguauauaggaaggcaauagaagaaaguguuuuguugacagucugugugacauacccaggcaauaccuuuuguacagaaauaaaugcuauagaaccuaaaauaacagaugaauuagagcuccaauucaaaacaguagauacaaagacacuacccaaucugcuagcaguucaaaaccauaagcuguacaguggucagauaaaugaccuaggguccuuugcacaagguugcggaaauauccagaaaacuaacuuaucugugauaggaacugguacagcaaaauuugacuacauaugucauggugccucaagaaaagacauaguaguuagaagauguuauaauaacaauuaugaaucaugcaaauuguugaaggaggagccaagccugaucuuuucugauaaucaugaaacaauagaaguagcaaauauucggcaccuucuuggagaauugcaguuuaaauuaaugcugggugauuuaagauauaaaucauuugcagaaaacccagagcuagagauagaggcaaaguguguuggaugcccaucaugcuuuucuaguuauuccugcaacuuccgaauaaguucaaguauugauacaguaugugcaauagauggaccaugcacaauauuucacaauagauuaauuauuaguucaacuaagcaagauuauggcaucaagaugagcuguaaagaaaagccaaacccaguugaaaaauucaacauauguaagagaauauauucaguuuuguucacaacuauugauaaaagugauaagauugaaauaaauacaggagaccaaacuucauuuauacaagaaaaggaugacagaugcaaaacauggcucuguagaguuagagaugaagggauaaguguuauuuuugagccgauaaaagcauucuuugggaguuauuucagcauugcauucuauguaguaauugggauaauagcacuuuuuaucacaauauauaucuuuuugccaaugguuuuuaaauuaaaagacauacuuaaaaagaaugaacucuuauauuuacaagagaugaaauauaaguag

SEQ ID NO: 4116 - RNA, 4305 nt, Artificial Sequence
  derived and/or modified CDS sequence (wt) from ANADV(EIV-13130Kam)__KT313721.1__GP
auguuuuuaauucuugucuuauugauaccauucuauaucacagcuacuccagugacaacaaggugcuuccaugggggccagcugauagcagaaagcaaaucuuugacagcaaucucagaguuuugccuaaaagaugaugucucaacugucaaaucugaaauaacauaccugaaaaaugacacaggaauauuugcucacagcaagguauuaaggaauuggauaauaaaagacuggaaaaauugcaauccuguaccaacagcaggaggcaguauaaaugucauagagguaaaugcagauuugagccuauccacaaaaacauauguaugcagccgagauuguacaaucacaguugauaaagaagaugcccaaauaauuuuucaaacagacaaauuaaaucacuuugaaguuucaggcaccacauuaaguucaggcugguucaagacuaaggcaucaguaacauuagauagaacaugugagcauauaaaagugacuugugggaaaaagacacuacaguuccaugcuugcuuuaagcaucacaugucaugcauaagauucuuccacaauacaauacucccagggacaauggcuguaucuauaugccagaauauagagcucauuauaauaacaagcuuaaccuugauuaucuucauauugauggugauacugacaaaaacguauauaugcuauguuuuaaugccuuuauucaugccaguagcauauuuguauggcugggcuuacaauaggaguugcaaaaaguguucauguugugggcuugcauaucauccauucaccaauugugguucccauuguguaugugggcugaaauuugaagcaucagacagaaugaggauacaucgggaaucaggauugugucagggauauaagagcuuaaggguggcaaggcugcuaugcaaaucaaaaggcucuucuuuaauuaucucuauauuacugucagugcuaauuuuaagcuuuguuacaccuauagagggaacacuaacaaauuacccagaaucaaagaaauacaguuuggaagagauagcugauguuauagaaggauucauugcugagaaagggauaaaagaauauauugugcuauauacuucaauauuuggugcuuuauuauuauuaauagcauuaaucaucacagucucuuuaaacagaauuacagaauaucuaacuaaccuaaaugucauuuauugccaugaauguuccauguaucauuccaaaaagaauauaaaauacauuggugacuuuacuaauaaauguggguucugcacauguggcgaauuagaagaucaggaaggucucaauaugcauaaaguaagcaaaaagugcauauaccgauaucaguuaacuuggucuaaagugauuaugacaaucuuagucugucuauuaaucgcucagaauacugugcugauuguagcagcaaaugaugacugcugggcuaaacaaucauuagaaauagaaugcguuggaccuuuacagcagguagaugcuugugaggauaagucaaguagaucuuacaauggagaggcaaaaaaacuaguugggacaucaaagguaacagaauuagaugcuggacaagugaaucuucuuggucaaacuauagagucagcaaucauugcaauaaggaaacaaagaacauaugcaacuaugcauuuccuugaaucaguauuuuuaggaaggcauugugauuauuacaaaguauuugaacauaauagugguuacucucaagcaaaauggaggcugcuagccaaaacaaaucacuuugauaucugcucaaggcauagcacacaucauuuuugcagaugcaugucagauggaacaaaaugcgaaaaugggaauugggauuuugcaggcgaaaugaauacuacuuaccauucaaaaagggacuucuuuaaacaugauuuuaauuuauuuugcacuuuacuugaaaaugcauucccuggcacaacagagucccuuuauuaccaacuuuugucaaagagaaacacaacaggggcaucaaaauuauuagggaaguugauuacaaaauuugggaauaacaaucucuuuguagggaucuggaaauuuggccaauuuuuguuguccuuacccuaugucaacaauacagaguugagcgcacuacaauccucaaagauauuggaaaguccagaaccucuccuuaggucagcuagugggagacaagaaucauuaucuagugccacuccuggggaggcaucuaaagaauguagaaaugcaaagaaaauuucaugcauaagcccuagauuuggaguuccuauggaaaacuugaccgcauguggagaauccccaaauuauaagauauauaaaacaccaaccaggauuuacaaaucaaacaauaagggagaaauauggugugcaggugauguccauuguuuucaggaauuuacgccaguacuacaagaagugguugacaaguuaaagaaaaugacaugcuuuuuaacagagccugaggcagaggaggaugcauucucaauugcuauagcuaugugcaaaauucuagacaaaggaguuugcacuauaaacagcgaaagguggaacaucauaaaaugugauaguggucuuauguauuauacagaccagagggauggacaagauacagggaaugauuuuggggaguacuguauaucacacaauuguaagacagaaagguucccuaucaauccgucuauaauaagugauuguauaugggaauaccauucuaggaaauccagguauauuagcaccuugaauuuagaaaguuuagaagaauucaaaagggcuauuucagaaaagcucucacauacacucauaguguaucaguuuaagccaacaucuaaccuuccccauaugaagccaguguauaaauauauuacagcacaagggguugaaaauucugauggaauagacucagcauuuaucacagccaguaugccagcucucaguggaacuaguauaggauauaauguaaugucuaaagauaauuuccccuuauuugauauaauuauauuuauaaagagugcaguuauuaagaccacauacaaucauauuuaugacacaggccccacuauugguauuaauguaaugcaugaugaacauugcacaggacaguguccgauagaaauaccccacaaagaaaacugguugacauucucucaagagagaacaagccgaugggguugugaggaauuugggugcuuagcuauaaauacagguuguguguuuggaucuugccaagauauaaucaggccugagacuaagguauauaggaaggcaauagaagaaaguguuuuguugacagucugugugacauacccaggcaauaccuuuugcacagaaauaaaugcuauagaaccuaaaauaacagaugaauuagagcuccaauucaaaacaguagauacaaagacacuacccaaucugcuagcaguucaaaaccauaagcuguacaguggucagauaaaugaccuaggguccuuugcacaagguugcggaaauauccagaaaacuaacuuaucugugauaggaacugguacagcaaaauuugacuacauaugucauggugccucaagaaaagacauaguaguuagaagauguuauaauaacaauuaugaaucaugcaaauuguugaaggaggagccaagccuaaucuuuucugauaaucaugaaacaauagaaguagcaaauauucggcaccuucuuggagaauugcaguuuaaauuaaugcugggugauuuaagauauaaaucauuugcagaaaacccagagcuagagauagaggcaaaguguguuggaugcccaucaugcuuuucuaguuauuccugcaacuuccgaauaaguucaaguauugauacaguaugugcaauagauggaccaugcacaauauuucacaauagauuaauuauuaguucaacuaagcaagauuauggcaucaagaugagcuguaaagaaaagccaaacccaguugaaaaauucaacauauguaagagaguauauucaguguuguucacaacuauugauaaaaaugauaagauugaaauaaauacaggagaccaaacuucauuuauacaagaaaaggaugacagaugcaaaacauggcucuguagaguuagagaugaagggauaaguguuauuuuugagccgauaaaagcauucuuugggaguuauuucagcauugcauucuauguaguaauugggauaauagcacuuuuuaucacaauauauaucuuuuugccaaugguuuuuaaauuaaaagacauacuuaaaaagaaugaacucuuauauuuacaagagaugaaauauaaguag

SEQ ID NO: 4117 - RNA, 4305 nt, Artificial Sequence
  derived and/or modified CDS sequence (wt) from ANADV(EIV-13395Mg)__KU159765.1__GP
auguuuuuaauucuugucuuauugauaccauucuauaucacagcuacuccagugacaacaaggugcuuccaugggggccagcugauagcagaaagcaaaucuuugacagcaaucucagaguuuugccuaaaagaugaugucucaacugucaaaucugaaauaacauaccugaaaaaugacacaggaauauuugcucacagcaagguauuaaggaauuggauaauaaaagacuggaaaaauugcaauccuguaccaacagcaggaggcaguauaaaugucauagagguaaaugcagauuugagccuauccacaaaaacauauguaugcagccgagauuguacaaucacaguugauaaagaggaugcccaaauaauuuuucaaacagacaaauuaaaucacuuugaaguuucaggcaccacauuaaguucaggcugguucaagacuaaggcaucaguaacauuagauagaacaugugagcauauaaaagugacuugugggaaaaagacacuacaguuccaugcuugcuuuaagcaucacaugucaugcauaagauucuuccacaauacaauacucccagggacaauggcuguaucuauaugccagaauauagagcucauuauaauaacaagcuuaaccuugauuaucuucauauugauggugauacugacaaaaacguauauaugcuauguuuuaaugccuuuauucaugccaguagcauauuuguauggcugggcuuacaauaggaguugcaaaaaguguucauguugugggcuugcauaucauccauucaccaauugugguucccauuguguaugugggcugaaauuugaagcaucagacagaaugaggauacaucgggaaucaggauugugucagggauauaagagcuuaaggguggcaaggcugcuaugcaaaucaaaaggcucuucuuuaauuaucucuauauuacugucagugcuaauucuaagcuuuguuacaccuauagagggaacacuaacaaauuacccagaaucaaagaaauacaguuuggaagagauagcugauguuauagaaggauucauugcugagaaagggauaaaagaauauauugugcuauauacuucaauauuuggugcuuuauuauuauuaauagcauuaaucaucacagucucuuuaaacagaauuacagaauaucuaacuaaccuaaaugucauuuauugccaugaauguuccauguaucauuccaaaaagaauauaaaauacauuggugacuuuacuaauaaauguggguucugcacauguggcgaauuagaagaucaggaaggucucaauaugcauaaaguaagcaaaaagugcauauaccgauaucaguuaacuuggucuaaagugauuaugacaaucuuagucugucuauuaaucgcucagaacacugugcugauuguagcagcaaaugaugacugcugggcuaaacaaucauuagaaauagaaugcguuggaccuuuacagcagguagaugcuugugaggauaagucaaguagaucuuacaauggagaggcaaaaaaacuaguugggacaucaaagguaacagaauuagaugcuggacaagugaaucuucuuggucaaacuauagagucagcaaucauugcaauaaggaaacaaagaacauaugcaacuaugcauuuccuugaaucaguauuuuuaggaaggcauugugauuauuacaaaguauuugaacauaauagugguuacucucaagcaaaauggaggcugcuagccaaaacaaaucacuuugauaucugcucaaggcauagcacacaucauuuuugcagaugcaugucagauggaacaaaaugcgaaaaugggaauagggauuuugcaggcgaaaugaauacuacuuaccauucaaaaagggacuucuuuaaacaugauuuuaauuuauuuugcacuuuacuugaaaaugcauucccuggcacaacagagucccuuuauuaccaacuuuugucaaagagaaacacaacaggggcaucaaaauuauuagggaaguugauuacaaaauuugggaauaacaaucucuuuguagggaucuggaaauuuggccaauuuuuguuguccuuacccuaugucaacaauacagaguugagcgcacuacaauccucaaagauauuggaaaguccagaaccucuccuuaggucagcuagugggagacaagaaucauuaucuagugccacuccuggggaggcaucuaaagaauguagaaaugcaaagaaaauuucaugcauaagcccuagauuuggaguuccuauggaaaacuugaccgcauguggagaauccccaaauuauaagauauauaaaacaccaaccaggauuuacaaaucaaacaauaagggagaaauauggugugcaggugauguccauuguuuucaggaauuuacgccaguacuacaagaagugguugacaaguuaaagaaaaugacaugcuuuuuaacagagccugaggcagaggaggaugcauucucaauugcuauagcuaugugcaaaauucuagacaaaggaguuugcacuauaaacagcgaaagguggaacaucauaaaaugugauaguggucuuauguauuauacagaccagagagauggacaagauacagggaaugauuuuggggaguacuguauaucacacaauuguaagacagaaagguucccuaucaauccgucuauaauaagugauuguauaugggaauaccauucuaggaaauccagguauauuagcaccuugaauuuagaaaguuuagaagaauucaaaagggcuauuucagaaaagcucucacauacacucguaguguaucaguuuaagccaacaucuaaccuuccccauaugaagccaguguauaaauauauuacagcacaagggguugaaaauucugauggaauagacucagcauuuaucacagccaguaugccagcucucaguggaacuaguauaggauauaauguaaugucuaaagauaauuuccccuuauuugauauaauuauauuuauaaagagugcaguuauuaagaccacauacaaucauauuuaugacacaggccccacuauugguauuaauguaaugcaugaugaacauugcacaggacaguguccgauagaaauaccccacaaagaaaacugguugacauucucucaagagagaacaagccgaugggguugugaggaauuugggugcuuagcuauaaauacagguuguguguuuggaucuugccaagauauaaucaggccugagacuaagguauauaggaaggcaauagaagaaaguguuuuguugacagucugugugacauacccaggcaauaccuuuugcacagaaauaaaugcuauagaaccuaaaauaacagaugaauuagagcuccaauucaaaacaguagauacaaagacacuacccaaucugcuagcaguucaaaaccauaagcuguacaguggucagauaaaugaccuaggguccuuugcacaagguugcggaaauauccagaaaacuaacuuaucugugauaggaacugguacagcaaaauuugacuacauaugucauggugccucaagaaaagacauaguaguuagaagauguuauaauaacaauuaugaaucaugcaaauuguugaaggaggagccaagccuaaucuuuucugauaaucaugaaacaauagaaguagcaaauauucggcaccuucuuggagaauugcaguuuaaauuaaugcugggugauuuaagauauaaaucauuugcagaaaacccagagcuagagauagaggcaaaguguguuggaugcccaucaugcuuuucuaguuauuccugcaacuuccgaauaaguucaaguauugauacaguaugugcaauagauggaccaugcacaauauuucacaauagauuaauuauuaguucaacuaagcaagauuauggcaucaagaugagcuguaaagaaaagccaaacccaguugaaaaauucaacauauguaagagaguauauucaguguuguucacaacuauugauaaaaaugauaagauugaaauaaauacaggagaccaaacuucauuuauacaagaaaaggaugacagaugcaaaacauggcucuguagaguuagagaugaagggauaaguguuauuuuugagccgauaaaagcauucuuugggaguuauuucagcauugcauucuauguaguaauugggauaauagcacuuuuuaucacaauauauaucuuuuugccaaugguuuuuaaauuaaaagacauacuuaaaaagaaugaacucuuauauuuacaagagaugaaauauaaguag

SEQ ID NO: 4118 - RNA, 4305 nt, Artificial Sequence
  derived and/or modified CDS sequence (wt) from ANADV(EIV-16002Mg)__KT313724.1__GP
auguuuuuaauucuugucuuauugauaccauucuauaucacagcuacuccagugacaacaaggugcuuccaugggggccagcugauagcagaaagcaaaucuuugacagcaaucucagaguuuugccuaaaagaugaugucucaacugucaaaucugaaauaacauaccugaaaaaugacacaggaauauuugcucacagcaagguauuaaggaauuggauaauaaaagacuggaaaaauugcaauccuguaccaacagcaggaggcaguauaaaugucauagagguaaaugcagauuugagccuauccacaaaaacauauguaugcagccgagauuguacaaucacaguugauaaagaggaugcccaaauaauuuuccaaacagacaaauuaaaucacuuugaaguuucaggcaccacacuaaguucaggcugguucaagacuaaggcaucaguaacauuagauagaacaugugagcauauaaaagugacuugugggaaaaagacacuacaguuccaugcuugcuuuaagcaucacaugucaugcauaagauucuuccacaauacaauacucccagggacaauggcuguaucuauaugccagaauauagagcucauuauaauaacaagcuuaaccuugauuaucuucauauugauggugauacugacaaaaacauauauaugcuauguuuuaaugccuuuauucaugccaguagcauauuuguauggcugggcuuacaauaggaguugcaaaaaguguucauguugugggcuugcauaucauccauucaccaauugugguucacauuguguaugugggcugaaauuugaagcaucagacagaaugaggauacaucgggaaucaggauugugucagggauauaagagcuuaaggguggcaaggcugcuaugcaaaucaaaaggcucuucuuuaauuaucucuauauuacugucagugcuaauuuuaagcuuuguuacaccuauagagggaacacuaacaaauuacccagaaucaaagaaauauaguuuggaagagauagcugauguuauagaaggauucauugcugagaaagggauaaaagaauauauugugcuauauacuucaauauuuggugcuuuauuauuauuaauagcauuaaucaucacagucucuuuaaacagaauuacagaauaucuaacuaaucuaaaugucauuuauugccaugaauguuccauguaucauuccaaaaagaauauaaaauacguuggugacuuuacuaauaaauguggguucugcacauguggcgaauuagaagaucaggaaggucucaauaugcauaaaguaagcaaaaagugcauauaccgauaucaguuaacuuggucuaaagugauuaugacaaucuuagucugucuauuaaucgcucagaacacugugcugauuguagcagcaaaugaugacugcugggcuaaacaaucauuagaaauagaaugcguuggacccuuacagcagguagaugcuugugaggauaagucaaguagaucuuacaauggagaggcaaaaaaacuaguugggacaucaaagguaacagaauuagaugcuggacaagugaaucuucuuggucaaacuauagagucagcaaucauugcaauaaggaaacaaagaacauaugcaacuaugcauuuccuugaaucaguauuuuuaggaaggcauugugauuauuacaaaguauuugaacauaauagugguuacucucaagcaaaauggagguugcuagccaaaacaaaucacuuugauaucugcucaaggcauagcacacaucauuuuugcagaugcaugucagauggaacaaaaugcgaaaaugggaauugggauuuugcaggcgaaaugaauacuacuuaccauucaaaaagagacuucuuuaaacaugauuuuaaauuauuuugcacuuuacuugaaaaugcauucccuggcacaacagagucccuuuauuaccaacucuugucaaagagaaacacaacaggggcaucaaaauuauuagggaaguugauuacaaaauuugggaauaacaaucucuuuguagggaucuggaaauuuggccaauuuuuguuguccuuacccuaugucaacaauacagaguugagugcacuacaauccucaaaaauauuggaaaguccagaaccucuccuuaggucagcuagugggagacaagaaucauuaucuagugccacuccuggagaggcaucuagagaauguagaaaugcaaagaaaauuucaugcauaagcccuagauuuggaguuccuauggaaaacuugaccgcauguggagaauccccaaauuauaagauauauaaaacaccagccaggauuuacaaaucaaacaauaagggagaaauauggugugcaggugauguccauuguuuucaggaauuuacgccaguacuacaagaagugguugauaaguuaaagaaaaugacaugcuuuuuaacagagccugaggcagaggaggaugcauucucaauugcuauagcuaugugcaaaauucuagacaaaggaguuugcacuauaaacagcgaaagguggaacaucauaaaaugugauaguggucuuauguauuauacagaccagagagauggacaagauacagggaaugauuuuggggaguacuguauaucacacaauuguaagacagaaagauucccuaucaauccgucuauaauaagugauuguauaugggaauaccauucuaggaaauccagguauauuagcaccuugaauuuagaaaguuuagaagaauucaaaagggcuauuucagaaaagcucucacauacacucguaguguaucaguuuaagccaacaucuaaccuuccccauaugaagccaguguauaaauauauuacagcacaagggguugaaaauucugauggaauagacucagcauuuaucacagccaguaugccagcucucaguggaacuaguauaggauauaauguaaugucuaaagauaauuuccccuuauuugauaucauuauauuuauaaagagugcaguuauuaagaccacauacaaucauauuuaugacacaggccccacuauugguauuaauguaaugcaugaugaacauugcacaggacaguguccgauagaaauaccccacaaagaaaacugguugacauucucucaagagagaacaagccgaugggguugugaggaauuugggugcuuagcuauaaauacagguuguguguuuggaucuugccaagauauaaucaggccugagacuaagguauauaggaaggcaauagaagaaaguguuuuguuaacagucugugugacauacccaggcaauaccuuuugcacagaaauaaaugcuauagaaccuaaaauaacagaugaauuagagcuccaauucaaaacaguagauacaaagacacuacccaaucugcuagcaguucaaaaccauaagcuguacaguggucagauaaaugaccuaggguccuuugcacaagguugcggaaauauccagaaaacuaacuuaucugugauaggaacugguacagcaaaauuugacuacauaugucauggugccucaagaaaagacauaguaguuagaagauguuauaauaacaauuaugaaucaugcaaauuguugaaggaggagccaagccuaaucuuuucugauaaucaugaaacaauagaaguagcaaacauucgacaccuucuuggagaauugcaguuuaaauuaaugcugggugauuuaagauauaaaucauuugcagaaaacccagagcuagagauagaggcaaaguguguuggaugcccaucaugcuuuucuaguuauuccugcaacuuccgaauaaguucaaguauugauacaguaugugcaauagauggaccaugcacaguauuucacaauagauuaauuauuaguucaacuaagcaagauuauggcaucaagaugagcuguaaagaaaagccaaacccaguugaaaaauucaacauauguaagagaguauauucaguguuguucacaacuauugauaaaaaugauaagauugaaauaaauacaggagaccaaacuucauuuauacaagaaaaggaugacagaugcaaaacauggcucuguagaguuagagaugaagggauaaguguuauuuuugagccgauaaaagcauucuuugggaguuauuucagcauugcauucuauguaguaauugggauaauagcacuuuuuaucacaauauauaucuuuuugccaaugguuuuuaaauuaaaagacauacuuaaaaagaaugaacucuuauauuuacaggagaugaaauauaaguag

SEQ ID NO: 4119 - RNA, 4305 nt, Artificial Sequence
  derived and/or modified CDS sequence (wt) from ANADV(EIV-16199Mg)__KT313730.1__GP
auguuuuuaauucuugucuuauugauaccauucuauaucacagcuacuccagugacaacaaggugcuuccaugggggccagcugauagcagaaagcaaaucuuugacagcaaucucagaguuuugccuaaaagaugaugucucaacugucaaaucugaaauaacauaccugaaaaaugacacaggaauauuugcucacagcaaaguauuaaggaauuggauaauaaaagacuggaaaaauugcaauccuguaccaacagcaggaggcaguauaaaugucauagagguaaaugcagauuugagccuauccacaaaaacauauguaugcagccgagauuguacaaucacaguugauaaagaggaugcccaaauaauuuuucaaacagacaaauuaaaucacuuugaaguuucaggcaccacacuaaguucaggcugguucaagacuaaggcaucaguaacauuagauagaacaugugagcauauaaaagugacuugugggaaaaagacacuacaguuccaugcuugcuuuaagcaucacaugucaugcauaagauucuuccacaauacaauacucccagggacaauggcuguaucuauaugccagaauauagagcucauuauaauaacaagcuuaaccuugauuaucuucauauugauggugauauugacaaaaacauauauaugcuaugucuuaaugccuuuauucaugccaguagcauauuuauauggcugggcuuacaauaggaguugcaaaaaguguucauguugugggcuugcauaucauccauucaccaauugugguucccauuguguaugugggcugaaauuugaagcaucagacagaaugaggauacaucgggaaucaggauugugucagggauauaaaagcuuaaggguggcgaggcugcuaugcaaaucaaaaggcucuucuuuaauuaucucuauauuacugucagugcuaauuuuaagcuuuguuacaccuauagagggaacacuaacaaauuacccagaaucaaagaaauacaguuuggaagagauagcugauguuauagaaggauucauugcugagaaagggauaaaagaauauauugugcuauauacuucaauauuuggugcuuuauuauuauuaauagcauuaaucaucacagucucuuuaaacagaauuacagaauauuuaacuaaucuaaaugucauuuauugccaugaauguuccauguaucauuccaaaaagaauauaaaauacauuggugacuuuacuaauaaauguggguucuguacauguggcgaauuagaagaucaggaaggucucaauaugcauaaaguaagcaaaaagugcauauaccgauaucaguuaacuuggucuaaagugauuaugacaaucuuagucugucuauuaaucgcucagaacacugugcugauuguagcagcaaaugaugacugcugggcuaaacaaucauuagaaauagaaugcguuggacccuuacagcagguagaugcuugugaggauaagucaaguagaucuuacaaugaagaggcaaaaaaacuaguugggacaucaaagguaacagaauuagaugcuggacaagugaaucuucuuggucaaacuauagagucagcaaucauugcaauaaggaaacaaagaacauaugcaacuaugcauuuccuugaaucaguauuuuuaggaaggcauugugacuauuacaaaguauuugaacauaauagugguuacucucaagcaaaauggagguugcuagccaaaacaaaucacuuugauaucugcucaaggcauagcacacaucauuuuugcagaugcaugucagauggaacaaaaugcgaaaauggaaauugggauuuugcaggcgaaaugaauacuacuuaccauucaaaaagagauuucuuuaaacaugauuuuaauuuauuuugcacuuuacuugaaaaugcauuccccggcacaacagagucccuuuauuaccagcuuuugucaaagagaaauacaacaggggcaucaaaauuauuagggaaguugauuacaaaauucgggaauaacaaucucuuuguagggaucuggaaauuuggccaauuuuuguuguccuuacccuaugucaacaauacagaguugagcgcacugcaauccucaaagauauuggaaaguccagaaccucuccuuaggucagcuagugggagacaagaaucauugucuagugccacuccuggggaggcaucuaaagaauguagaaaugcaaagaaaauuucaugcauaagcccuagauuuggaguuccuauggaaaacuugacugcauguggagaauccccaaauuauaagauauauaaaacaccaaccaggauuuacaaaucaaacaauaagggagaaauauggugugcaggugauguucauugcuuucaggaauuuacgccaguacuacaagaaguggucgacaaauuaaagaaaaugacauguuuuuuaacagagccugaggcagaggaggaugcauucucaauugcuauagcuaugugcaaaauucuagacaaaggaguuugcaccauaaacagcgaaagguggaacaucauaaaaugugauaguggucuuauguauuauacagaucagagagaugggcaagauacagggaaugauuuuggggaguacuguauaucacacaauuguaagacagaaagauucccuaucaauccgucuauaauaagugauuguauaugggaauaccauucuagaaaauccagguauauuagcaccuugaauuuagaaaguuuagaagaguucaaaagggcuauuucagaaaagcucucacauacacucauaguguaucaguuuaagccaacaucuaaccuuccccauaugaagccaguguauaaauauauuacagcacaagggguugaaaauucugauggaauagacucagcauuuaucacagccaguaugccagcucucaguggaacuaguauaggauauaauguaaugucuaaagauaauuuccccuuauuugauauaauuauauuuauaaagagugcaguuauuaagaccacauacaaucauauuuaugacacagggcccacuauugguauuaauguaaugcaugaugaacauugcacaggacaguguccgauagaaauaccucacaaagaaaacugguugacauucucucaagagagaacaagccgaugggguugugaggaauuugggugcuuagcuauaaauacagguuguguguuuggaucuugucaagauauaaucaggccugagacuaagguauauaggaaggcaauagaagaaagugucuuguugacagucugugugacauacccaggcaauaccuuuugcacagaaauaaaugcuauagaaccuaaaauaacagaugaauuagagcuccaauucaaaacaguagauacaaagacacuacccaauuugcuagcaguucaaaaccauaagcuguacaguggucagauaaaugaccuaggguccuuugcacaagguugcggaaauauccagaaaacuaacuuaucugugauaggaacuggaacagcaaaauuugacuacauaugucauggugccucaagaaaagacauagugguuagaagauguuauaauaacaauuaugaaucaugcaaauuguugaaggaggagccaagccuaaucuuuucugauaaucaugaaacgauagaaguagcaaauauucggcaccuucuuggagaauugcaguuuaaauuaaugcugggugauuugagauauaaaucauuugcagaaaacccagagcuagagauagaggcaagguguguuggaugcccaucaugcuuuucuaguuauuccugcaauuuccgaauaaguucaaguauugauacaguaugugcaauagacggaccaugcacaauauuucacaauagauuaauuauuaguucaacuaagcaagauuauggcaucaagaugagcuguaaagaaaagccaaacccaguugaaaaauucaacauauguaagagaguauauucaguguuguucacaacuauugauaaaaaugauaagauugaaauaaauacaggagaccaaacuucauuuauacaagaaaaggaugacagaugcaaaacauggcucuguagaguuagagaugaagggauaaguguuauuuuugagccgauaaaagcauucuuugggaguuauuucagcauugcauucuaugugguaauugggauaauagcacuuuuuaucauaauauauaucuuuuugccaaugguuuuuaaauuaaaagacauacuuaaaaagaaugaacucuuauauuuacaagagaugaaauauaaguag

SEQ ID NO: 4120 - RNA, 4305 nt, Artificial Sequence
  derived and/or modified CDS sequence (wt) from ANADV(EIV-16208Mg)__KT313733.1__GP
auguuuuuaauucuugucuuauugauaccauucuauaucacagcuacuccagugacaacaaggugcuuccaugggggccagcugauagcagaaagcaaaucuuugacagcaaucucagaguuuugccuaaaagaugaugucucaacugucaaaucugaaauaacauaccuaaaaaaugacacaggaauauuugcucacagcaaaguauuaaggaauuggauaauaaaagacuggaaaaauugcaauccuguaccaacagcaggaggcaguauaaaugucauagagguaaaugcagauuugagccuauccacaaaaacauauguaugcagccgagauuguacaaucacaguugauaaagaagaugcccaaauaauuuuccaaacagauaaauuaaaucacuuugaaguuucgggcaccacacuaaguucaggcugguucaagacuaaggcaucaguaacauuagauagaacaugugagcauauaaaagugacuugugggaaaaagacacuacaguuccaugcuugcuuuaagcaccacaugucaugcauaagauucuuccacaauacaauacucccagggacaauggcuguaucuauaugccagaauauagagcucauuauaauaacaagcuuaaccuugauuaucuucauauugauggugauauugacaaaaacauauauaugcuaugucuuaaugccuuuauucaugccaguagcauauuuguauggcugggcuuacaauaggaguugcagaaaguguucauguugugggcuugcauaucauccauucaccaauugugguucccauuguguaugugggcugaaauuugaagcaucagacagaaugaggauacaucgggaaucaggauugugucagggauauaaaagcuuaaggguggcgaggcugcuaugcaaaucaaaaggcucuucuuuaauuaucucuauauuauugucagugcuaauuuuaagcuuuguuacaccuauagagggaacacuaacaaacuacccagaaucaaagaaauacaguuuggaagagauagcugauguuauagaaggauuuauugcugagaaagggauaaaagaauauauugugcuauauacuucaauauuuggugccuuauuauuauuaauagcauuaaucaucacagucucuuuaaacagaauuacagaauaucuaacuaaucuaaaugucauuuauugccaugaauguuccauguaucauuccaaaaagaauauaaaauacauuggugacuuuacuaacaaauguggguucugcacauguggcgaauuagaagaucaggaaggucucaauaugcauaaaguaagcaaaaagugcauauaccgauaucaguuaacuuggucuaaagugauuaugacaaucuuaaucugucuauuaaucgcucagaaugcugugcugauuguagcagcaaaugacgacugcugggcuaaacaaucauuagaaauagaaugcguuggacccuuacagcagguagaugcuugugaggauaagucaaguagaucuuacaauggagaggcaaaaaaacuaguugggacaucaaagguaacagaauuagaugcuggacaagugaaucuucuuggucaaacuauagagucagcaaucauugcaauaaggaaacaaagaacauaugcaacuaugcauuuccuugaaucaguauuuuuaggaaggcauugugauuauuacaaaguauuugaacauaauagugguuacucucaagcaaaauggagguugcuagccaaaacaaaucacuuugauaucugcucaaggcauagcacacaucauuuuugcagaugcaugucagauggaacaaaaugcgaaaaugggaauugggauuuugcaggcgaaaugaauacuacuuaccauucaaaaagagauuucuuuaaacaugauuuuaaguuauuuugcacuuuacuugaaaaugcauucccuggcacaacagagucccuuuauuaccaacuuuugucaaagagaaacacaacaggggcaucaaaauuauuagggaaguugauuacaaaauucgggaauaacaaucucuuuguagggaucuggaaauuuggccaauucuuguuguccuuacccuaugucaacaauacagaguugagugcacugcaauccucaaagauauuggaaaguccagaaccucuccuuaggucagcuagugggagacaagaaucauuaucuagugccacuccuggggaggcaucuaaagaauguagaaaugcaaagaagauuucaugcauaagcccuagauuuggaguuccuauggaaaacuugacugcauguggagaauccccaaauuauaagauauauaaaacaccaaccaggauuuacaaaucaaacaauaagggagaaauauggugugcaggugauguccauuguuuccaggaauuuacgccaguacuacaagaagugguugacaaauuaaagaaaaugacauguuuuuuaacagagccugaggcagaggaggaugcauucucaauugcuauagcuaugugcaaaauucuagacaaagggguuugcacuauaaacagcgaaagguggaacaucauaaaaugugauaguggucuuauguauuauacagaucagagagaugggcaagauacagggaaugauuuuggggaguacuguauaucacacaauuguaagacagaaagguucccuaucaauccgucuauaauaagugauuguauaugggaauaccauucuaggaaauccaaguauauuagcaccuugaauuuagaaaguuuagaagaauucaaaagggcuauuucagaaaagcucucacauacacucguaguauaucaguuuaaaccaacaucuaaccuuccccauaugaagccaguguauaaauauauuacagcacaagggguugaaaauucugauggaauagacucagcauuuaucacagccaguaugccagcucucaguggaacuaguauaggauauaauguaaugucuaaagauaauuuccccuuauuugauauaauuauauuuauaaagagugcaguuauuaagaccacauacaaucauauuuaugacacaggccccacuauugguauuaauguaaugcaugaugaacauugcacaggacaguguccgauagaaauaccucacaaagaaaacugguugacauucucccaagaaagaacaagccgauggggcugugaggaauucgggugcuuagcuauaaauacagguuguguguuuggaucuugccaagauauaaucaggccugagacuaagguauauaggaaggcaauagaagaaaguguuuuguugacagucugugugacauacccaggcaauaccuuuugcacagaaauaaaugcuauagaaccuaaaauaacagaugaauuagagcuccaauucaaaacaguagauacaaagacacuacccaaucugcuagcaguucaaaaccauaagcuguacaguggucagauaaaugaccuaggguccuuugcacaagguugcggaaauauccagaaaacuaacuuaucuguaauaggaacugguacagcaaaauuugacuacauaugucauggugccucaagaaaagacauaauaguuagaagauguuauaauaacaauuaugaaucaugcaaauuguugaaggaagagccaagccuaaucuuuucugauaaucaugaaacaauagaaguagcaaauauucggcaccuucuuggagaauugcaauuuaaguuaaugcugggugauuugagauauaaaucauuugcagaaaacccagagcuagagauagaggcaaaguguguuggaugcccaucaugcuuuucuaguuauuccugcaauuuccgaauaaguucaaguauugauacaguaugugcaauagauggaccaugcacaauauuucacaauagauuaauuauuaguucaacuaagcaagauuauggcaucaagaugagcuguaaagaaaagccaaacucaguugaaaaauucaacauauguaagagaguauauucaguguuguucacaacuauugauaaaaaugauaagauugaaauaaauacaggagaccaaacuucauuuauacaagaaaaggaugacagaugcaaaacauggcucuguagaguuagagaugaagggauaaguguuauuuuugagccgauaaaagcauucuuugggaguuauuucagcauugcauucuaugugguaauugggauaauagcacuuuuuaucauaauauauaucuuuuugccaaugguuuuuaaauuaaaagacauacuuaagaagaaugaacucuuauauuuacaagagaugaaauauaaguag

SEQ ID NO: 4121 - RNA, 4305 nt, Artificial Sequence
  derived and/or modified CDS sequence (wt) from ANADV(EIV-16356Mg)__KT313736.1__GP
auguuuuuaauucuugucuuauugauaccauucuauaucacagcuacuccagugacaacaaggugcuuccauggaggccagcugauagcagaaagcaaaucuuugacagcaaucucagaguuuugccuaaaagaugaugucucaacugucaaaucugaaauaacauaccugaaaaaugacacaggaauauuugcucacagcaagguauuaaggaauuggauaauaaaagacuggaaaaauugcaauccuguaccaacagcaggaggcaguauaaaugucauagagguaaaugcagauuugagccuauccacaaaaacauauguaugcagccgagauuguacaaucacaguugauaaagaggaugcccaaauaauuuuccaaacagacaaauuaaaucacuuugaaguuucaggcaccacacuaaguucaggcugguucaagacuaaggcaucaguaacauuagauagaacaugcgagcauauaaaagugacuugugggaaaaagacacuacaguuccaugcuugcuuuaagcaucacaugucaugcauaagauucuuccacaauacaauacucccagggacaauggcuguaucuauaugccagaauauagagcucauuauaauaacaagcuuaaccuugauuaucuucauauugauggugauacugacaaaaacauauauaugcuauguuuuaaugccuuuauucaugccaguagcauauuuguauggcugggcuuacaauaggaguugcaaaaaguguucauguugugggcuugcauaucauccauucaccaauugugguucacauuguguaugugggcugaaauuugaagcaucagacagaaugaggauacaucgggaaucaggauugugucagggauauaagagcuuaaggguggcaaggcugcuaugcaaaucaaaaggcucuucuuuaauuaucucuauauuacugucagugcuaauuuuaagcuuuguuacaccuauagagggaacacuaacaaauuacccagaaucaaagaaauacaguuuggaagagauagcugauguuauagaaggauucauugcugagaaagggauaaaagaauauauugugcuauauacuucaauauuuggugcuuuauuauuauuaauagcauuaaucaucacaguuucuuuaaacagaauuacagaauaucuaacuaaucuaaaugucauuuauugccaugaauguuccauguaucauuccaaaaagaauauaaaauacauuggugacuuuacuaauaaauguggguucugcacauguggcgaauuagaagaucaggaaggucucaauaugcauaaaguaagcaaaaagugcauauaccgauaucaguuaacuuggucuaaagugauuaugacaaucuuagucugucuauuaaucgcucagaacacugugcugauuguagcagcaaaugaugacugcugggcuaaacaaucauuagaaauagaaugcguuggacccuuacagcagguagaugcuugugaggauaagucaaguagaucuuacaauggagaggcaaaaaaacuaguugggacaucaaagguaacagaauuagaugcuggacaagugaaucuucuuggucaaacuauagagucagcaaucauugcaauaaggaaacaaagaacauaugcaacuaugcauuuccuugaaucaguauuuuuaggaaggcauugugauuauuacaaaguauuugaacauaauagugguuacucucaagcaaaauggagguugcuagccaaaacaaaucacuuugauaucugcucaaggcauagcacacaucauuuuugcagaugcaugucagauggaacaaaaugcgaaaaugggaauugggauuuugcaggcgaaaugaauacuacuuaccauucaaaaagagacuucuuuaaacaugauuuuaaguuauuuugcacuuuacuugaaaaugcauucccuggcacaacagagucccuuuauuaccaacucuugucaaagagaaacacaacaggggcaucaaaauuauuagggaaguugauuacaaaauuugggaauaacaaucucuuuguagggaucuggaaauuuggccaauuuuuguuguccuuacccuaugucaacaauacagaguugagugcacuacaauccucaaaaauauuggaaaguccagaaccucuccuuaggucagcuagugggagacaagaaucauuaucuagugccacuccuggagaggcaucuaaagaauguagaaaugcaaagaaaauuucaugcauaagcccuagauuuggaguuccuauggaaaacuugaccgcauguggagaauccccaaauuauaagauauauaaaacaccaaccaggauuuacaaaucaaacaauaagggagaaauauggugugcaggugauguccauuguuuucaggaauuuacgccauuacuacaagaagugguugauaaguuaaagaaaaugacaugcuuuuuaacagagccugaggcagaggaggaugcauucucaauugcuauagcuaugugcaaaauucuagacaaaggaguuugcacuauaaacagcgaaagguggaacaucauaaaaugugauaguggucuuauguauuauacagaccagagagaugggcaagauacagggaaugauuuuggggaguacuguauaucacacaauuguaagacagaaagauucccuaucaauccgucuauaauaagugauuguauaugggaauaccauucuaggaaauccagguauauuagcaccuugaauuuagaaaguuuagaagaauucaaaagggcuauuucagaaaagcucucacauacacucguaguguaucaguuuaagccaacaucuaaccuuccccauaugaagccaguguauaaauauauuacagcacaagggguugaaaauucugauggaauagacucagcauuuaucacagccaguaugccagcucucaguggaacuaguauaggauauaauguaaugucuaaagauaauuuccccuuauuugauaucauuauauuuauaaagagugcaguuauuaagaccacauacaaucauauuuaugacacaggccccacuauugguauuaauguaaugcaugaugaacauugcacaggacaguguccgauagaaauaccccacaaagaaaacugguugacauucucucaagagagaacaagccgaugggguugugaggaauuugggugcuuagcuauaaauacagguuguguguuuggaucuugccaagauauaaucaggccugagacuaagguauauaggaaggcaauagaagaaaguguuuuguuaacagucugugugacauacccaggcaauaccuuuugcacagaaauaaaugcuauagaaccuaaaauaacagaugaauuagagcuccaauucaaaacaguagauacaaagacacuacccaaucugcuagcaguucaaaaccauaagcuguacaguggucagauaaaugaccuaggguccuuugcacaagguugcggaaauauccagaaaacuaacuuaucugugauaggaacugguacagcaaaauuugacuacauaugucauggugccucaagaaaagacauaguaguuagaagauguuauaauaacaauuaugaaucaugcaaauuguugaaggaggagccaagccuaaucuuuucugauaaucaugaaacaauagaaguagcaaauauucgacaccuucuuggagaauugcaguuuaaauuaaugcugggugauuuaagauauaaaucauuugcagaaaacccagagcuagagauagaggcaaaguguguuggaugcccaucaugcuuuucuaguuauuccugcaacuuccgaauaaguucaaguauugauacaguaugugcaauagauggaccaugcacaauauuucacaauagauuaauuauuaguucaacuaagcaagauuauggcaucaagaugagcuguaaagaaaagccaaacccaguugaaaaauucaacauauguaagagaguauauucaguguuguucacaacuauugauaaaaaugauaagauugaaauaaauacaggagaccaaacuucauuuauacaagaaaaggaugacagaugcaaaacauggcucuguagaguuagagaugaagggauaaguguuauuuuugagccgauaaaagcauucuuugggaguuauuucagcauugcauucuauguaguaauugggauaauagcacuuuuuaucacaauauauaucuuuuugccaaugguuuuuaaauuaaaagacauacuuaaaaagaaugaacucuuauauuuacaagagaugaaauauaaguag

SEQ ID NO: 4122 - RNA, 4305 nt, Artificial Sequence
  derived and/or modified CDS sequence (wt) from ANADV(EIV-17769Yak)__KT313739.1__GP
auguuuuuaauucuugucuuauugauaccauucuauaucacagcuacuccaguggcaacaaggugcuuccaugggggccagcugauagcagaaagcaaaucuuugacagcaaucucagaguuuugccuaaaagaugaugucucaacugucaaaucugaaauaacauaccugaaaaaugacacaggaauauuugcucacagcaagguauuaaggaauuggauaauaaaagacuggaaaaauugcaauccuguaccaacagcaggaggcaguauaaaugucauagagguaaaugcagauuugagccuauccacaaaaacauauguaugcagccgagauuguacaaucacaguugauaaagaggaugcccaaauaauuuuccaaacagacaacuuaaaucacuuugaaguuucaggcaccacacuaaguucaggcugguucaagacuaaggcaucaguaacauuagauagaacaugugagcauauaaaagugacuugugggaaaaagacacuacaguuccaugcuugcuuuaagcaucacaugucaugcauaagauucuuccacaauacaauacucccagggacaauggcuguaucuauaugccagaauauagagcucauuauaauaacaagcuuaaccuugauuaucuucauauugauggugauacugacaaaaacauauauaugcuauguuuuaaugccuuuauucaugccaguagcauauuuguauggcugggcuuacaauaggaguugcaaaaaguguucauguugugggcuugcauaucauccauucaccaauugugguucacauuguguaugugggcugaaauuugaagcaucagacagaaugaggauacaucgggaaucaggauugugucagggauauaagagcuuaaggguggcaaggcugcuaugcaaaucaaaaggcucuucuuuaauuaucuccauauuacugucagugcuaauuuuaagcuuuguuacaccuauagagggaacacuaacaaauuacccagaaucaaagaaauacaguuuggaagagauagcugauguuauagaaggauucauugcugagaaagggauaaaagaauauauugugcuauauacuucaauauuuggugcuuuauuauuauuaauagcauuaaucaucacagucucuuuaaacagaauuacagaauaucuaacuaaucuaaaugucauuuauugccaugaauguuccauguaucauuccaaaaagaauauaaaauacguuggugacuuuacuaauaaauguggguucugcacauguggcgaauuagaagaucaggaaggucucaauaugcauaaaguaagcaaaaagugcauauaccgauaucaguuaacuuggucuaaagugauuaugacaaucuuagucugucuauuaaucgcucagaacacugugcugauuguagcagcaaaugacgacugcugggcuaaacaaucauuagaaauagaaugcguuggacccuuacagcagguagaugcuugugaggauaagucaaguagaucuuacaauggagaggcaaaaaaacuaguugggacaucaaagguaacagaauuagaugcuggacaagugaaucuucuuggucaaacuauagagucagcaaucauugcaauaaggaaacaaagaacauaugcaacuaugcauuuccuugaaucaguauuuuuaggaaggcauugugauuauuacaaaguauuugaacauaauagugguuacucucaagcaaaauggagguugcuagccaaaacaaaucacuuugauaucugcucaaggcauagcacacaucauuuuugcagaugcaugucagauggaacaaaaugcgaaaaugggaaucgggauuuugcaggcgaaaugaauacuacuuaccauucaaaaagagacuucuuuaaacaugauuuuaauuuauuuugcacuuuacuugaaaaugcauucccuggcacaacagagucccuuuauuaccaacucuugucaaagagaaacacaacaggggcaucaaaauuauuagggaaguugauuacaaaauuugggaauaacaaucucuuuguagggaucuggaaauuuggccaauuuuuguuguccuuacccuaugucaacaauacagaguugagugcacuacaauccucaaaaauauuggaaaguccagaaccucuccuuaggucagcuagugggagacaagaaucauuaucuagugccacuccuggagaggcaucuagagaauguagaaaugcaaagaaaauuucaugcauaagcccuagauuuggaguuccuauggaaaacuugaccgcauguggagaauccccaaauuauaagauauauaaaacaccaaccaggauuuacaaaucaaacaauaagggagaaauauggugugcaggugauguccauuguuuucaggaauuuacgccaguacuacaagaagugguugauaaguuaaagaaaaugacaugcuuuuuaacagagccugaggcagaggaggaugcauucucaauugcuauagcuaugugcaaaauucuagauaaaggaguuugcacuauaaacagcgaaagguggaacaucauaaaaugugauaguggucuuauguauuauacagaccagagagauggacaagauacagggaaugauuuuggggaguacuguauaucacacaauuguaagacagaaagauucccuaucaauccgucuauaauaagugauuguauaugggaauaccauucuaggaaauccagguauauuagcaccuugaauuuagaaaguuuagaagaauucaaaagggcuauuucagaaaagcucucacauacacucguaguguaucaguuuaagccaacaucuaaccuuccccauaugaagccaguguauaaauauauuacagcacaagggguugaaaauucugauggaauagacucagcauuuaucacagccaguaugccagcucucaguggaacuaguauaggauauaauguaaugucuaaagauaauuuccccuuauuugauaucauuauauuuauaaagagugcaguuauuaagaccacauacaaucauauuuaugacacaggccccacuauugguauuaauguaaugcaugaugaacauugcacaggacaguguccgauagaaauaccccacaaagaaaacugguugacauucucucaagagagaacaagccgaugggguugugaggaauuugggugcuuagcuauaaauacagguuguguguuuggaucuugccaagauauaaucaggccugagacuaagguauauaggaaggcaauagaagaaaguguuuuguuaacagucugugugacauacccaggcaauaccuuuugcacagaaauaaaugcuauagaaccuaaaauaacagaugaauuagagcuccaauucaaaacaguagauacaaagacacuacccaaucugcuagcaguucaaaaccauaagcuguacaguggucagauaaaugaccuaggguccuuugcacaagguugcggaaauauccagaaaacuaacuuaucugugauaggaacugguacagcaaaauuugacuacauaugucauggugccucaagaaaagacauaguaguuagaagauguuauaauaacaauuaugaaucaugcaaauuguugaaggaggagccaagccuaaucuuuucugauaaucaugaaacaauagaaguagcaaauauucgacaccuucuuggagaauugcaguuuaaauuaaugcugggugauuuaagauauaaaucauuugcagaaaacccagagcuagagauagaggcaaaguguguuggaugcccaucaugcuuuucuaguuauuccugcaacuuccgaauaaguucaaguauugauacaguaugugcaauagauggaccaugcacaauauuucacaauagauuaauuauuaguucaacuaagcaagauuauggcaucaagaugagcuguaaagaaaagccaaacccaguugaaaaauucaacauauguaagagaguauauucaguguuguucacaacuauugauaaaaaugauaagauugaaauagauacaggagaccaaacuucauuuauacaagaaaaggaugacagaugcaaaacauggcucuguagaguuagagaugaagggauaaguguuauuuuugagccgauaaaagcauucuuugggaguuauuucagcauugcauucuauguaguaauugggauaauagcacuuuuuaucacaauauauaucuuuuugccaaugguuuuuaaauuaaaagacauacuuaaaaagaaugaacucuuauauuuacaggagaugaaauauaaguag

SEQ ID NO: 4123 - RNA, 4305 nt, Artificial Sequence
  derived and/or modified CDS sequence (wt) from ANADV(EIV-18098Yak)__KT313742.1__GP
auguuuuuaauucuugucuuauugauaccauucuauaucacagcuacuccagugacaacaaggugcuuccaugggggccagcugauagcagaaagcaaaucuuugacagcaaucucagaguuuugccuaaaagaugaugucucaacugucaaaucugaaauaacauaccugaaaaaugacacaggaauauuugcucacagcaagguauuaaggaauuggauaauaaaagacuggaaaaauugcaauccuguaccaacagcaggaggcaguauaaaugucauagagguaaaugcagauuugagccuauccacaaaaacauauguaugcagccgagauuguacaaucacaguugauaaagaggaugcccaaauaauuuuccaaacagacaaauuaaaucacuuugaaguuucaggcaccacacuaaguucaggcugguucaagacuaaggcaucaguaacauuagauagaacaugugagcauauaaaagugacuugugggaaaaagacacuacaguuccaugcuugcuuuaagcaucacaugucaugcauaagauucuuccacaauacaauacucccagggacaauggcuguaucuauaugccaaaauauagagcucauuauaauaacaagcuuaaccuugauuaucuucauauugauggugauacugacaaaaacauauauaugcuauguuuuaaugccuuuauucaugccaguagcauauuuguauggcugggcuuacaauaggaguugcaaaaaguguucauguugugggcuugcauaucauccauucaccaauugugguucacauuguguaugugggcugaaauuugaagcaucagacagaaugaggauacaucgggaaucaggauugugucagggauauaagagcuuaaggguggcaaggcugcuaugcaaaucaaaaggcucuucuuuaauuaucucuauauuacugucagugcuaauuuuaagcuuuguuacaccuauagagggaacacuaacaaauuacccagaaucaaagaaauauaguuuggaagagauagcugauguuauagaaggauucauugcugagaaagggauaaaagaauauauugugcuauauacuucaauauuuggugcuuuauuauuauuaauagcauuaaucaucacagucucuuuaaacagaauuacagaauaucuaacuaaucuaaaugucauuuauugccaugaauguuccauguaucauuccaaaaagaauauaaaauacguuggugacuuuacuaauaaauguggguucugcacauguggcgaauuagaagaucaggaaggucucaauaugcauaaaguaagcaaaaagugcauauaccgauaucaguuaacuuggucuaaagugauuaugacaaucuuagucugucuauuaaucgcucagaacacugugcugauuguagcagcaaaugaugacugcugggcuaaacaaucauuagaaauagaaugcguuggacccuuacagcagguagaugcuugugaggauaagucaaguagaucuuacaauggagaggcaaaaaaacuaguugggacaucaaagguaacagaauuagaugcuggacaagugaaucuucuuggucaaacuauagagucagcaaucauugcaauaaggaaacaaagaacauaugcaacuaugcauuuccuugaaucaguauuuuuaggaaggcauugugauuauuacaaaguauuugaacauaauagugguuacucucaagcaaaauggagguugcuagccaaaacaaaucacuuugauaucugcucaaggcauagcacacaucauuuuugcagaugcaugucagauggaacaaaaugcgaaaaugggaauugggauuuugcaggcgaaaugaauacuacuuaccauucaaaaagagacuucuuuaaacaugauuuuaauuuauuuugcacuuuacuugaaaaugcauucccuggcacaacagagucccuuuauuaccaacucuugucaaagagaaacacaacaggggcaucaaaauuauuagggaaguugauuacaaaauuugggaauaacaaucucuuuguagggaucuggaaauuuggccaauuuuuguuguccuuacccuaugucaacaauacagaguugagugcacuacaauccucaaaaauauuggaaaguccagaaccucuccuuaggucagcuagugggagacaagaaucauuaucuagugccacuccuggagaggcaucuagagaauguagaaaugcaaagaaaauuucaugcauaagcccuagauuuggaguuccuauggaaaacuugaccgcauguggagaauccccaaauuauaagauauauaaaacaccagccaggauuuacaaaucaaacaauaagggagaaauauggugugcaggugauguccauuguuuucaggaauuuacgccaguacuacaagaagugguugauaaguuaaagaaaaugacaugcuuuuuaacagagccugaggcagaggaggaugcauucucaauugcuauagcuaugugcaaaauucuagacaaaggaguuugcacuauaaacagcgaaagguggaacaucauaaaaugugauaguggucuuauguauuauacagaccagagagauggacaagauacagggaaugauuuuggggaguacuguauaucacacaauuguaagacagaaagauucccuaucaauccgucuauaauaagugauuguauaugggaauaccauucuaggaaauccagguauauuagcaccuugaauuuagaaaguuuagaagaauucaaaagggcuauuucagaaaagcucucacauacacucguaguguaucaguuuaagccaacaucuaaccuuccccauaugaagccaguguauaaauauauuacagcacaagggguugaaaauucugauggaauagacucagcauuuaucacagccaguaugccagcucucaguggaacuaguauaggauauaauguaaugucuaaagauaauuuccccuuauuugauaucauuauauuuauaaagagugcaguuauuaagaccacauacaaucauauuuaugacacaggccccacuauugguauuaauguaaugcaugaugaacauugcacaggacaguguccgauagaaauaccccacaaagaaaacugguugacauucucucaagagagaacaagccgaugggguugugaggaauuugggugcuuagcuauaaauacagguuguguguuuggaucuugccaagauauaaucaggccugagacuaagguauauaggaaggcaauagaagaaaguguuuuguuaacagucugugugacauacccaggcaauaccuuuugcacagaaauaaaugcuauagaaccuaaaauaacagaugaauuagagcuccaauucaaaacaguagauacaaagacacuacccaaucugcuagcaguucaaaaccauaagcuguacaguggucagauaaaugaccuaggguccuuugcacaagguugcggaaauauccagaaaacuaacuuaucugugauaggaacugguacagcaaaauuugacuacauaugucauggugccucaagaaaagacauaguaguuagaagauguuauaauaacaauuaugaaucaugcaaauuguugaaggaggagccaagccuaaucuuuucugauaaucaugaaacaauagaaguagcaaauauucgacaccuucuuggagaauugcaguuuaaauuaaugcugggugauuuaagauauaaaucauuugcagaaaacccagagcuagagauagaggcaaaguguguuggaugcccaucaugcuuuucuaguuauuccugcaacuuccgaauaaguucaaguauugauacaguaugugcaauagauggaccaugcacaguauuucacaauagauuaauuauuaguucaacuaagcaagauuauggcaucaagaugagcuguaaagaaaagccaaacccaguugaaaaauucaacauauguaagagaguauauucaguguuguucacaacuauugauaaaaaugauaagauugaaauaaauacaggagaccaaacuucauuuauacaagaaaaggaugacagaugcaaaacauggcucuguagaguuagagaugaagggauaaguguuauuuuugagccaauaaaagcauucuuugggaguuauuucagcauugcauucuauguaguaauugggauaauagcacuuuuuaucacaauauauaucuuuuugccaaugguuuuuaaauuaaaagacauacuuaaaaagaaugaacucuuauauuuacaggagaugaaauauaaguag

SEQ ID NO: 4124 - RNA, 4305 nt, Artificial Sequence
  derived and/or modified CDS sequence (wt) from ANADV(EIV-18136Yak)__KT313745.1__GP
auguucuuaauucuugucuuauugauaccauucuauaucacagcuacuccagugacaacaaggugcuuccaugggggccagcugauagcagaaagcaaaucuuugacagcaaucucagaguuuugccuaaaagaugaugucucaacugucaaaucugaaauaacauaccugaaaaaugacacaggaauauuugcucacagcaaaguauuaaggaauuggauaauaaaagacuggaaaaauugcaauccuguaccaacagcaggaggcaguauaaaugucauagagguaaaugcagauuugagccuauccacaaaaacauauguaugcagccgagauuguacaaucacaguugauaaagaggaugcccaaauaauuuuucaaacagacaaauuaaaucacuuugaaguuucaggcaccacacuaaguucaggcugguucaagacuaaggcaucaguaacauuagauagaacaugugagcauauaaaagugacuugugggaaaaagacacuacaguuccaugcuugcuuuaagcaucacaugucaugcauaagauucuuccacaauacaauacucccagggacaauggcuguaucuauaugccagaauauagagcucauuauaauaacaagcuuaaccuugauuaucuucauauugauggugauauugacaaaaacauauauaugcuaugucuuaaugccuuuauucaugccaguagcauauuuauauggcugggcuuacaauaggaguugcaaaaaguguucauguugugggcuugcauaucauccauucaccaauugugguucccauuguguaugugggcugaaauuugaagcaucagacagaaugaggauacaucgggaaucaggauugugucagggauauaaaagcuuaaggguggcgaggcugcuaugcaaaucaaaaggcucuucuuuaauuaucucuauauuacugucagugcuaauuuuaagcuuuguuacaccuauagagggaacacuaacaaauuacccagaaucaaagaaauacaguuuggaagagauagcugauguuauagaaggauucauugcugagaaagggauaaaagaauauauugugcuauauacuucaauauuuggugcuuuauuauuauuaauagcauuaaucaucacagucucuuuaaacagaauuacagaauaucuaacuaaucuaaaugucauuuauugccaugaauguuccauguaucauuccaaaaagaauauaaaauacauuggugacuuuacuaauaaauguggguucuguacauguggcgaauuagaagaucaggaaggucucaauaugcauaaaguaagcaaaaagugcauauaccgauaucaguuaacuuggucuaaagugauuaugacaaucuuagucugucuauuaaucgcucagaacacugugcugauuguagcagcaaaugaugacugcugggcuaaacaaucauuagaaauagaaugcguuggacccuuacagcagguagaugcuugugaggauaagucaaguagaucuuacaauggagaggcaaaaaaacuaguugggacaucaaagguaacagaauuagaugcuggacaagugaaucuucuuggucaaacuauagagucagcaaucauugcaauaaggaaacaaagaacauaugcaacuaugcauuuccuugaaucaguauuuuuaggaaggcauugugacuauuacaaaguauuugaacauaauagugguuacucucaagcaaaauggagguugcuagccaaaacaaaucacuuugauaucugcucaaggcauagcacacaucauuuuugcagaugcaugucagauggaacaaaaugcgaaaauggaaauugggauuuugcaggcgaaaugaauacuacuuaccauucaaaaagagauuucuuuaaacaugauuuuaaauuauuuugcacuuuacuugaaaaugcauuccccggcacaacagagucccuuuauuaccaacuuuugucaaagagaaauacaacaggggcaucaaaauuauuagggaaguugauuacaaaauucgggaauaacaaucucuuuguagggaucuggaaauuuggccaauuuuuguuguccuuacccuaugucaacaauacagaguugagcgcacugcaauccucaaagauauuggaaagcccagaaccucuccuuaggucagcuagugggagacaagaaucauugucuagugccacuccuggggaggcaucuaaagaauguagaaaugcaaagaaaauuucaugcauaagcccuagauuuggaguuccuauggaaaacuugacugcauguggagaauccccaaauuauaagauauauaaaacaccaaccaggauuuacaaaucaaacaauaagggagaaauaugguguguaggugauguucauugcuuucaggaauuuacgccaguacuacaagaaguggucgacaaauuaaagaaaaugacauguuuuuuaaccgagccugaggcagaggaggaugcauucucaaucgcuauagcuaugugcaaaauucuagacaaaggaguuugcaccauaaacagcgaaagguggaacaucaugaaaugugauaguggucuuauguauuauacagaucagagagaugggcaagauacagggaaugauuuuggggaguacuguauaucacacaauuguaagacagaaagauucccuaucaauccgucuauaauaagugauuguauaugggaauaccauucuagaaaauccagguauauuggcaccuugaauuuagaaaguuuagaagaguucaaaagggcuauuucagaaaagcucucacauacacuuguaguguaucaguuuaagccaacaucuaaccuuccccauaugaagccaguguauaaauauauuacagcacaagggguugaaaauucugauggaauagacucagcauuuaucacagccaguaugccagcucucaguggaacuaguauaggauauaauguaaugucuaaagacaauuuccccuuauuugauauaauuauauuuauaaagagugcaguuauuaagaccacauacaaucauauuuaugacacagggcccacuauugguauuaauguaaugcaugaugaacauugcacaggacaguguccgauagaaauaccucacaaagaaaacugguugacauucucucaagagagaacaagccgaugggguugugaggaauuugggugcuuagcuauaaauacagguuguguguuuggaucuugucaagauauaaucaggccugagacuaagguauauaggaaggcaauagaagaaagugucuuguugacagucugugugacauacccaggcaauaccuuuugcacagaaauaaaugcuauagaaccuaaaauaacagaugaauuagagcuccaauucaaaacaguagauacaaagacacuacccaauuugcuagcaguucaaaaccauaagcuguacaguggucagauaaaugaccuaggguccuuugcacaagguugcggaaauauccagaaaacuaacuuaucugugauaggaacuggaacagcaaaauuugacuacauaugucauggugccucaagaaaagacauagugguuagaagauguuauaauaacaauuaugaaucaugcaaauuguugaaggaggagccaagccuaaucuuuucugauaaucaugaaacaauagaaguagcaaauauucggcaccuucuuggagaauugcaguuuaaauuaaugcugggugauuugagauauaaaucauuugcagaaaacccagagcuagagauagaggcaagguguguuggaugcccaucaugcuuuucuaguuauuccugcaauuuccgaauaaguucaaguauugauacaguaugugcaauagauggaccaugcacaauauuucacaauagauuaauuauuaguucaacuaagcaagauuauggcaucaagaugagcuguaaagaaaagccaaacccaguugaaaaauucaacauauguaagagaguauauucaguguuguucacaacuauugauaaaaaugauaagauugaaauaaauacaggagaccaaacuucauuuauacaagaaaaggaugacagaugcaaaacauggcucuguagaguuagagaugaagggauaaguguuauuuuugagccgauaaaagcauucuuugggaguuauuucagcauugcauucuauguggugauugggauaauagcacuuuuuaucauaauauauaucuuuuugccaaugguuuuuaaauuaaaagacauacuuaaaaagaaugaacucuuauauuuacaagagaugaaauauaaguag

SEQ ID NO: 4125 - RNA, 4305 nt, Artificial Sequence
  derived and/or modified CDS sequence (wt) from ANADV(EIV-18146Yak)__KT313748.1__GP
auguuuuuaauucuugucuuauugauaccauucuauaucacagcuacuccagugacaacaaggugcuuccaugggggccagcugauagcagaaagcaaaucuuugacagcaaucucagaguuuugccuaaaagaugaugucucaacugucaaaucugaaauaauauaccugaaaaaugacacaggaauauuugcucacagcaaaguauuaaggaauuggauaauaaaagacuggaaaaauugcaauccuguaccaacagcaggaggcaguauaaaugucauagagguaaaugcagauuugagccuauccacaaaaacauauguaugcagccgggauuguacaaucacaguugauaaagaggaugcccaaauaauuuuucaaacagacaaauuaaaucacuuugaaguuucaggcaccacacuaaguucaggcugguucaagacuaaggcaucaguaacauuagauagaacaugugagcauauaaaagugacuugugggaaaaagacacuacagcuccaugcuugcuuuaagcaucacaugucaugcauaagauucuuccacaauacaauacucccagggacaauggcuguaucuauaugccagaauauagagcucauuauaauaacaagcuuaaccuugauuaucuucauauugauggugauauugacaaaaacauauauaugcuaugucuuaaugccuuuauucaugccaguagcauauuuauauggcugggcuuacaauaggaguugcaaaaaguguucauguugugggcuugcauaucauccauucaccaauugugguucccauuguguaugugggcugaaauuugaagcaucagacagaaugaggauacaucgggaaucaggauugugucagggauauaaaagcuuaaggguggcgaggcugcuaugcaaaucaaaaggcucuucuuuaauugucucuauauuacugucagugcuaauuuuaagcuuuguuacaccuauagagggaacacuaacaaauuacccagaaucaaagaaauacaguuuggaagagauagcugauguuauagaaggauucauugcugagaaagggauaaaagaauauauugugcuauauacuucaauauuuggugcuuuauuauuauuaauagcauuaaucaucacagucucuuuaaacagaauuacagaauaucuaacuaaucuaaaugucauuuauugccaugaauguuccauguaucauuccaaaaagaauauaaaauacauuggugacuuuacuaauaaauguggguucuguacauguggcgaauuagaagaucaggaaggucucaauaugcauaaaguaagcaaaaagugcauauaccgauaucaguuaacuuggucuaaagugauuaugacaaucuuagucugucuauuaaucgcucagaacacugugcugauuguagcagcaaaugaugacugcugggcuaaacaaucauuagaaauagaauguguuggacccuuacagcagguagaugcuugugaggauaagucaaguagaucuuacaaugaagaggcaaaaaaacuaguugggacaucaaagguaacagaauuagaugcuggacaagugaaucuucuuggucaaacuauagagucagcaaucauugcaauaaggaaacaaagaacauaugcaacuaugcauuuccuugaaucaguauuuuuaggaaggcauugugacuauuacaaaguauuugaacauaauagugguuacucucaagcaaaauggagguugcuagccaaaacaaaucacuuugauaucugcucaaggcauagcacacaucauuuuugcagaugcaugucagauggaacaaaaugcgaaaauggaaauugggauuuugcaggcgaaaugaauacuacuuaccauucaaaaagagauuucuuuaaacaugauuuuaauuuauuuugcacuuuacuugaaaaugcauuccccggcacaacagagucccuuuauuaccaacuuuugucaaagagaaauacaacaggggcaucaaaauuauuagggaaguugauuacaaaauucgggaauaacaaucucuuuguagggaucuggaaauuuggccaauuuuuguuguccuuacccuaugucaacaauacagaguugagcgcacugcaauccucaaagauauuggaaaguccagaaccucuccuuaggucagcuagugggagacaagaaucauugucuagugccacuccuggggaggcaucuaaagaauguagaaaugcaaagaaaauuucaugcauaagcccuagauuuggaguuccuauggaaaacuugacugcauguggagaauccccaaauuauaagauauauaaaacaccaaccaggauuuacaaaucaaacaauaagggagaaauauggugugcaggugauguucauugcuuucaggaauuuacgccaguacuacaagaaguggucgacaaauuaaagaaaaugacauguuuuuuaacagagccugaggcagaggaggaugcauucucaauugcuauagcuaugugcaaaauucuagacaaaggaguuugcaccauaaacagcgaaagguggaacaucauaaaaugugauaguggucuuauguauuauacagaucagagagaugggcaagauacagggaaugauuuuggggaguacuguauaucacacaauuguaagacagaaagauucccuaucaauccgucuauaauaagugauuguauaugggaauaccauucuagaaaauccagguauauuagcaccuugaauuuagaaaguuuagaagaguucaaaagggcuauuucagaaaagcucucacauacacucauaguguaucaguuuaagccaacaucuaaccuuccccauaugaagccaguguauaaauauauuacagcacaagggguugaaaauucugauggaauagacucagcauuuaucacagccaguaugccagcucucaguggaacuaguauaggauauaauguaaugucuaaagauaauuuccccuuauuugauauaauuauauuuauaaagagugcaguuauuaagaccacauacaaucauauuuaugacacagggcccacuauugguauuaauguaaugcaugaugaacauugcacaggacaguguccgauagaaauaccucacaaagaaaacugguugacauucucucaagagagaacaagccgaugggguugugaggaauuugggugcuuagcuauaaauacagguuguguguuuggaucuugucaagauauaaucaggccugagacuaagguauauaggaaggcaauagaagaaagugucuuguugacagucugugugacauacccaggcaauaccuuuugcacagaaauaaaugcuauagaaccuaaaauaacagaugaauuagagcuccaauucaaaacaguagauacaaagacacuacccaauuugcuagcaguucaaaaccauaagcuguacaguggucagauaaaugaccuaggguccuuugcacaagguugcggaaauauccagaaaacuaacuuaucugugauaggaacuggaacagcaaaauuugacuacauaugucauggugccucaagaaaagacauagugguuagaagauguuauaauaacaauuaugaaucaugcaaauuguugaaggaggagccaagccuaaucuuuucugauaaucaugaaacaauagaaguagcaaauauucggcaccuucuuggagaauugcaguuuaaauuaaugcugggugauuugagauauaaaucauuugcagaaaacccagagcuagagauagaggcaagguguguuggaugcccaucaugcuuuucuaguuauuccugcaauuuccgaauaaguucaaguauugauacaguaugugcaauagauggaccaugcacaauauuucacaauagauuaauuauuaguucaacuaagcaagauuauggcaucaagaugagcuguaaagaaaagccaaacccaguugaaaaauucaacauauguaagagaguauauucaguguuguucacaacuauugauaaaaaugauaagauugaaauaaauacaggagaccaaaccucauuuauacaagaaaaggaugacagaugcaaaacauggcucuguagaguuagagaugaagggauaaguguuauuuuugagccgauaaaagcauucuuugggaguuauuucagcauugcauucuaugugguaauugggauaauagcacuuuuuaucauaauauauaucuuuuugccaaugguuuuuaaauuaaaagacauacuuaaaaagaaugaacucuuauauuuacaagagaugaaauauaaguag

SEQ ID NO: 4126 - RNA, 4305 nt, Artificial Sequence
  derived and/or modified CDS sequence (wt) from ANADV(EIV-18353Yak)__KT313751.1__GP
auguuuuuaauucuugucuuauugauaccauucuauaucacagcuacuccagugacaacaaggugcuuccauggaggccagcugauagcagaaagcaaaucuuugacagcaaucucagaguuuugccuaaaagaugaugucucaacugucaaaucugaaauaauauaccugaaaaaugacacaggaauauuugcucacagcaaaguauuaaggaauuggauaauaaaagacuggaaaaauugcaauccuguaccaacagcaggaggcaguauaaaugucauagagguaaaugcagauuugagccuauccacaaaaacauauguaugcagccgagauuguacaaucacaguugauaaagaggaugcccaaauaauuuuucaaacagacaaauuaaaucacuuugaaguuucaggcaccacacuaaguucaggcugguucaagacuaaggcaucaguaacauuagauagaacaugugagcauauaaaagugacuugugggaaaaagacacuacaguuccaugcuugcuuuaagcaucacaugucaugcauaagauucuuccacaauacaauacucccagggacaauggcuguaucuauaugccagaauauagagcucauuauaauaacaagcuuaacccugauuaucuucauauugauggugauauugacaaaaacauauauaugcuaugucuuaaugccuuuauucaugccaguagcauauuuauauggcugggcuuacaauaggaguugcaaaaaguguucauguugugggcuugcauaucauccauucaccaauugugguucccauuguguaugugggcugaaauuugaagcaucagacagaaugaggauacaucgggaaucaggauugugucagggauauaaaagcuuaaggguggcgaggcugcuaugcaaaucaaaaggcucuucuuuaauuaucucuauauuacugucagugcuaauuuuaagcuuuguuacaccuauagagggaacacuaacaaauuacccagaaucaaagaaauacaguuuggaagagauagcugauguuauagaaggauucauugcugagaaagggauaaaagaauauauugugcuauauacuucaauauuuggugcuuuauuauuauuaauagcauuaaucaucacagucucuuuaaacagaauuacagaauaucuaacuaaucuaaaugucauuuauugccaugaauguuccauguaucauuccaaaaagaauauaaaauacauuggugacuuuacuaauaaauguggguucuguacauguggcgaauuagaagaucaggaaggucucaauaugcauaaaguaagcaaaaagugcauauaccgauaucaguuaacuuggucuaaagugauuaugacaaucuuagucugucuauuaaucgcucagaacacugugcugauuguagcagcaaaugaugacugcugggcuaaacaaucauuagaaauagaaugcguuggacccuuacagcagguagaugcuugugaggauaagucaaguagaucuuacaaugaagaggcaaaaaaacuaguugggacaucaaagguaacagaauuagaugcuggacaagugaaucuucuuggucaaacuauagagucagcaaucauugcaauaaggaaacaaagaacauaugcaacuaugcauuuccuugaaucaguauuuuuaggaaggcauugugacuauuacaaaguauuugaacauaauagugguuacucucaagcaaaauggagguugcuagccaaaacaaaucacuuugauaucugcucaaggcauagcacacaucauuuuugcagaugcaugucagauggaacaaaaugcgaaaauggaaauugggauuuugcaggcgaaaugaauacuacuuaccauucaaaaagagauuucuuuaaacaugauuuuaauuuauuuugcacuuuacuugaaaaugcauuccccggcacaacagagucccuuuauuaccaacuuuugucaaagagaaauacaacaggggcaucaaaauuauuagggaaguugauuacaaaauucgggaauaacaaucucuuuguagggaucuggaaauuuggccaauuuuuguuguccuuacccuaugucaacaauacagaguugagcgcacugcaauccucaaagauauuggaaaguccagaaccucuccuuaggucagcuagugggagacaagaaucauugucuagugccacuccuggggaggcaucuaaagaauguagaaaugcaaagaaaauuucaugcauaagcccuagauuuggaguuccuauggaaaacuugacugcauguggagaauccccaaauuauaagauauauaaaacaccaaccaggauuuacaaaucaaacaauaagggagaaauauggugugcaggugauguucauugcuuucaggaauuuacgccaguacuacaagaaguggucgacaaauuaaagaaaaugacauguuuuuuaacagagccugaggcagaggaggaugcauucucaauugcuauagcuaugugcaaaauucuagacaaaggaguuugcaccauaaacagcgaaagguggaacaucauaaaaugugauaguggucuuauguauuauacagaucagagagaugggcaagauacagggaaugauuuuggggaguacuguauaucacacaauuguaagacagaaagauucccuaucaauccgucuauaauaagugauuguauaugggaauaccauucuagaaaauccagguauauuagcacccugaauuuagaaaguuuagaagaguucaaaagggcuauuucagaaaagcucucacauacacucauaguguaucaguuuaagccaacaucuaaccuuccccauaugaagccaguguauaaauauauuacagcacaagggguugaaaauucugauggaauagacucagcauuuaucacagccaguaugccagcucucaguggaacuaguauaggauauaauguaaugucuaaagauaauuuccccuuauuugauauaauuauauuuauaaagagugcaguuauuaagaccacauacaaucauauuuaugacacagggcccacuauugguauuaauguaaugcaugaugaacauugcacaggacaguguccgauagaaauaccucacaaagaaaacugguugacauucucucaagagagaacaagccgaugggguugugaggaauuugggugcuuagcuauaaauacagguuguguguuuggaucuugucaagauauaaucaggccugagacuaagguauauaggaaggcaauagaagaaagugucuuguugacagucugugugacauacccaggcaauaccuuuugcacagaaauaaaugcuauagaaccuaaaauaacagaugaauuagagcuccaauucaaaacaguagauacaaagacacuacccaauuugcuagcaguucaaaaccauaagcuguacaguggucagauaaaugaccuaggguccuuugcacaagguugcggaaauauccagaaaacuaacuuaucugugauaggaacuggaacagcaaaauuugacuacauaugucauggugccucaagaaaagacauagugguuagaagauguuauaauaacaauuaugaaucaugcaaauuguugaaggaggagccaagccuaaucuuuucugauaaucaugaaacaauagaaguagcaaauauucggcaccuucuuggagaauugcaguuuaaauuaaugcugggugauuugagauauaaaucauuugcagaaaacccagagcuagagauagaggcaagguguguuggaugcccaucaugcuuuucuaguuauuccugcaauuuccgaauaaguucaaguauugauacaguaugugcaauagauggaccaugcacaauauuucacaauagauuaauuauuaguccaacuaagcaagauuauggcaucaagaugagcuguaaagaaaagccaaacccaguugaaaaauucaacauauguaagagaguauauucaguguuguucacaacuauugauaaaaaugauaagauugaaauaaauacaggagaccaaaccucauuuauacaagaaaaggaugacagaugcaaaacauggcucuguagaguuagagaugaagggauaaguguuauuuuugagccgauaaaagcauucuuugggaguuauuucagcauugcauucuaugugguaauugggauaauagcacuuuuuaucauaauauauaucuuuuugccaaugguuuuuaaauuaaaagacauacuuaaaaagaaugaacucuuauauuuacaagagaugaaauauaaguag

SEQ ID NO: 4127 - RNA, 4305 nt, Artificial Sequence
  derived and/or modified CDS sequence (wt) from ANADV(EIV-18560Yak)__KT313754.1__GP
auguuuuuaauucuugucuuauugauaccauucuauaucacagcuacuccagugacaacaaggugcuuccauggaggccagcugauagcagaaagcaaaucuuugacagcaaucucagaguuuugccuaaaagaugaugucucaacugucaaaucugaaauaauauaccugaaaaaugacacaggaauauuugcucacagcaaaguauuaaggaauuggauaauaaaagacuggaaaaauugcaauccuguaccaacagcaggaggcaguauaaaugucauagagguaaaugcagauuugagccuauccacaaaaacauauguaugcagccgagauuguacaaucacaguugauaaagaggaugcccaaauaauuuuucaaacagacaaauuaaaucacuuugaaguuucaggcaccacacuaaguucaggcugguucaagacuaaggcaucaguaacauuagauagaacaugugagcauauaaaagugacuugugggaaaaagacacuacaguuccaugcuugcuuuaagcaucacaugucaugcauaagauucuuccacaauacaauacucccagggacaauggcuguaucuauaugccagaauauagagcucauuauaauaacaagcuuaacccugauuaucuucauauugauggugauauugacaaaaacauauauaugcuaugucuuaaugccuuuauucaugccaguagcauauuuauauggcugggcuuacaauaggaguugcaaaaaguguucauguugugggcuugcauaucauccauucaccaauugugguucccauuguguaugugggcugaaauuugaagcaucagacagaaugaggauacaucgggaaucaggauugugucagggauauaaaagcuuaaggguggcgaggcugcuaugcaaaucaaaaggcucuucuuuaauuaucucuauauuacugucagugcuaauuuuaagcuuuguuacaccuauagagggaacacuaacaaauuacccagaaucaaagaaauacaguuuggaagagauagcugauguuauagaaggauucauugcugagaaagggauaaaagaauauauugugcuauauacuucaauauuuggugcuuuauuauuauuaauagcauuaaucaucacagucucuuuaaacagaauuacagaauaucuaacuaaucuaaaugucauuuauugccaugaauguuccauguaucauuccaaaaagaauauaaaauacauuggugacuuuacuaauaaauguggguucuguacauguggcgaauuagaagaucaggaaggucucaauaugcauaaaguaagcaaaaagugcauauaccgauaucaguuaacuuggucuaaagugauuaugacaaucuuagucugucuauuaaucgcucagaacacugugcugauuguagcagcaaaugaugacugcugggcuaaacaaucauuagaaauagaaugcguuggacccuuacagcagguagaugcuugugaggauaagucaaguagaucuuacaaugaagaggcaaaaaaacuaguugggacaucaaagguaacagaauuagaugcuggacaagugaaucuucuuggucaaacuauagagucagcaaucauugcaauaaggaaacaaagaacauaugcaacuaugcauuuccuugaaucaguauuuuuaggaaggcauugugacuauuacaaaguauuugaacauaauagugguuacucucaagcaaaauggagguugcuagccaaaacaaaucacuuugauaucugcucaaggcauagcacacaucauuuuugcagaugcaugucagauggaacaaaaugcgaaaauggaaaucgggauuuugcaggcgaaaugaauacuacuuaccauucaaaaagagauuucuuuaaacaugauuuuaauuuauuuugcacuuuacuugaaaaugcauuccccggcacaacagagucccuuuauuaccaacuuuugucaaagagaaauacaacaggggcaucaaaauuauuagggaaguugauuacaaaauucgggaauaacaaucucuuuguagggaucuggaaauuuggccaauuuuuguuguccuuacccuaugucaacaauacagaguugagcgcacugcaauccucaaagauauuggaaaguccagaaccucuccuuaggucagcuagugggagacaagaaucauugucuagugccacuccuggggaggcaucuaaagaauguagaaaugcaaagaaaauuucaugcauaagcccuagauuuggaguuccuauggaaaacuugacugcauguggagaauccccaaauuauaagauauauaaaacaccaaccaggauuuacaaaucaaacaauaagggagaaauauggugugcaggugauguucauugcuuucaggaauuuacgccaguacuacaagaaguggucgacaaauuaaagaaaaugacauguuuuuuaacagagccugaggcagaggaggaugcauucucaauugcuauagcuaugugcaaaauucuagacaaaggaguuugcaccauaaacagcgaaagguggaacaucauaaaaugugauaguggucuuauguauuauacagaucagagagaugggcaagauacagggaaugauuuuggggaguacuguauaucacacaauuguaagacagaaagauucccuaucaauccgucuauaauaagugauuguauaugggaauaccauucuagaaaauccagguauauuagcaccuugaauuuagaaaguuuagaagaguucaaaagggcuauuucagaaaagcucucacauacacucauaguguaucaguuuaagccaacaucuaaccuuccccauaugaagccaguguauaaauauauuacagcacaagggguugaaaauucugauggaauagacucagcauuuaucacagccaguaugccagcucucaguggaacuaguauaggauauaauguaaugucuaaagauaauuuccccuuauuugauauaauuauauuuauaaagagugcaguuauuaagaccacauacaaucauauuuaugacacagggcccacuauugguauuaauguaaugcaugaugaacauugcacaggacaguguccgauagaaauaccucacaaagaaaacugguugacauucucucaagagagaacaagccgaugggguugugaggaauuugggugcuuagcuauaaauacagguuguguguuuggaucuugucaagauauaaucaggccugagacuaagguauauaggaaggcaauagaagaaagugucuuguugacagucugugugacauacccaggcaauaccuuuugcacagaaauaaaugcuauagaaccuaaaauaacagaugaauuagagcuccaauucaaaacaguagauacaaagacacuacccaauuugcuagcaguucaaaaccauaagcuguacaguggucagauaaaugaccuaggguccuuugcacaagguugcggaaauauccagaaaacuaacuuaucugugauaggaacuggaacagcaaaauuugacuacauaugucauggugccucaagaaaagacauagugguuagaagauguuauaauaacaauuaugaaucaugcaaauuguugaaggaggagccaagccuaaucuuuucugauaaucaugaaacaauagaaguagcaaauauucggcaccuucuuggagaauugcaguuuaaauuaaugcugggugauuugagauauaaaucauuugcagaaaacccagagcuagagauagaggcaagguguguuggaugcccaucaugcuuuucuaguuauuccugcaauuuccgaauaaguucaaguauugauacaguaugugcaauagauggaccaugcacaauauuucacaauagauuaauuauuaguccaacuaagcaagauuauggcaucaagaugagcuguaaagaaaagccaaacccaguugaaaaauucaacauauguaagagaguauauucaguguuguucacaacuauugauaaaaaugauaagauugaaauaaauacaggagaccaaaccucauuuauacaagaaaaggaugacagaugcaaaacauggcucuguagaguuagagaugaagggauaaguguuauuuuugagccgauaaaagcauucuuugggaguuauuucagcauugcauucuaugugguaauugggauaauagcacuuuuuaucauaauauauaucuuuuugccaaugguuuuuaaauuaaaagacauacuuaaaaagaaugaacucuuauauuuacaagagaugaaauauaaguag

SEQ ID NO: 4128 - RNA, 4305 nt, Artificial Sequence
  derived and/or modified CDS sequence (wt) from ANADV(EIV-18715Yak)__KT313757.1__GP
auguuuuuaauucuugucuuauugauaccauucuauaucacagcuacuccagugacaacaaggugcuuccaugggggccagcugauagcagaaagcaaaucuuugacagcaaucucagaguuuugccuaaaagaugaugucucaacugucaaaucugaaauaacauaccugaaaaaugacacaggaauauuugcucacagcaaaguauuaaggaauuggauaauaaaagacuggaaaaauugcaauccuguaccaacagcaggaggcaguauaaaugucauagagguaaaugcagauuugagccuauccacaaaaacauauguaugcagccgagauuguacaaucacaguugauaaagaggaugcccaaauaauuuuucaaacagacaaauuaaaucacuuugagguuucaggcaccacacuaaguucaggcugguucaagacuaaggcaucaguaacauuagauagaacaugugagcauauaaaagugacuugugggaaaaagacacuacaguuccaugcuugcuuuaagcaucacaugucaugcauaagauucuuccacaauacaauacucccagggacaauggcuguaucuauaugccagaauauagagcucauuauaauaacaagcuuaaccuugauuaucuucauauugauggugauauugacaaaaacauauauaugcuaugucuuaaugccuuuauucaugccaguagcauauuuauauggcugggcuuacaauaggaguugcaaaaaguguccauguugugggcuugcauaucauccauuuaccaauugugguucccauuguguaugugggcugaaauuugaagcaucagacagaaugaggauacaucgggaaucaggauugugucagggauauaaaagcuuaaggguggcgaggcugcuaugcaaaucaaaaggcucuucuuuaauuaucucuauauuacugucagugcuaauuuuaagcuuuguuacaccuauagaggggacacuaacaaauuacccagaaucaaagaaauacaguuuggaagagauagcugauguuauagaaggauucauugcugagaaagggauaaaagaauauauugugcuauauacuucaauauuuggugcuuuauuauuauuaauagcauuaaucaucacagucucuuuaaacagaauuacagaauaucuaacuaaucuaaaugucauuuauugccaugaauguuccauguaucauuccaaaaagaauauaaaauacauuggugacuuuacuaauaaauguggguucuguacauguggcgaauuagaagaucaggaaggucucaauaugcauaagguaagcaaaaagugcauauaccgauaucaguuaacuuggucuaaagugauuaugacaaucuuaaucugucuauuaaucgcucagaacacugugcugauuguagcagcaaaugaugacugcugggcuaaacaaucauuagaaauagaaugcguuggacccuuacagcagguagaugcuugugaggauaagucaaguagaucuuacaauggagaggcaaaaaaacuaguugggacaucaaggguaacagaauuagaugcuggacaagugaaucuucuuggucaaacuauagagucagcaaucauugcaauaaggaaacaaagaacauaugcaacuaugcauuuccuugaaucaguauuuuuaggaaggcauugugacuauuacaaaguauuugaacauaauagugguuacucucaagcaaaauggagguugcuagccaaaacaaaucacuuugauaucugcucaaggcauagcacacaucauuuuugcagaugcaugucagauggaacaaaaugcgaaaauggaaauugggauuuugcaggcgaaaugaauacuacuuaccauucaaaaagagauuucuuuaaacaugauuuuaguuuauuuugcacuuuacuugaaaaugcauuccccggcacaacagagucccuuuauuaccaacuuuugucaaagagaaauacaacaggggcaucaaaauuauuagggaaguugauuacaaaauucgggaauaacaaucucuuuguagggaucuggaaauuuggccaauuuuuguuguccuuacccuaugucaacaauacagaguugagcgcacugcaauccucaaagauauuggaaaguccagaaccucuccuuaggucagcuagugggagacaagaaucauugucuagugccacuccuggggaggcaucuaaagaauguagaaaugcaaagaaaauuucaugcauaagcccuagauuuggaguuccuauggaaaacuugacugcauguggagaauccccaaauuauaagauauauaaaacaccaaccaggauuuacaaaucaaacaauaagggagaaauauggugugcaggugauguucauugcuuucaggaauuuacgccaguacuacaagaaguggucgacaaauuaaagaaaaugacauguuuuuuaacagagccugaggcagaggaggaugcauucucaauugcuauagcuaugugcaaaauucuagacaaaggaguuugcaccauaaacagcgaaagguggaauaucauaaaaugugauaguggucuuauguauuauacagaucagagagaugggcaagauacagggaaugauuuuggggaguacuguauaucacacaauuguaagacagaaagauucccuaucaauccgucuauaauaagugauuguguaugggaauaccauucuagaaaauccagguauauuagcaccuugaauuuagaaaguuuagaagaguucaaaagggcuauuucagaaaagcucucacauacacucguaguguaucaguuuaagccaacaucuaaccuuccccauaugaagccaguguauaaauauauuacagcacaagggguugaaaauucugauggaauagacucagcauuuaucacagccaguaugccagcucuuaguggaacuaguauaggauauaauguaaugucuaaagauaauuuccccuuauuugauauaauuauauuuauaaagagugcaguuauuaagaccacauacaaucauauuuaugacacagggcccacuauugguauuaauguaaugcaugaugaacauugcacaggacaguguccgauagaaauaccucacaaagaaaacugguugacauucucucaagagagaacaagccgaugggguugugaggaauuugggugcuuagcuauaaauacagguuguguguuuggaucuugucaagauauaaucaggccugagacuaagguauauaggaaggcaauagaagaaagugucuuguugacagucugugugacauacccaggcaauaccuuuugcacagaaauaaaugcuauagaaccuaaaauaacagaugaauuagagcuccaauucaaaacaguagauacaaagacacuacccaauuugcuagcaguucaaaaccauaagcuguacaguggucagauaaaugaccuaggguccuuugcacaagguugcggaaauauccagaaaacuaacuuaucugugauaggaacuggaacagcaaaauuugacuacauaugucauggugccucaagaaaagacauagugguuagaagauguuauaauaacaauuaugaaucaugcaaauuguugaaggaggagccaagccuaaucuuuucugauaaucaugaaacaauagaaguagcaaauauucggcaccuucuuggagaauugcaguuuaaauuaaugcugggugauuugagauauaaaucauuugcagaaaacccagagcuagagauagaggcaagguguguuggauguccaucaugcuuuucuaguuauuccugcaauuuccgaauaaguucaaguauugauacaguaugugcaauagauggaccaugcacaauauuucacagcagauuaauuauuaguucaacuaagcaagauuauggcaucaagaugagcuguaaagaaaagccaaacccaguugaaaaauucaacauauguaagagaguauauucaguguuguucacaacuauugauaaaaaugauaagauugaaauaaauacaggagaccaaacuucauuuauacaagaaaaggacgacagaugcaaaacauggcucuguagaguuagagaugaagggauaaguguuauuuuugagccgauaaaagcauucuuugggaguuauuucagcauugcauucuaugugguaauugggauaauagcacuuuuuaucauaauauauaucuuuuugccaaugguuuuuaaauuaaaagacauacuuaaaaagaaugaacucuuauauuuacaagagaugaaauauaaguag

SEQ ID NO: 4129 - RNA, 4305 nt, Artificial Sequence
  derived and/or modified CDS sequence (wt) from ANADV(EIV-23263Tyum)__KT313760.1__GP
auguuuuuaauucuugucuuauugauaccauucuauaucacagcuacuccagugacaacaaggugcuuccaugggggccagcugauagcagaaagcaaaucuuugacagcaaucucagaguuuugccuaaaagaugaugucucaacugucaaaucugaaauaacauaccugaaaaaugacacaggaauauuugcucacagcaaaguauuaagaaauuggauaauaaaagacuggaaaaauugcaauccuguaccaacagcaggaggcaguauaaaugucauagagguaaaugcagauuugagccuauccacaaagacauauguaugcagccgagauuguacaaucacaguugauaaagaggaugcccaaauaauuuuccaaacagacaaauuaaaucacuuugaaguuucaggcaccacacuaaguucaggcugguuuaagacuaaggcaucaguaacauuagauagaacaugugagcauauaaaagugacuugugggaaaaagacacuacaguuccaugcuugcuuuaagcaucacaugucaugcauaagauucuuccacaauacaauacucccagggacaauggcuguaucuauaugccagaauauagagcucauuauaauaacaagcuuaaccuugauuaucuuuauauugauggugauauugacaaaaacauauauauguuaugucuuaaugccuuuauucaugccaguagcauauuuguauggcugggcuuacaauaggaguugcaaaaaguguucauguugugggcuugcauaucauccauucaccaauugugguucccauuguguaugugggcugaaauuugaagcaucagacagaaugaggauacaucgggaaucaggauugugucagggauauaaaagcuuaaggguggcgaggcugcuaugcaaaucaaaaggcucuucuuuaauuaucucuauauuacugucagugcuaauuuuaagcuuuguuacaccuauagagggaacacuaacaaauuacccagaaucaaagaaauacaguuuggaagagauagcugauguuauagaaggauucauugcugagagagggauaaaagaauauauugugcuauauacuucaauauuuggugcuuuauuauuauuaauagcauuaaucaucacagucucuuuaaacagaauuacagaauaucuaacuaaucuaaaugucauuuauugccaugaauguuccauguaucauuccaaaaagaauauaaaauacauuggugacuuuacuaauaaauguggguucugcacauguggcgaauuagaagaucaggaaggucucaauaugcauaaaguaagcaaaaagugcauauaccgauaucaguuaacuuggucuaaagugauuaugacaaucuuagucugucuauuaaucgcucagaacacugugcugauuguagcagcaaaugaugacugcugggcuaaacaaucauuagaaauagaaugcguuggacccuuacagcagguagaugcuugugaggauaagucaaguagaucuuacaauggagaggcaagaaaacuaguugggacgucaaagguaacagaauuagaugcuggacaagugaaucuucuuggucaaacuauagagucagcaaucauugcaauaaggaaacaaagaacauaugcaacuaugcauuuccuugaaucaguauuuuuaggaaggcauugugacuauuacaaaguauuugaacauaauagugguuacucucaagcaaaauggagguugcuagccaaaacaaaucacuuugauaucuguucaaggcauagcacacaucauuuuugcagaugcaugucagauggaacaaaaugcgaaaauggaaauugggauuuugcaggcgaaaugaauacuacuuaccauucaaaaagagauuucuuuaaacaugauuuuaaguuauuuugcacuuuacuugaaaaugcauucccuggcacaacagagucccuuuauuaccaacuuuugucaaagagaaauacaacaggggcaucaaaauuauuagggaaguugauuacaaaauucgggaauaacaaucucuuuguagggaucuggaaauuuggccaauuuuuguuguccuuacccuaugucaacaauacagaguugagcgcacugcaauccucaaagauauuggaaaguccagaaccucuccuuaggucagcuagugggagacaagaaucauuaucuagugccacuccuggggaggcaucuaaagaauguagaaaugcaaagaaaauuucaugcauaagcccuagauuuggaguuccuauggaaaacuugaccgcauguggagaauccccaaauuauaagauauuuaaaacaccaaccaggauuuacaaaucaaacaauaagggagaaauauggugugcaggugauguccauugcuuccaggaguuuacaccaauacuacaagaagugguugacaaauuaaagaaaaugacauguuuuuuaacagagccugaggcagaggaggaugcauucucaauugcuauagcuaugugcaaaauucuagacaaaggaguuugcaccauaaacagcgaaagguggaacaucauaaaaugugauaguggucuuauguauuauacagaucagagagaugggcaagauacagggaaugauuuuggggaguacuguauaucacacaauuguaagacagaaagguucccuaucaauccguccauaauaagugauuguauaugggaauaccauucuagaaaauccagguauauuagcaccuugaauuuagaaaguuuagaagaguucaaaagggcuauuucagaaaagcucucacauacacucguaguguaucaguuuaagccaacaucuaaccuuccccauaugaagccaguguauaaauauauuacagcacaagggguugaaaauucugauggaauagacucagcauuuaucacagccaguaugccagcucucaguggaacuaguauaggauauaauguaaugucuaaagauaauuuccccuuauuugauauaauuauauuuauaaagagugcaguuauuaagaccacauacaaucauauuuaugacacaggccccacuauugguauuaauguaaugcaugaugaacauugcacaggacaguguccgauagaaauaccucacaaagaaaacugguugacauucucucaagagagaacaagccgaugggguugugaggaauuugggugcuuagcuauaaauacagguuguguguuuggaucuugucaagauauaaucaggccugagacuaagguauauaggaaggcaauagaagaaagugucuuguugacagucugugugacauacccaggcaauaccuuuugcacagaaauaaaugcuauagaaccuaaaauaacagaugaauuagagcuccaauucaaaacaguagauacaaagacacuacccaauuugcuagcaguucaaaaccauaagcuguacaguggucagauaaaugaccuaggguccuuugcacaagguugcggaaauauccagaaaacuaacuuaucugugauaggaacuggaacagcaaaauuugacuacauaugucauggugccucaagaaaagacauagugguuagaagauguuauaauaacaauuaugaaucaugcaaauuguugaaggaggagccaagccuaaucuuuucugauaaucaugaaacaauagaaguagcaaauauucggcaccuucuuggagaauugcaguuuaaauuaaugcugggugauuugagauauaaaucauuugcagaaaacccagagcuagagauagaggcaagguguguuggaugcccaucaugcuuuucuaguuauuccugcaauuuccgaauaaguucaaguauugauacaguaugugcaauagauggaccaugcacaauauuucacaauagauuaauuauuaguucaacuaagcaagauuauggcaucaagaugagcuguaaagaaaagccaaacccaguugaaaaauucaacauauguaagagaguauauucaguguuguuuacaacuauugauaaaaaugauaagauugaaauaaauacaggagaccaaacuucauuuauacaagaaaaggaugacagaugcaaaacauggcucuguagaguuagagaugaagggauaaguguuauuuuugagccgauaaaagcauucuuugggaguuauuucagcauugcauucuaugugguaauugggauaauagcacuuuuuaucauaauauauaucuuuuugccaauggguuuuaaauuaaaagacauacucaaaaagaaugaacucuuauauuuacaagagaugaaauauaaguag

SEQ ID NO: 4130 - RNA, 4305 nt, Artificial Sequence
  derived and/or modified CDS sequence (wt) from BATV(804992)__FJ436801.1__GP
auguuguuacuucuugucuuauuaaucccuugcuguguaucagccucuccuguaauaacaagauguuuucauggagggcaacuaauagcagaaaggaagucccaagcggcuauaucagaauuuugccucaaagaugaugucucuacuaucaaaucagagauaauauaugaaaaaaaugacacugguuuauuugcacacaauaaaguuuuacgaaauuggauuauaaaggauuggaaaaauuguaauccuguucccacagcaggaggcaguauaaauguuauagaagucaauacagaucuaagccugacuacaaaaacauauguguguagcagggauugcacaaucacaguugauaaagaagaugcucaaauaauuuuccaaacugaaaaacugaaucauuuugaaguuucugggaccacauugagcucagguugguucaaaaccaaagcgucaguaacauuagauagaaccugcgaacacauuaaaguaacauguggaaaaaagacccuacaguuccaugccuguuucaagcaccacaugucauguauuagauuuuuccauggcacuauccuuccuggaacaauggccaccucuaucugucagaacauagaacucauaauuauaaucagucugacauugauuauuuuuaucuuaaugguaauacugacuaaaacuuacauauguuaucuauuaaugccacuauuuaugccaaucgcauacuucuaugguuggucauauaacaaaaguugcaaaaaauguccauguuguggcuuagcauaucacccuuuuacaaauuguggaucacauugugugugcggauugaaauuugaggcaucagauaggaugaggauacauagagagucaggauugugucaaggcuacaaaagcuuacguguugcuagguugcuguguaaaucaaaagguucaucccuuauaaucucaauauuauuaucuauguugauacuaagcuuuguuacaccaauagaggggacauuaacuaauuauccggaaucaagaaaauacgaccuagaggaaauugcugaugucuuagaaggauucguuguggaaaaaggaauaaaagaauauguggucuuuuauacuucuauuuucggagcuuuauuuuuauuaauggcauugauugucauaauagcacuaaacagagucacagaauaucucacaaacauuaauguuuuauacugucacgaauguucaauguaucacucaaagaagaauauaaaauauauuggagauuucacaaacaaauguggcuuuuguacauguggagagcuugaagaucaagagggcuuaaaaauacauaaagugagcaggaagugcauauauaaauaucagcucaccugguccaagguaauuaugaugauauuaguguguuuacugauugcucaaaacaccauccugauaguugcagcaucagaugauugcuggacuaaaaagucuuuagagauggaauguauaggcccuuuacagcaaguggauacaugugaugacaaaacaagcaggucauacaguggggaagcaaaaaaacuagugagggcaucaaaaauaucagauuuggaugcagcacagguggggcuguuaggauccacaauagaaucagcaauagcaagcauaagaaggcaaagaacauauucaacuaugcaucuucuugaaucaguuuuccugggaaagcauugugauuacuauaaaguuuuugagcauaacaguggcuacucucaggcaaaguggagguuaacagcuaagacacaucauuuugauauuuguucaagacacagcacccaucacuucuguagaugcaucucagacggaacuaaaugucaaaauggagauugggacuuugcaggugaaaugaacucaauauaccaaucaaagaaagacuuuuuuaagcaugacuucaaacuguucugcacucuuguagaaaaugccuucccagguacaacagagucacucuucuaugaaaugcuaucaaagaaaaacacaacugguauuacaaaauuauuagauaaauuaacaaaaaaauucgggaacaacaauauguucguaggaauauggaaauuugggcaauaucuaaugucacuaccauacgucaaugaaacaucauuaucuccuauucaacuugcaaagguauuagagguuacagaucaacaucaccgguccguuucuggcaggcaagagucgcuggcuagugcuacuccugggaguaaguccagugaaugugaccaugcaaagaagguuucuugcauaaguccuagauuuggcgcuccaauggaaggauuaauggcaugugggaacucgccaaauuacaaaauuuacaagacaccagcaaagcuuuacaaaucaaacaacaagggagaagugugguguucaggugauguucacuguuuucaagagcuuaccccugccucacaagaaucuguagacaggauaaaacaaaugacuugcuuuuugaccgaacccgaaguaaaugaugacguuuuuucuauugcaauagcuaugugcaaaguccaagauaagggaguauguacaauaaaugaagauagguggaacauaauaaaaugugauaguggccugauauauuauacugaccagagggaggggcaagacacaggcaaugauuuuggagaguauuguuugucccacagcuguagaauagaaagauucccgauaaauccggcaauaauuagugauuguuuaugggaauaucauucgcgaaaaucaaaguauauaacuaguuuagacuuagaaagcuuagaagaguuuaaaagggccauuucugaaaaauugucacauacucuuguaguguauaauuuuaaaccgacagccaaccuuccucauauaaagccaguauacaaguauaucacagugcaaggaguugaaaauucugacggaguagauucagcauauauaacugcuaguaugccagcuuuaagugggacaagcauaggcuauaacauaaugucuagggauaacuucccacuauucgauauaauuauauuuauaaaaagugcuauuauuaaagcaacuuacaaucacauauaugacacagguccuacuauagggauuaauguaaugcaugaugaacauuguacaggacaaugcccaacagacauaccacauaaagaaaauuggaucacauuugcccaagagagaacuagucguuggggaugugaagaauuugggugucuugcugucaacaccggcuguguuuuuggcucuugucaagauauaauaaggccagaaacgaagguuuauagaaaagcaguugaagagagugucuuauuaacaguuuguauaacuuacccugguaaaacauuuugcacagaaauaaaugccauagagccuaaaauuacagacgaguuagaauugcaguuuaaaacaguugauacaaaaacacugcccaacaucuuagcuguccaaaaucauaaauuauauaguggacaaaucaaugacuugggaucauucucccagggcugugguaacauacagaaaacuaauucaucuaucauaggcacaggcacugcaaaguuugauuaugugugucauggugccucuaggaaagauaucauuguaaggagaugcuacaauaauaauuaugaaucauguaaauuauugaaggaggaacaauccuuaauguuugcagauaaucaugaaacaaucgauguagccaaugucagacaucuccuuggggaucugcaguuuaaauuaauguugggagaucuaagguacaagucauuugcggaaaacccagauuuagaaauagaagcaaaguguguuggaugcccaucauguuuuacuaguuauuccugcaguuucaaaauuguuucaaauauugauacugugugcucaauugaagggccuuguacaacuuuucauaacagauuaaugaucaccucuacaaaacaagauuauggcauuaaaaugagcuguaagacaaagccagggcugacagaggaguuccaaauuugcaaaaaaacuuacacaguacuguucgcaacaguugaaaaaaaugauaaaaucgaaauaagcacaggagaccaaacaucuuuuauccaagaaagagaugauagaugcaaaacaugguuauguaggguuagggaugaagggaucaguguuauuuucgaaccgauaagagcuuucuuuggaagcuacuuuaguauagcuuuuuauauaguaauugguaucauuguccuguuucuaguaaucuacauuuucuugcccaugauguuuaaacuuagagaugugcuaaaaagaaaugaauaccuguaccuacaggagauaaaacauaaguaa

SEQ ID NO: 4131 - RNA, 4305 nt, Artificial Sequence
  derived and/or modified CDS sequence (wt) from BATV(8627-11)__FJ436799.1__GP
auguuguuacuucuugucuuauuaaucccuugcuguguaucagccucuccuguaauaacaagauguuuucauggagggcaacuaauagcagaaaggaagucccaagcggcuauaucagaauuuugccucaaagaugaugucucuacuaucaaaucagagauaauauaugaaaaaaaugacacugguuuauuugcacacaauaaaguuuuacgaaauuggauuauaaaggauuggaaaaauuguaauccuguucccacagcagggggcaguauaaauguuauagaagucaauacagaucuaagccugacuacaaaaacauauguguguagcagggauugcacaaucacaguugauaaagaagaugcucaaauaauuuuccaaacugaaaaacuaaaucauuuugaaguuucugggaccacauugagcucagguugguucaaaaccaaagcgucaguaacauuagauagaaccugcgaacacauuaaaguaacauguggaaaaaagacccuacaguuccaugccuguuucaagcaccacaugucauguauuagauuuuuccauggcacuauccuuccuggaacaauggccaccucuaucugucagaacauagaacucauaauuauaaucagucugacauugauuauuuuuaucuuaaugguaauacugacuaaaacuuacauauguuaucuauuaaugccacuauuuaugccaauugcauacuucuaugguuggucauauaacaaaaguugcaaaaaauguccauguuguggcuuagcauaucacccuuuuacaaauuguggaucacauuguguguguggauugaaauuugaggcaucagauaggaugaggauacauagagagucaggauugugucaaggcuacaaaagcuuacguguugcuagguugcuguguaaaucaaaagguucuucccuuauaaucucaauauuauuaucuauguugauacuaagcuuuguuacaccaauagaggggacauuaacuaauuauccggaaucaagaaaauacgaccuagaggaaauugcugauguccuagaaggauuuguuguggaaaaaggaauaaaagaauauguggucuuuuacacuucuauuuucggagcuuuauuuuuauuaauggcauugauugucauaauagcacuaaacagagucacagaauaucucacaaacauuaauguuuuauacugucacgaauguucaauguaucacucaaagaagaauauaaaauauauuggagauuucacaaacaaauguggcuuuuguacauguggagagcuugaagaucaagagggcuuaaaaauacauaaagugagcaggaagugcauauauaaauaucagcucaccugguccaagguaauuaugaugauauuaguguguuuauugauugcucaaaacaccauccugauaguugcagcaucggacgauugcuggacuaaaaggucuuuagagauggaauguauaggcccuuuacagcaaguggauacaugugaugauaaaacaagcaggucauacaguggggaagcaaaaaaacuagugagggcaucaaaaauaucagauuuggaugcagcacagguggggcuguuaggauccacaauagaaucagcaauagcaagcauaagaaggcaaagaacauauucaacuaugcaucuucuugagucaguuuuccugggaaagcauugugauuacuauaaaguuuuugagcacaacaguggcuacucucaggcaaaguggagguuaacagcuaagacacaucauuuugauauuuguucaagacacagcacccaucacuucuguagaugcaucucagacggaacuaaaugucaaaauggagauugggacuuugcaggugaaaugaacucaacauaccaaucaaagaaagacuuuuuugagcaugacuucaaacuguucugcacucuuguagaaaaugccuucccagguacaacagagucacucuucuaugaaaugcuaucaaagaaaaacacaacugguauuacaaaauuauuagauaaauuaacaaaaaaauucgggaacaacaauauguuuguaggaauauggaaauuugggcaauaucuaaugucacuaccauacgucaaugaaacaucauuaucuccuacucaacuugcgaaaguauuagagguuacagaucaacaucaccgguccguuucuggcaggcaagagucgcuggcuagugcuacucccgggaguaaguccagugaaugugaccaugcaaagaagguuucuugcauaaguccuagauuuggcguuccaauggaaggauuaauggcaugugggaacucgccaaauuacaaaauuuacaagacaccagcaaagcuuuacaaaucaaacaacaagggagaagugugguguucagguaauguucacuguuuucaagagcuuaacccugccucacaagaaucuguagacaggauaaaacaaaugacuugcuuuuugaccgaacccgaaguaaaugaugacguuuuuucuauugcaauagcuaugugcaaaguccaagauaagggaguauguacaauaaauaaagauagguggaacauaauaaaaugugauaguggccugauauauuauacugaccagagagaggggcaagacacaggcaaugauuuuggagaguauuguuugucccacagcuguagaauagaaagauucccgauaaauccggcaauaauuagugauuguuuaugggaauaucauucacgaaaaucaaaguauauaacuaguuuagacuuagaaagcuuagaagaguuuaaaagggccauuucugaaaaauugucacauacucucguaguguauaauuuuaaaccgacagccaaucuuccucauauaaagccaguauacgaguauaucacagugcaaggaguugaaaauucugacggaguagauucagcauauauaacugcuaguaugccagcuuuaaguggaacaagcauaggcuauaacauaaugucuagggauaacuucccacuauucgauauaauuauauuuauaaaaagugcuauuauuaaagcaacuuacaaucacauauaugacacagguccuacuauagggauuaauguaaugcaugaugaacauuguacaggacaaugcccaacagacauaccacauaaagaaaauuggaucacauuugcccaggagagaacuagucguuggggaugugaagaauuugggugucuugcugucaacaccggcuguguuuuuggcucuugucaagauauaauaaggccagaaacgaagguuuauagaaaagcaguugaagagagugucuuauuaacaguuuguauaacuuacccugguaaaacauuuugcacagaaauaaaugccauagagccuaaaauuacagacgaguuagaauugcaguuuaaaacaguugauacaaaaacgcugcccaacaucuuagcuguccaaaaucauaaauuauauaguggacaaauuaaugacuuaggaucauucucccagggcugugguaacauacagaaaacuaauucauccaucauaggcacaggcacugcaaaguuugauuaugugugucauggugccucuaggaaagauaucauuguaaggagaugcuacaauaauaauuaugaaucauguaaauuauugaaggaggaacaauccuuaauguuugcagauaaucaugaaacaaucgauguagccaaugucagacaucuccuuggggaucugcaguuuaaauuaauguugggagaucuaagguacaagucauuugcggaaaacccagauuuagaaauagaagcaaaguguguuggaugcccaucauguuuuacuaguuauuccugcaguuucaaaauuguuucaaauauugauacugugugcucaauugaagggccuuguacaacuuuucauaacagauuaaugaucaccucuacaagacaagauuauggcauuaaaaugagcuguaagacaaagccagggcuaacagaggaguuccaaauuugcaagaaaacuuacacaguacuguucgcaacaguugaaaagaaugauaaaaucgaaauaagcacaggagaccaaacaucuuuuauccaagaaagagaugauagaugcaaaacaugguuauguaggguuagggaugaagggaucaguguuauuuucgaaccgauaagagcuuucuuuggaagcuacuuuaguauagcuuucuauauaguaauugguaucauuguccuguuucuaguaaucuacauuuucuugcccaugauguuuaaacuuagagauguguuaaaaagaaaugaauaccuguaccuacaggaaauaaaacauaaguaa

SEQ ID NO: 4132 - RNA, 4305 nt, Artificial Sequence
  derived and/or modified CDS sequence (wt) from BATV(Chittoor/IG-20217)__JX846599.1__GP
auguugcuacuucuugucuuauuaaucccuugcuguguaucagccucuccuguaauaacaagauguuuucauggagggcaacugauagcagaaaggaagucccaagcggcuauaucagaauuuugccucaaggaugaugucucuacuaucaaaucagaaauaauauaugaaaaaaaugacacugguuuauuugcacauaauaaaguuuuacgaaauuggauuauaaaggacuggaaaaauugcaauccuguucccacagcagggggcaguauaaauguuauagaagucaauacagauuugagcuugacuacaaaaacauauguguguagcagggauugcacaaucacaguugauaaagaagaugcucaaauaauuuuccaaacugaaaaacugaaucacuuugaaguuucuggaaccacauugagcucagguugguucaaaaccaaagcaucaguaacauuagauagaaccugcgaacacauuaaaguaacaugugggaaaaagacccuacaguuccaugccuguuucaagcaccacaugucauguauuagauuuuuccauggcacuauccuuccuggaacaauggcuaccucuaucugucagaauauagaacucauaauuauaauaagucugacauugauuauuuuuaucuuaaugauaauacugaccaaaaccuacauauguuaucuauuaaugccacuauuuaugccaaucgcauacuucuaugguuggucauauaacaaaaguugcaaaaaauguccauguuguggcuuagcauaucacccuuuuacaaauuguggaucacauugugugugcggauugaaauuugaggcaucagauaggaugaggauacauagagaaucaggauugugucaaggcuauaaaagcuuacguguugcuagguugcuguguaaaucaaaagguucaucccucauaaucucgauauuauuaucuauguugauacuaagcuuuguuacaccaauagaggggacauuaaccaauuauccagaaucaagaaaauacgaccuagaggaaauugcugaugucuuagaaggauucguuguggaaaaaggaauaaaagaauauguagucuuuuauacuucuauuuucggagcuuuauuuuuauuaauggcauugauugucauaauagcacuaaacagaguuacagaauaucucacaaacaucaauguuuuauacugucacgaauguucaauguaucacucaaagaagaauauaaaauauauuggagauuucacaaauaaauguggcuuuuguacauguggagagcucgaagaucaagagggcuuaaaaauacauaaagugagcaggaagugcauauauaaauaucagcucaccugguccaaaguaauuaugaugauauuaguguguuuacugauugcucaaaacaccauccugauaguugcagcaucagacgauugcuggacuaaaaagucuuuagagauggaauguauaggcccuuuacagcaaguggauacaugugacgacaaaacaagcaggucauacaguggggaggcaaaaaaacuagugagggcaucaaaaauaucagauuuggaugcagcacagguggggcuguuaggauccacaauagaaucagcaauagcaagcauaagaaggcaaagaacauauucaacuaugcaucuucuugaaucaguuuuccuggggaagcauugugauuacuauaaaguuuuugagcauaacaguggcuacucucaggcaaaauggagguuaacagcuaaaacacaucauuuugauauuuguucaagacacagcacccaucacuucuguagaugcaucucagacggaacuaaaugucaaaauggagauugggacuuugcaggugaaaugaacucaacauaccaaucaaagagagacuuuuuugagcaugacuucaaacuguucugcacucuuauagaaaaugccuucccaggcacaacagagucacucuucuaugaaaugcuaucaaagaaaaacacaacugguauuacaaaacuauuagauaaauuaacaaaaaaauuugggaacaacaauauguucguaggaauauggaaauuugggcaauaucuaauuucacuaccauacgucaaugaaacaucauuaucuccuacucaacuugcaaaaguauuagagguuacagaucaacaucaccgguccauuucuggaaggcaagagucgcuggcuagugcuaccccugggaguaaguccagugaaugugaccaugcaaagaaggcuucuugcauaaguccuagguuugguguuccaauggaaggauuaauggcaugugggaacucgccaaauuacaaaauuuacaagacaccagcaaagcuuuacaaaucaaacaacaagggagaagugugguguucagguaauuuucacuguuuucaagagcucauccccgccucacaagaaucuguugacaggauaaaacaaaugacuugcuuuuugaccgaaccugaaguaaaugaugacguuuuuucuauugcaauagcuaugugcaaaguccaagacaagggaguauguacaauaaauaaggauagguggaacguaauaaaaugugauaguggccugauauauuauacugaccagagagaggggcaagacacaggcaaugauuuuggagaguauuguuuaucccacagcuguagaauagaaagauucccgauaaauccggcaauaauuagugauuguuuaugggaauaucauucacgaaaaucaaaguauauaacuaguuuagacuuagaaagcuuagaagaguuuaaaagagcuauuucugaaaaauugucacauacucucauaguguauaauuuuaaaccgacagccaaucuuccucauauaaagccaguauacaaguauaucacagugcaaggaguugaaaauucugauggaguagauucagcauauauaacugcuaguaugccagcuuuaagugggacaagcauaggcuauaacauaaugucuagggauaacuucccacuauucgauauaauuauauuuauaaaaagugccauuauuaaagcaacuuacaaucacauauaugacacagguccuacuauagggaucaauguaaugcaugaugaacauuguacaggacaaugcccaacagacauaccacauaaagaaaauuggaucacauuugcccaagagagaacuagucguuggggaugugaagaauuugggugucuugcugucaacaccggcuguguuuuuggcucuugucaagauauaauaaggccagaaacaaagguuuauagaaaagcaguugaggagagugucuuauuaacaguuuguauaacuuacccugguaaaacauuuugcacagaaauaaaugccauagagccuaaaauuacagacgaauuagaauugcaguuuaaaacaguugauauaaaaacacugcccaacaucuuagcuguccaaaaucauaaauuauauaguggacagauuaaugacuuaggaucauucucccagggcugugguaacauacagaaaacuaauucauccaucauaggcacaggcacugcaaaguuugauuaugugugucauggugccucuaggaaagauaucauuguaaggagaugcuacaauaauaauuaugagucauguaaauuauugaaggaggaacaauccuugauguuugcagauaaucaugaaacaaucgauguagccaaugucagacaucuccuuggggaucugcaguuuaaauuaauguugggagaucuaagguacaaaucauuugcggaaaauccagauuuagaaauagaagcaaaguguguuggaugcccaucauguuuuacuaguuauuccugcaguuucaaaauuguuucaaauauugauacugugugcucaauugaagggccuuguacaacuuuucauaacagauuaaugaucaccuccacaaaacaagauuauggcauuaaaaugagcuguaagacaaagccagggcugacagaggaguuccagauuugcaagaaaacuuauacaguacuguucgcaacaguugaaaagaaugauaaaaucgaaauaagcacaggagaccaaacaucuuuuauccaagaaagagaugauagaugcaaaacaugguuguguaggguuagggaugaagggaucaguguuauuuucgaaccgauaagagcuuucuuuggaagcuacuuuaguauagcuuuuuauauaguaauugguaucauuguccuguuucuaguaaucuacauuuucuugcccaugauguuuaaacuuagagauguguuaaaaagaaaugaauaccuguaccuacaggaaauaaaacauaaguaa

SEQ ID NO: 4133 - RNA, 4305 nt, Artificial Sequence
  derived and/or modified CDS sequence (wt) from BATV(41.3)__KM507322.1__GP
auguugcuauuccucaucuuacuaauucccuguuaugcaucagccuccccuguaguaacaagaugcuuccauggagggcaauuaauagcagagaguagguccccaacagcugugucagaguucugcuuaaaagacgaugucucuacuauuaaaucagagauaauauaugucaagaaugauacuggauuguuugcgcacaacaaaguuuuaaggaauuggaucauaaaagacuggaagaauugcaauccugugccuacagcuggggguaguauuaaugucauagaagucaauacagaccugagcuugagcacaaaaacauacguguguaguagagauugcacaauuacaguugauaaagaagaugcucagauaauauuccaaacugagaaauuaaaucauuuugaaguuucuggaaccacauuaaguucaggcugguucaaaacuaaagcaucaguaacgcuggauagaacaugugagcauaucaaggucacaugugggaaaaagacucugcaauuucaugcauguuuuaagcaccauaugucaugcauuagauuuuuccauaguaccauucuucccggaacaauggcaacuucaaucugucaaaauauagagcuuauaauuauaauaaguuugacacugcucauuuuuaucuugauggcaauauugacuaaaaccuacauauguuauuugcuaaugcccuuauucaugccuauugcauaucuuuaugguuggucauauaauagaagcuguaaaaaauguucaugcugcggccuagcauaucauccauucacaaauuguggcucacauugugucugugguuuaaaguuugaagcaucagacagaaugagaauacacagagaaucaggguuaugccagggcuacaaaagcuuaagaguagcaagacuguugugcaaaucaaaagguucaucucuuauaauuucaauauuguuaucuauguuaauccugagcuuuguuacgccgauagaagggacuuuaacuaauuacccagagucaaggaaauacgaucuagaagaaauugcugacgucuuggagggguuuauuacagaaaagggaauaaaagaauauguaguuuuuuauacuucuauuuuuggggguuuauuuuuauuacuggcauugauuauuauaauugcauugaacagaguuacagaauaccucacaaauauuaaugucuuuuauugucacgaaugcucaauguaucauucaaagaagaauauaaaauauauuggugauuuuacaaauaaguguggguuuuguacauguggggagcuagaagaucaagaaggauuaaagauacacaaagucagcaggaagugcauauacaaauaucaacuuacuugguccaaaauaaucaugauaauauuagugugucuacugauugcccaaaauaccaucuuaauaguugcagcaucaaaugauuguugggcaaaaaaaucuuuagagauggaaugcauagggcccuugcagcaaguggaaucaugugaugacaaagcaagcagaucuuacagcggagaggcaaaaaagcuaguaagagcaucuaaaauaucagauuuagaugcagcacaaguaggcuuacuagguucuacaauagaaucagcaauagcaaguauaaggaaacaaagaacauauccaaccaugcaucuccuugaaucaguauuuuuggcaaaacauugugauuacuauaaauccuuugagcauaauagugguuauucccaagcaaaauggcgguuaacagcuaaaacacaucauuuugacauuuguucaagacacagcacccaccauuucuguaggugcauuucugauggaaccaaaugccagaauggggauugggauuuugcaggugagaugaauucaacauaucaaucaaaaaaagauuuuuuugagcaugauuuuaaacuauucugcacccuccuggagaaugcuuucccaggcacaacagaaucauuuuauuaucaaaugcugcaaaagaaaaauacaacuggcguuguaaaacuauuggaugaauuaacaaagaaauuuggaaacaauaacauguuuguggggauauggaaauuuggacaauauuuaaugucacucccguacaucaaugaaacaucauuaacuccuuuacaacuuucaaaaauauuggaagcuucaaaccagcaucaccgcucuauaucuggaaggcaagaaucauuagcuaaugcugccucuggggguaaaucuaaagaaugcgaucaugcaaaaaaagucucuugcauaaguccuagguuugguguuccaauggaagggcuaauagcauguggaagcucaccaaauuauaaaauuuauaagaugccaacaaagcuuuacaaaucgaauaauaaaggcgaagugugguguucaggugauguucauugcuuccaagaauugaacccugcuucacaggagucuguggauagaauaaagcaaaugacauguuuuuugacugagccugagacaaaugaagaugucuuuucaauugccauaucuaugugcaagguucaagauaaaggagugugcacaauaaaugaagagagauggaauguaauaaaaugcgacaguggcuuaauauauuacacugaccagagggauggacaagacacagguaacgacuuuggagaauauugccuaucacacaauuguaggauugaaagguuuccaauaaacccuacaauaauaaaugauugccuaugggaauaucauucacgaaaaucuaaguacauuacuaguuuagacuuagaaagucuugaagaauucaaaagggcuauuucugagaaauuaucacauacccucauaguauauaauuuuaaaccaacggccaaccucccucauaucaagccaguguauaaauauauuacaguacaagggguugagaauucugauggaguggauucagcauacauaacugcuagcaugccggcucuaaguggaacaaguauaggauauaauauaaugucuaaagauaacuucccauuauuugauauaaucauauucauaaaaagcgcuguuaucaaggcaacuuauaaucacauauaugauacaggccccacuauagggauaaauguaaugcaugaugagcacugcacaggucagugcccaacagauauaccacauaaagagaauuggaucacauuuucccaggaaaggacuagccguuggggaugugaagaauucggaugccuugcugugaauacagguugugucuuugguucuugccaagauauaauaagaccagaaacaaaaguauauagaaaagcaaucgaagaaagugucuuauuaacagucugcauaacuuaucccgguaagacauuuuguacagaaauaaaugcuauagaaccuaaaauuacagaugaauuagaacugcaauuuaaaacaguugacacaaaaacauuacccaauauauuagcuguucaaaaccacaaauuguauagugggcaaauaaaugauuuaggaucguuuucacaagguugugguaacauacagaaaaccaauucaucuauaauaggaacaggcacugccaaauuugauuacguaugucauggugccucuagaaaagauauuauuguaagaagauguuacaacaauaacuaugaaucaugcagauuauuaaaagaagaacaauccuuaauguuugcagacaaccaugaaacuauugacguagcuaaugucaggcaccuccuuggggaucuacaauuuaaguugauguuaggagauuuaagauacaagucauuugcagaagacccagacuuagagauagaagcaaaauguguuggguguccaucauguuucacuaguuacuccugcaauuuuagaauuguuucaaauauugauacuguguguucaauugaagggccuugcacaaccuuucacaacaggcuaaugauuacuuccacaaaacaggauuauggcaucaagaugagcuguaagggaaagccaggaucaacagaagaauuucagaucugcaagaaaacuuacacaguguuguuuacaacaguugaaaagaaugacaaaauugagauaaacacaggagaccaaacaucuuucauucaagagagggaugauagaugcaaaacaugguuauguagggucagagaugaagggauuaguguuauuuuugaaccaauaagggccuuuuucgggaguuauuuuaguauagccuucuauaucgugguuggaaucauuguccuguuccuuaugaucuacauuuucuugccuauggcauuuaaacuuagggauguauuaaaaaggaaugaauaucuauaucuacaggagauaaagcacaaguag

SEQ ID NO: 4134 - RNA, 4305 nt, Artificial Sequence
  derived and/or modified CDS sequence (wt) from BATV(EIV-1217Astr)__KT313699.1__GP
auguugcuauuccucaucuuacuaauccccuguuaugcaucagccuccccuguaguaacaagaugcuuccauggagggcaauuaauagcagaaaguagguccccaacagcugugucagaauucugcuuaaaagaugaugucucuacuauuaaaucagagauaauauauguuaagaaugauacuggauuguuugcacacaacaaaguuuuaaggaacuggaucauaaaagacuggaaaaacugcaauccugugccuacagcuggggguagcauuaaugucauagaaguuaauacagaccugagcuugagcacaaaaacauacguguguaguagagauugcacaauuacaguugauaaagaagaugcucagauaaucuuccaaacugagaaauuaaaucauuuugaaguuucuggaaccacauuaaguucaggcugguucaaaacuaaagcaucaguaacacuggauagaacaugugagcauaucaaggucacaugugggaaaaagacucugcaauuucaugcauguuuuaagcaccauaugucaugcauuagauuuuuccaugguaccauucuccccggaacaauggcaacuucgaucugucaaaauauagagcuuauaauuauaauaaguuugacacugcuuauuuuuaucuugauggcaauauugacuaaaaccuacauauguuauuugcuaaugcccuuauucaugccuauugcauaucuuuaugguuggucauauaauagaagcuguaaaaaauguucaugcuguggccuagccuaucauccauucacaaauuguggcucacauugugucugugguuuaaaguuugaagcaucagacagaaugagaauacacagagaaucaggauuaugccagggcuacaaaagcuuaagaguagcaagacuauugugcaaaucaaaagguucaucucuuauaauuucaauauuguuaucuauguuaauccugagcuuuguuacgccaauagaagggacuuuaacuaauuacccagagucaaggaaauacgaucuagaggaaauugcugacgucuuggagggauuuguuacagaaaagggaauaaaagaauauguaguuuuuuauacuucuauuuuuggggguuuguuuuuauuacuggcauugauuauuauaauugcauugaacagaguuacagaauaccucacaaauauuaaugucuuuuauugucacgaaugcucaauguaucauucaaaaaagaauauaaaauauauuggugauuuuacaaauaaguguggguuuugcacauguggggagcuagaagaucaagaaggauuaaagauacacaaagucagcagaaagugcauauacaaauaucaacuuacuugguccaaaauaaucaugauaauauuagugugucuacugauugcccaaaauaccaucuuaauaguugcagcaucaaaugauuguugggcaaagaaaucuuuagagauggaaugcauagggccuuugcagcaaauggaaucaugugaugacaaagcaagcagaucuuauaguggagaggcaaaaaagcuaguaagggcaucuaaaauaucagauuuagaugcagcacaaguaggcuuacuagguucuacaauagaaucagcaauagcaaguauaagaaaacaaagaacauauccaaccaugcaucuccuugaaucaguauuuuuggcaaaacauugugauuacuauaaauccuuugagcauaauagugguuauucccaagcaaaauggcgguuaacagcuaaaacacaucauuuugacauuuguucaagacacagcacccaccauuucuguagaugcauuucugauggaacuaaaugccagaauggggacugggauuuugcaggugagaugaauucaacauaucaaucaaaaaaagauuucuucaagcaugauuuuaaacuauucugcacccuccuggagaaugcuuucccaggcacaacagaaucauuuuauuaucaaaugcugcaaaagaaaaauacaacugguguuguaaaacuauuggaugaauuaacaaagaaauuuggaaacaauaauauguucguagggauauggaaauuuggacaauauuuaaugucacucccauacaucaaugaaacaucauuaacuccuuuacaacuuucaaaaauauuggaggcuucagaccagcaucaucgcucuauaucuggaaggcaagaaucauuagcuaaugccgccucuggggguaaaucuaaagaaugugaucaugcaaaaaaagucucuugcauaaguccuagguuuggugucccaauggaagggcuaauagcauguggaggcucaccaaauuauaaaauuuauaagaugccaacaaagcuuuacaaaucaaauaauaaaggagaaguaugguguucaggugauguucauuguuuccaagaauugaacccugcuuuacaggagucuguagauagaauaaagcaaaugacauguuuuuugacugaaccugagacaaaugaagaugucuuuucaauugccauaucuaugugcaagguucaagauaaaggagugugcacaauaaaugaagagagauggaauguaauaaaaugcgacaguggcuuaauauauuacacugaccagagggauggacaagacacagguaacgacuuuggagaauauugccuaucacacaauuguagaauugaaagguuuccaauaaacccuacaauaauaaaugauugccuaugggaauaucauucacgaaaaucuaaguacauuacuaguuuagacuuagaaagucuugaagaauucaaaagggcaauuucugagaaauuaucacauacccucauaguauauaauuuuaaaccaacggcuaaccucccucauaucaagccaguguauaaauauauuacaguacaagggguugagaauucugauggaguagauucagcauacauaacugcuagcaugccggcucuaaguggaacaaguauaggauauaauauaaugucuaaagauaacuucccauuauuugauauaaucauauucauaaaaagcgcuguuaucaaggcaacuuauaaucacauauaugauacaggccccacuauagggauaaauguaaugcaugaugagcacugcacaggucagugcccaacagauauaccacauaaagagaauuggaucacauuuucucaggaaaggacuagccguuggggaugugaagaauucggaugccuugcugugaauacagguugugucuuugguucuugccaggauauaauaagaccagaaacaaaaguauauagaaaagcaaucgaagaaaguguuuuauuaacagucugcauaacuuaucccgguaagacauuuuguacagaaauaaaugcuauagaaccuaaaauuacagaugaauuagaacugcaauuuaaaacaguugacacaaaaacauuacccaauauauuagcuguucaaaaccacaaauuauauagugggcaaauaaaugauuuaggaucguuuucacaaggcugugguaauauacagaaaaccaauucaucuauaauaggaacaggcacugccaaauuugauuacguaugucauggugcuucuagaaaagauauuauuguaagaagguguuacaacaauaacuaugaaucaugcagauuauuaaaagaagaacaauccuuaauguuugcagacaaccaugagacuauugacguagcuaaugucaggcaccuccuuggggaucuacaauuuaaguuaauguuaggagauuuaagauacaagucauuugcagaagacccagacuuagagauagaagcaaaauguguuggguguccaucauguuuuacuagcuacuccugcaauuuuagaauuguuucaaauauugauacuguguguucaauugaagggccuugcacaaccuuucacaacaggcuaaugaucacuuccacaaaacaggauuauggcaucaagaugagcuguaagggaaaaccaggaucaacagaagaauuucagaucugcaagaaaacuuacacaguguuguuuacaacaguugaaaagaacgacaaaauugagauaaacacaggagaccaaacaucuuucauucaagagagggaugauagaugcaaaacaugguuauguagggucagagaugaagggauuaguguuguuuuugaaccaauaagggccuuuuucgggagcuauuuuaguauagccuucuauaucgugguuggaaucauuguccuguuccuugugaucuacauuuucuugccuauggcauuuaagcuuagggauguauuaaaaaggaaugaauaucuauaucuacaggagauaaagcacaaguag

SEQ ID NO: 4135 - RNA, 4305 nt, Artificial Sequence
  derived and/or modified CDS sequence (wt) from BATV(EIV-12497Bl)__KT313692.1__GP
auguugcuauuccucaucuuacuaauucccuguuaugcaucagccuccccuguaguaacaagaugcuuccauggagggcaauuaauagcagagaguagguccccaacagcugugucagaguucugcuuaaaagaugaugucucuacuaucaaaucagagauaauauaugucaagaaugauacuggauuguuugcgcacaacaaaguuuuaaggaauuggaucauaaaagacuggaagaacugcaauccugugccuacagcuggggguagcauuaaugucauagaaguuaauacagaccugagcuugagcacaaaaacauacguguguaguagagauugcacaauuacaguugauaaagaagaugcucagauaaucuuccaaacugagaaauuaaaucauuuugaaguuucuggaaccacauuaaguucaggcugguucaaaacuaaagcaucaguaacacuggauaggacaugugagcauaucaaggucacaugugggaaaaagacucugcaauuucaugcaugcuuuaagcaccauaugucaugcauuagauuuuuccaugguaccauucuccccggaacaauggcaacuucaaucugucaaaauauagagcuuauaauuauaacaaguuugacacugcucauuuuuaucuugauggcaauauugacuaaaaccuacauauguuauuugcuaaugcccuuauucaugccuauugcauaucuuuaugguuggucauauaauagaagcuguaaaaaauguucaugcuguggccuagcauaucauccauucacaaauuguggcucacauugugucugugguuuaaaguuugaagcaucagacagaaugagaauacacagagaaucaggguuaugccagggcuacaaaagcuuaagaguagcaagacuauugugcaaaucaaaagguucaucucuuauaauuucaauauuguuaucuauguuaauccugagcuuuguuacaccgauagaagggacuuuaacuaauuacccggagucaaggaaauaugaucuagaagaaauugcugacgucuuggagggguuuauuacagaaaagggaauaaaagaauauguaguuuuuuauacuucuauuuuuggggguuuguuuuuauuacuggcauugauuauuauaauugcauuaaacagaguuacagaauaccucacaaauauuaaugucuuuuauugucaugaaugcucaauguaucauucaaagaagaauauaaaauauauuggugauuuuacaaauaaguguggguuuuguacauguggggagcuagaagaucaagaaggauuaaagauacacaaagucagcagaaagugcauauacaaauaucaacuuacuugguccaaaauaaucaugauaauauuagugugucuacugauugcccaaaauaccaucuuaauaguugcagcaucaaaugauuguugggcaaagaaaucuuuagagauggaaugcauagggcccuugcagcaaguggaaucaugugaugacaaagcaagcagauccuacagcggagaggcaaaaaagcuaguaagagcauccaaaauaucagauuuagaugcagcacaagcaggcuuacuagguucuacaauagaaucagcaauagcaaguauaaggaaacaaagaacauauccaaccaugcaucuccuugaaucaguauuuuuggcaaaacauugugauuauuauaaauccuuugagcauaauagugguuauucccaagcaaaauggcgguuaacggcuaaaacacaucauuuugacauuuguucaagacacagcacccaccauuucuguaggugcauuucugauggaacuaaaugccagaauggagacugggauuuugcaggugagaugaauucaacauaucaaucaaaaaaagauuuuuuugagcaugauuuuaaacuauucugcacccucuuggagaaugcuuuuccagguacaacagaaucauucuauuaucaauugcugcaaaagaaaaauacaacugguguuguaaaacuauuggaugaauuaacaaagaaauuuggaaacaauaauauguuuguagggauauggaaauuuggacaguauuuaaugucacucccauacaucaaugaaacaucacuaacuccuuuacaacuuucaaaaauauuggaagcuucagaccagcaucaucguucuauaucuggaaggcaagaaucauuagcuagugccgccucuggggguaaaucuaaagagugcgaucaugcaaaaaaagucucuugcauaaguccuagguuuagugucccaauggaagggcuaauagcauguggaagcucaccaaauuauaaaauuuauaggaugccaacaaagcuuuauaaaucaaauaauaaaggagaagugugguguucaggugauguucauuguuuccaagaauugaacccugcuucacaggagucuguagauagaauaaagcaaaugauauguuuuuugacugagccugagguaaaugaagaugucuuuucaauugccauaucuaugugcaagguucaagauaaaggagugugcacaauaaaugaagagagauggaauguaauaaaaugcgacagugguuuaauauauuacacugaccagagggauggacaagacacagguaaugacuuuggagaauauugccuaucacacaauuguagaauugaaagguuuccaauaaacccuacaauaauaaaugauugccuaugggaauaucauucacgaaaaucuaaguacauuacuaguuuagacuuagaaagucuugaagaauucaaaagggcuauuucugagaaauuaucacauacccucauaguauauaauuuuaaaccaacagcuaaccucccucauaucaagccaguguauaaauauauuacaguacaagggguugagaauucugauggaguagauucagcauacauaacugccagcaugccggcucuaagugggacaaguauaggguauaauauaaugucuagagauaacuucccauuauuugauauaaucauauuuauaaaaagugcuguuaucaaggcaacuuauaaucacauauaugauacaggccccacuauagggauaaauguaaugcaugacgagcacugcacaggucaguguccaacagauauaccacauaaagagaauuggaucacauuuucucaggaaaggacuagccguuggggaugugaagaauucggaugccuugcuguaaauacagguugugucuuugguucuugccaagauauaauaagaccagaaacaaagguauauagaaaagcagucgaagaaaguguuuuauuaacagucugcauaacuuaucccgguaagacauuuuguacagaaauaaaugcuauagaaccuaagauuacagaugaauuagaacugcaauuuaaaacaguugacacaaaaacauuacccaauauauuagcuguucaaaaccacaaauuauacagugggcaaauaaaugauuuaggaucguuuucacaaggcugugguaauauacagaaaaccaauucaucuauaauagggacaggcacugccaaauuugauuacguaugucauggugcuucuagaaaagauauuauuguaagaagauguuacaacaauaacuaugaaucaugcagauuauuaaaagaagaacaaucuuuaauguuugcagacaaucaugaaaccauugacguagcuaaugucaggcaccuccuuggggaucuacaauuuaaguugauguuaggagauuuaagauacaagucauuugcagaagacccaggcuuagagauagaagcaaaauguguuggguguccaucauguuuuaccagcuacuccugcaauuuuagaauuguuucaaauauugauacuguguguucaauugaagggccuugcacaaccuuucacaacaggcuaaugaucacuuccacgaaacaagauuauggcaucaagaugagcuguaagggaaaaccaggaucaacagaagaauuucagaucugcaagaaaacuuacacaguguuguuuacaacaauugaaaagaaugacaaaauugagauaaacacaggagaccaaacaucuuucguucaagagagggaugauagaugcaaaacaugguuauguaggguuagagaugaagggauuaguguuauuuuugaaccaauaagagccuuuuuugggagcuauuuuaguauagccuucuauaucgugguuggaaucauuguccuguuccuugugaucuacauuuucuugccuauggcauuuaaacuuagggauguauuaaaaaggaaugaauaucuauaucuacaggagauaaagcacaaguag

SEQ ID NO: 4136 - RNA, 4305 nt, Artificial Sequence
  derived and/or modified CDS sequence (wt) from BATV(EIV-12845Ms)__KT313690.1__GP
auguugcuauuccucaucuuacuaauucccuguuaugcaucagccuccccuguaguaacaagaugcuuccauggagggcaauuaauagcagagaauagguccccaacagcugugucagaguucugcuuaaaagaugaugucucuacuauuaaaucagaaauaauauaugucaagaaugauacuggauuguuugcgcacaacaaaguuuuaaggaauuggaucauaaaagacuggaagaacugcaauccugugccuacagcuggggguagcauuaaugucauagaaguuaauacagaccugagcuugagcacaaaaacauacguguguaguagagauugcacaauuacaguugauaaagaagaugcucagauaaucuuccaaacugagaaauuaaaucauuuugaaguuucuggaaccacauuaaguucaggcugguucaaaacuaaagcaucaguaacacuggauagaacaugugagcauaucaaggucacaugugggaaaaagacucugcaauuucaugcauguuuuaagcaccauaugucaugcauuagauuuuuccauaguaccauucuucccggaacaauggcaacuucaaucugucaaaauauagagcuuauaauuauaauaaguuugacacugcuuauuuuuaucuugauggcaauauugacuaaaaccuacauauguuauuugcuaaugcccuuauucaugccuauugcauaucuuuaugguuggucauauaauagaagcuguaaaaaauguucaugcuguggccuagcauaucauccauucacaaauuguggcucacauugugucugugguuuaaaguuugaagcaucagacagaaugagaauacacagagaaucaggguuaugccagggcuacaaaagcuuaagaguagcaagacuauugugcaaaucaaaagguucaucucuuauaauuucaauauuguuaucuauguuaauccugagcuuuguuacgccgauagaagggacuuuaacuaauuacccagagucaaggaaauacgaucuagaagaaauugcugacgucuuggagggguuuauuacagaaaagggaauaaaagaauauguaguuuuuuauacuucuauuuuuggggguuuguuuuuauuacuggcauugauuauuauaauugcauugaacagaguuacagaauaccucacaaauauuaaugucuuuuauugucacgaaugcucaauguaucauucaaagaagaauauaaaauauauuggugauuuuacaaauaaguguggguuuuguacauguggggagcuagaagaucaagaaggauuaaagauacacaaagucagcagaaagugcauauacaaauaucaacuuacuugguccaaaauaaucaugauaauauuagugugucuacugauugcccaaaauaccaucuuaauaguugcagcaucaaaugauuguugggcaaagaaaucuuuagagauggaaugcauagggcccuugcagcaaguggaaucaugugaugacaaagcaagcagaucuuacagcggagaggcaaaaaagcuaguaagagcaucuaaaauaucagauuuagaugcagcacaaguaggcuuacuagguucuacaauagaaucagcaauagcaaguauaaggaaacaaagaacauauccaaccaugcaucuccuugaaucaguauuuuuggcaaaacauugugauuacuauaaauccuuugagcauaacagugguuauucccaagcaaaauggcgguuaacagcuaaaacacaucauuuugacauuuguucaagacacagcacccaccauuucuguaggugcauuucugauggaacuaaaugccagaauggggauugggauuuugcaggugagaugaauucaacauaucaaucaaaaaaagauuuuuuugagcaugauuuuaaacuauucugcacccuccuggagaaugcuuucccaggcacaacagaaucauuuuauuaucaaaugcugcaaaagaaaaauacaacuggcguuguaaaacuauuggaugaauuaacaaagaaauuuggaaacaauaauauguuuguagggauauggaaauuuggacaauauuuaaugucacucccauacaucaaugaaacaucauuaacuccuuuacaacuuucaaaaauauuggaagcuucagaccagcaucaucgcucuauaucuggaaggcaagaaucauuagcuaaugccgccucugggaguaaaucuaaagaaugcgaucaugcaaaaaaagucucuugcauaaguccuagguuuggugucccaauggaagggcuaauagcauguggaagcucaccaaauuauaaaauuuauaagaugccaacaaagcuuuacaaaucaaauaauaaaggcgaagugugguguucaggugauguucauugcuuccaagaauugaacccugcuucacaggagucuguggauagaauaaagcaaaugacauguuuuuugacugagccugagacaaaugaagaugucuuuucaauugccauaucuaugugcaaaguucaagauaaaggagugugcacaauaaaugaagagagauggaauguaauaaaaugcgacaguggcuuaauauauuacacugaccagagggauggacaagauacagguaacgacuuuggagaauauugccuaucacacaauuguaggauugaaagguuuccaauaaacccuacaauaauaaaugauugccuaugggaauaucauucacgaaaaucuaaguacauuacuaguuuagacuuagaaagucuugaagaauucaaaagggcuauuucugagaaauuaucacauacccucauaguauauaauuuuaaaccaacagcuaaccucccucauaucaagccaguguauaaauauauuacaguacaagggguugagaauucugauggaguagauucagcauacauaacugcuagcaugccggcucuaaguggaacaaguauaggauauaauauaaugucuaaagauaacuuuccauuauuugauauaaucauauucauaaaaagcgcuguuaucaaggcaacuuauaaucacauauaugauacaggccccacuauagggauaaauguaaugcaugaugagcacugcacaggucagugcccaacagauauaccacauaaagagaauuggaucacauuuucccaggaaaggacuagccguuggggaugugaagaauucggaugccucgcugugaauacagguugugucuuugguucuugccaagauauaauaagaccagaaacaaaaguauauagaaaagcaaucgaagaaaguguuuuauuaacagucugcauaacuuauccuggcaagacauuuuguacagaaauaaaugcuauagaaccuaaaauuacagaugaauuagaacugcaauuuaaaacaguugacacaaaaacauuacccaauauauuagcuguucaaaauuacaaauuauauagugggcaaauaaaugauuuaggaucguuuucacaagguugugguaacauacagaaaaccaauucaucuauaauaggaacaggcacugccaaauuugauuacguaugucauggugccucuagaaaagauauuauuguaagaagguguuacaacaauaacuaugaaucaugcagauuauuaaaagaagaacaauccuuaauguuugcagacaaccaugaaacuauugacguagcuaaugucaggcaccuccuuggggaucuacaauuuaaguugauguuaggagauuuaagauacaagucauuugcagaagacccagacuuagagauagaagcaaaauguguuggguguccaucauguuuuacuagcuauuccugcaauuuuagaauuguuucaaacauugauacuguguguucaauugaagggccuugcacaaccuuucacaacaggcuaaugaucacuuccacaaaacaggauuauggcaucaagaugagcuguaagggaaagccaggaucaacagaagaauuucagaucugcaagaaaacuuacacaguguuguuuacaacaguugaaaagaaugacaaaauugagauaaacacaggagaccaaacaucuuucauucaagagagggaugauagaugcaaaacaugguuauguagggucagagaugaagggauuaguguuauuuuugaaccaauaagggccuuuuuugggagcuauuuuaguauagccuucuauaucgugguuggaaucauuguccuguuccuugugaucuauauuuuuuugccuauggcauuuaaacuuagggauguauuaaaaaggaaugaauaucuauaucuacaggagauaaagcacaaguag

SEQ ID NO: 4137 - RNA, 4305 nt, Artificial Sequence
  derived and/or modified CDS sequence (wt) from BATV(EIV-2077Astr)__KT313702.1__GP
auguugcuauuccucaucuuacuaauccccuguuaugcaucagccuccccuguaguaacaagaugcuuccauggagggcaauuaauagcagaaaguagguccccaacagcugugucagaauucugcuuaaaagaugaugucucuacuauuaaaucagagauaauauauguuaagaaugauacuggauuguuugcacacaacaaaguuuuaaggaacuggaucauaaaagacuggaaaaacugcaauccugugccuacagcuggggguagcauuaaugucauagaaguuaauacagaccugagcuugagcacaaaaacauacguguguaguagagauugcacaauuacaguugauaaagaagaugcucagauaaucuuccaaacugagaaauuaaaucauuuugaaguuucuggaaccacauuaaguucaggcugguucaaaacuaaagcaucaguaacacuggauagaacaugugagcauaucaaggucacaugugggaaaaagacucugcaauuucaugcauguuuuaagcaccauaugucaugcauuagauuuuuccaugguaccauucuccccggaacaauggcaacuucgaucugucaaaauauagagcuuauaauuauaauaaguuugacacugcuuauuuuuaucuugauggcaauauugacuaaaaccuacauauguuauuugcuaaugcccuuauucaugccuauugcauaucuuuaugguuggucauauaauagaagcuguaaaaaauguucaugcuguggccuagcauaucauccauucacaaauuguggcucacauugugucugugguuuaaaguuugaagcaucagacagaaugagaauacacagagaaucaggauuaugccagggcuacaaaagcuuaagaguagcaagacuauugugcaaaucaaaagguucaucucuuauaauuucaauauuguuaucuauguuaauccugagcuuuguuacgccaauagaagggacuuuaacuaauuacccagagucaaggaaauacgaucuagaggaaauugcugacgucuuggagggauuuguuacagaaaagggaauaaaagaauauguaguuuuuuauacuucuauuuuuggggguuuguuuuuauuacuggcauugauuauuauaauugcauugaacagaguuacagaauaccucacaaauauuaaugucuuuuauugucacgaaugcucaauguaucauucaaaaaagaauauaaaauauauuggugauuuuacaaauaaguguggguuuugcacauguggggagcuagaagaucaagaaggauuaaagauacacaaagucagcagaaagugcauauacaaauaucaacuuacuugguccaaaauaaucaugauaauauuagugugucuacugauugcccaaaauaccaucuuaauaguugcagcaucaaaugauuguugggcaaagaaaucuuuagagauggaaugcauagggccuuugcagcaaauggaaucaugugaugacaaagcaagcagaucuuauaguggagaggcaaaaaagcuaguaagggcaucuaaaauaucagauuuagaugcagcacaaguaggcuuacuagguucuacaauagaaucagcaauagcaaguauaagaaaacaaagaacauauccaaccaugcaucuccuugaaucaguauuuuuggcaaaacauugugauuacuauaaauccuuugagcauaauagugguuauucccaagcaaaauggcgguuaacagcuaaaacacaucauuuugacauuuguucaagacacagcacccaccauuucuguagaugcauuucugauggaacuaaaugccagaauggggacugggauuuugcaggugagaugaauucaacauaucaaucaaaaaaagauuucuuugagcaugauuuuaaacuauucugcacccuccuggagaaugcuuucccaggcacaacagaaucauuuuauuaucaaaugcugcaaaagaaaaauacaacugguguuguaaaacuauuggaugaauuaacaaagaaauuuggaaacaauaauauguucguagggauauggaaauuuggacaauauuuaaugucacucccauacaucaaugaaacaucauuaacuccuuuacaacuuucaaaaauauuggaggcuucagaccagcaucaucgcucuauaucuggaaggcaagaaucauuagcuaaugccgccucuggggguaaaucuaaagaaugugaucaugcaaaaaaagucucuugcauaaguccuagguuuggugucccaauggaagggcuaauagcauguggaggcucaccaaauuauaaaauuuauaagaugccaacaaagcuuuacaaaucaaauaauaaaggagaagugugguguucaggugauguucauuguuuccaagaauugaacccugcuuuacaggagucuguagauagaauaaagcaaaugacauguuuuuugacugaaccugagacaaaugaagaugucuuuucaauugccauaucuaugugcaagguucaagauaaaggagugugcacaauaaaugaagagagauggaauguaauaaaaugcgacaguggcuuaauauauuacacugaccagagggauggacaagacacagguaacgacuuuggagaauauugccuaucacacaauuguagaauugaaagguuuccaauaaacccuacaauaauaaaugauugccuaugggaauaucauucacgaaaaucuaaguacauuacuaguuuagacuuagaaagucuugaagaauucaaaagggcaauuucugagaaauuaucacauacccucauaguauauaauuuuaaaccaacggcuaaccucccucauaucaagccaguguauaaauauauuacaguacaagggguugagaauucugauggaguagauucagcauacauaacugcuagcaugccggcucuaaguggaacaaguauaggauauaauauaaugucuaaagauaacuucccauuauuugauauaaucauauucauaaaaagcgcuguuaucaaggcaacuuauaaucacauauaugauacaggccccacuauagggauaaauguaaugcaugaugagcacugcacaggucagugcccaacagauauaccacauaaagagaauuggaucacauuuucucaggaaaggacuagccguuggggaugugaagaauucggaugccuugcugugaauacagguugugucuuugguucuugccaggauauaauaagaccagaaacaaaaguauauagaaaagcaaucgaagaaaguguuuuauuaacagucugcauaacuuaucccgguaagacauuuuguacagaaauaaaugcuauagaaccuaaaauuacagaugaauuagaacugcaauuuaaaacaguugacacaaaaacauuacccaauauauuagcuguucaaaaccacaaauuauauagugggcaaauaaaugauuuaggaucguuuucacaaggcugugguaauauacagaaaaccaauucaucuauaauaggaacaggcacugccaaauuugauuacguaugucauggugcuucuagaaaagauauuauuguaagaagguguuacaacaauaacuaugaaucaugcagauuauuaaaagaagaacaauccuuaauguuugcagacaaccaugagacuauugacguagcuaaugucaggcaccuccuuggggaucuacaauuuaaguuaauguuaggagauuuaagauacaagucauuugcagaagacccagacuuagagauagaagcaaaauguguuggguguccaucauguuuuacuagcuacuccugcaauuuuagaauuguuucaaauauugauacuguguguucaauugaagggccuugcacaaccuuucacaacaggcuaaugaucacuuccacaaaacaggauuauggcaucaagaugagcuguaagggaaaaccaggaucaacagaagaauuucagaucugcaagaaaacuuacacaguguuguuuacaacaguugaaaagaacgacaaaauugagauaaacacaggagaccaaacaucuuucauucaagagagggaugauagaugcaaaacaugguuauguagggucagagaugaagggauuaguguuguuuuugaaccaauaagggccuuuuucgggagcuauuuuaguauagccuucuauaucgugguuggaaucauuguccuguuccuugugaucuacauuuucuugccuauggcauuuaagcuuagggauguauuaaaaaggaaugaauaucuauaucuacaggagauaaagcacaaguag

SEQ ID NO: 4138 - RNA, 4305 nt, Artificial Sequence
  derived and/or modified CDS sequence (wt) from BATV(Italy-2009)__KC168047.1__GP
auguugcuauuccucaucuuacuaauucccuguuaugcaucagccuccccuguaguaacaagaugcuuccauggagggcaauuaauagcagagaguagguccccaacagcugugucagaguucugcuuaaaagaugaugucucuacuauuaaaucagagauaauauaugucaagaaugauacuggauuguuugcgcacaacaaagucuuaaggaauuggaucauaaaagacuggaagaacugcaauccugugccuacagcuggggguagcauuaaugucauagaagucaauacagaccugagcuugagcacaaaaacauacguguguaguagagauugcacaauuacaguugauaaagaagaugcucagauaauauuccaaacugagaaauuaaaucauuuugaaguuucuggaaccacauuaaguucaggcugguucaaaacuaaagcaucaguaacacuggauagaacaugugagcauaucaaggucacaugugggaaaaagacucugcaauuucaugcauguuuuaagcaccauaugucaugcauuagauuuuuccauaguaccauucuucccggaacaauggcaacuucaaucugucaaaauauagagcuuauaauuauaauaaguuugacacugcuuauuuuuaucuugauggcaauauugacuaaaaccuacauauguuauuugcuaaugcccuuauucaugccuauugcauaucuuuaugguuggucauauaauagaagcuguaaaaaauguucaugcuguggccuagcauaucauccauucacaaauuguggcucacauugugucugugguuuaaaguuugaagcaucagacagaaugagaauacacagagaaucaggguuaugccagggcuauaaaagcuuaagaguagcaagacuguugugcaaaucaaaagguucaucucuuauaauuucaauauuguuaucuauguuaauccugagcuuuguuacgccgauagaagggacuuuaacuaauuacccagagucaaggaaauacgaucuagaagaaauugcugacgucuuggagggguuuauuacagaaaagggaauaaaagaauauguaguuuuuuacacuucuauuuuuggggguuuauuuuuauuacuggcauugauaauuauaauugcauugaacagaguuacagaauaccucacaaauauuaaugucuuuuauugucacgaaugcucaauguaucauucaaagaagaauauaaaauauauuggugauuuuacaaauaaguguggguuuuguacauguggggagcuagaagaucaagaaggauuaaagauacacaaagucagcaggaagugcauauacaaauaucaacuuacuugguccaaaauaaucaugauaauauuagugugucuacugauugcccaaaauaccaucuuaauaguugcagcaucaaaugauuguugggcaaaaaaaucuuuagagauggaaugcauagggcccuugcagcgaguggaaucaugugaugacaaagcaagcagaucuuacagcggagaggcaaaaaagcuaguaagagcaucuaaaauaucagauuuagaugcagcacaaguaggcuuacuagguucuacaauagaaucagcaauagcaaguauaaggaaacaaagaacauauccaaccaugcaucuccuugaaucaguauuuuuggcaaaacauugugauuacuauaaauccuuugagcauaauagugguuauucccaagcaaaauggcgguuaacagcuaaaacacaucauuuugacauuuguucaagacacagcacccaccauuucuguaggugcaucucugauggaacuaaaugccagaauggggauugggauuuugcaggugagaugaauucaacauaucaaucaaaaaaagauuuuuuugagcaugauuuuaaacuauucugcacccuccuggagaaugcuuucccaggcacaacagaaucauuuuauuaucaaaugcugcaaaagaaaaauacaacuggcguuguaaaacuauuggaugaguuaacaaagaaguuuggaaacaauaauauguuuguagggauauggaaauuuggacaauauuuaaugucacucccguacaucaaugaaacaucauuaacuccuuuacaacuuucaaaaauauuggaagcuucaaaccagcaucaucgcucuauaucuggaaggcaagaaucauuagcuaaugccgccucuggggguaaaucuaaagaaugcgauaaugcaaagaaagucucuugcauaaguccuagguuugguguuccaauggaagggcuaauagcauguggaagcucaccaaauuauaaaauuuauaagaugccaacaaagcuuuacaaaucaaauaauaaaggcgaagugugguguucaggugauguucauuguuuccaagaauugaacccugcuucacaggagucuguggauagaauaaagcaaaugacauguuuuuugacugagccugagacaaaugaagauguuuuuucaauugccauaucuaugugcaagguucgagauaaaggagugugcacaauaaaugaagagagauggaauguaauaaaaugcgacaguggcuuaauauauuacacugaccagagggauggacaagacacagguaacgauuuuggagaauauugccuaucacacaauuguaggauugaaagguuuccaauaaacccugcaauaauaaaugauugccuaugggaauaucauucacggagaucuaaguacauuacuaguuuagacuuagaaagucuugaagaauucaaaagggcuauuucugagaaauuaucacauacccucauaguauauaauuuuaaaccaacggcuaaccucccucauaucaagccaguguauaaauauauuacaguacaagggguugagaauucugauggaguggauucagcauacauaacugcuagcaugccggcucuaaguggaacaaguauaggauauaauauaaugucuaaagauaacuucccauuauuugauauaaucauauucauaaaaagcgcuguuaucaaggcaacuuauaaucacauauaugauacaggccccacuauagggauaaauguaaugcaugaugagcacugcacaggucagugcccaacagauauaccacauaaagagaauuggaucacauuuucccaggaaaggacuagucguuggggaugugaagaauucggaugccuugcugugaauacagguugugucuuugguucuugccaagauauaauaagaccagaaacaaaaguauauagaaaagcaaucgaagaaaaugucuuauuaacaguuugcauaacuuaucccgguaagacauuuuguacagaaauaaaugcuauagaaccuaaaauuacagaugaauuagaacugcaauuuaaaacaguugacacaaaaacauuacccaauauauuagcuguucaaaaccacaaauuguauagugggcaaauaaaugauuuaggaucguuuucacaagguugugguaacauacagaaaaccaauucaucuauaauaggaacaggcacugccaaauuugauuauguaugucauggugccucuagaaaagauauuauuguaagaagauguuacaacaauaacuaugaaucaugcagauuauuaaaagaagaacaauccuuaauguuugcagacaaccaugaaacuauugacguagcuaaugucaggcaccuccuuggggaucuacaauuuaaguugauguuaggagauuuaagauacaagucauuugcagaagacccagacuuagagauagaagcaaaauguguuggguguccaucauguuuuacuagcuacuccugcaauuuuagaauuguuucaaauauugauacuguguguucaauugaagggccuugcacaaccuuucacaacaggcuaaugaucacuuccacaaaacaggauuauggcaucaagaugagcuguaagggaaagccaggaucaacagaagaauuucagaucugcaagaaaacuuacacaguguuguuuacaacaguugaaaagaaugacaaaauugagauaaacacaggagaccaaacaucuuucauucaagagagggaugauagaugcaaaacaugguuauguagggucagagaugaagggauuaguguuauuuuugaaccaauaagggccuuuuucgggagcuauuuuaguauagcuuucuauaucgugguuggaaucauuguccuguuccuuaugaucuacauuuucuugccuauggcauuuaaacuuagggauguauugaaaaggaaugaauaucuauaucuacaggaaauaaagcacaaguag

SEQ ID NO: 4139 - RNA, 4305 nt, Artificial Sequence
  derived and/or modified CDS sequence (wt) from BATV(MM2222)__AB257763.1__GP
auguugcuacuucuugucuuauuaaucucuugcuguguaucagccucuccuguaauaacgagauguuuucauggagggcaacugauagcagaaaggaagucccaaacagcuauaucagaauuuugccucaaggaugaugucucuacuauuaagucagaaauaauauaugaaaaaaaugacacugguuuauuugcacauaauaaaguuuuacgaaauuggaucauaaaagacuggaaaaauugcaauccuguucccacagcagggggcaguauaaauguuauagaagucaauacagauuugagcuugaccacaaaaacauauguguguagcagagauugcacaaucacaguugauaaagaagaugcccaaauaguuuuccaaacugaaaaauugaaucauuuugagguuucuggaaccacauugagcucagguugguucaaaaccaaggcaucaguaacauuagauagaaccugcgaacacauuaaagugacaugugggaagaagaccuuacaauuccaugccuguuucaaacaccacaugucguguauuagauuuuuccaugguacuauccuuccuggaacaauggcuacuucuaucugccagaauauagaacucauaauuauaauaagucuaacauuaauuauuuuuaucuuaauggugauacugaccaaaaccuacauauguuaucuauuaaugccacuauuuaugccaaucgcauacuuuuaugguuggucauacaacaaaaguugcaaaaaaugcccguguuguggccuagcauaucacccuuucacaaauuguggaucacauugugugugcggguugaaauuugaggcaucagauaggaugaggauacauagagaaucaggauuaugucaaggcuacaaaagcuuacguguagcuagguugcuguguaaaucaaaagguucaucccucauaaucucaauauuauuaucuauguugauacugagcuuuguuacaccaauagaggggacauuaacuaauuauccagaaucaagaaaauacaaccuagaggagauugcugaugucuuagaaggauucguuguggaaaaaggaauaaaggaauauguagucuuuuauacuucuauuuucggagcuuuauuuuuauuaauggcacuaauugucauaauagcacuaaauagaguuacagaauaucucacaaacaucaauguuuuguacugucaugaauguucaauguaucacucaaagaagaauauaaaauauauuggagauuucacaaacaaauguggcuuuuguacauguggagagcuagaagaucaagaaggcuuaaaaauacauaaaguaagcagaaagugcauauauaaauaucagcucaccugguccaaaauaauuaugaugauauuagugugucuacugauugcucaaaacaccauccuaauaguugcagcaucagacgauugcuggacaaaaaagucuuuggagauggaauguauaggcccuuuacagcaaguggauacaugugaagacaaaacaagcaggucuuacaguggagaggcaaaaaaacuagugagggcaucaaaaauaucagauuuagaugcagcacagguagggcuguuaggauccacgauagaaucagcaauagcaagcauaagaaggcaaagaacauauucaacuaugcaucuucuugaaucaguauuccuggggaagcauugugauuacuauaaaguuuuugagcauaacaguggcuacucucaggcgaaauggagguuaacagcuaaaacacaucauuuugauauuugcucaagacauagcacccaucauuucugcagaugcaucucagauggaacuaaaugucaaaauggggauugggauuuugcaggugaaaugaacucaauauaccaaucaaagagagacuuuuuuaagcaugacuucaaacuguucuguacucuuauagaagaugcuuucccaggcacaacugagucacucuuuuaugaaaugcuaucaaagaaaaacacaacugguauuacaaaacuauuagauaaauuaacaaaaaaauuugggaacaacaauauguucguaggaauuuggaaauuugggcaauaucuaaugucacugccauaugucaaugaaacaucauuauccccuacucaacuugcuaaaguauuagagguuacagaucaucaucaccggucuauaucuggaaggcaagagucgcuggcuagugcuaccucugggaguaaguccagugagugugaccaugcaaagaagguuucuugcauaaguccuagguuugguguuccaauggaaggauuaauagcauguggaaacucaccaaauuacaagauuuauaagacaccagcaaagcuuuacaaaucaaacaacaagggagaagugugguguucaggugauguucauuguuuccaagaacuaaucccugccucacaagaaucuguugacaggauaaaacaaaugacuugcuuuuuaacugaaccugaaguaaaugaugacguuuucuccauugcaauaucuaugugcaaaguccaagacaagggaguauguacaauaaaugaagauagguggaacguaauaaaaugugauaguggccugauauauuauacugaccagagagaagggcaagacacaggcaaugauuuuggggaauauuguuuaucccacagcuguagaauagaaagguucccaauaaauccgacaauaaucagugauuguuuaugggaauaucauucacgaaaaucaaaauauauuaccaguuuagaucuagaaagcuuagaagaguuuaaaagagcuauuucugagaaauugucacauacucuuauaguguauaauuuuaaaccgacagccaaucuuccucauauaaagccaguauacaaguauaucacaguucaagggguugaaaauucugaugggguagauucagcauauauaacugcuaguaugccagcuuuaaguggaacaagcauagguuauaauauaaugucuagggauaacuucccacuauuugauauaauuauauucauaaaaagugccauuauuaaggcgacuuauaaucacauauaugacacagguccuacuauagggauuaauguaaugcaugaugaacauuguacaggacaauguccgacagacauaccacauaaagaaaauuggaucacauuugcccaagagagaacuagucguuggggaugugaagaauuugggugccuugcugucaacacuggcuguguuuuuggcucuugucaagacauaauaaggccagaaacaaagguuuauaggaaagcaguugaggagagugucuuauugacaguuuguauaacuuauccugguaaaacauuuugcacagaaauaaaugccauagagccuaaaauuacagaugaauuagaauugcaguuuaaaacaguugauacaaaaacacugcccaacaucuuggcuguccaaaaccauaaauuauacaguggacagaucaaugacuuaggaucauucucacaaggcugugguaacauacagaaaaccaauucauccaucauaggcacaggcacugcaaaguuugauuaugugugucauggugccucuagaaaagauauaauugugaggagaugcuacaauaauaauuaugaaucauguaaauuauugaaggaggaacaauccuuaauguuugcagauaaucaugaaacaaucgauguagccaaugucagacaccuucuuggggaucugcaauuuaaauuaauguuaggagaucugagguacaaaucauuugcggaaaauccagauuuggaaauagaagcaaaguguguugggugcccaucauguuuuacuaguuauuccugcaguuuuaagauuguuucaaauauugacacugugugcucaauugaagggccuuguacaacuuuucacaacagauugaugaucaccuccacaaaacaagauuauggcauuaaaaugagcugcaagacaaagccagggccaauagaggaguuccagauuugcaagaaaacuuacacaauacuguuuacaacaguugaaaagaaugauaaaaucgaaauaagcacaggggaccaaacaucuuucauccaagaaaaagaugauagaugcaaaacaugguuauguagaguuagagaugaagggaucaguguuauuuucgaaccaauaagagcuuucuuuggaagcuacuuuaguauagcuuuuuauauaguaauugguaucauuguccuguuccuaguaauuuacauuuuuuuaccuaugauguuuaaacuuagagauguauuaaaaagaaaugaauaccuguaccuacaggaaauaaaacauaaguaa

SEQ ID NO: 4140 - RNA, 4305 nt, Artificial Sequence
  derived and/or modified CDS sequence (wt) from BATV(MM2222)__AY772534.1__GP
auguugcuacuucuugucuuauuaaucucuugcuguguaucagccucuccuguaauaacgagauguuuucauggagggcaacugauagcagaaaggaagucccaaacagcuauaucagaauuuugccucaaggaugaugucucuacuauuaagucagaaauaauauaugaaaaaaaugacacugguuuauuugcacauaauaaaguuuuacgaaauuggaucauaaaagacuggaaaaauugcaauccuguucccacagcagggggcaguauaaauguuauagaagucaauacagauuugagcuugaccacaaaaacauauguguguagcagagauugcacaaucacaguugauaaagaagaugcccaaauaguuuuccaaacugaaaaauugaaucauuuugagguuucuggaaccacauugagcucagguugguucaaaaccaaggcaucaguaacauuagauagaaccugcgaacacauuaaagugacaugugggaagaagaccuuacaauuccaugccuguuucaaacaccacaugucguguauuagauuuuuccaugguacuauccuuccuggaacaauggcuacuucuaucugccagaauauagaacucauaauuauaauaagucuaacauuaauuauuuuuaucuuaauggugauacugaccaaaaccuacauauguuaucuauuaaugccacuauuuaugccaaucgcauacuuuuaugguuggucauacaacaaaaguugcaaaaaaugcccguguuguggccuagcauaucacccuuucacaaauuguggaucacauugugugugcggguugaaauuugaggcaucagauaggaugaggauacauagagaaucaggauuaugucaaggcuacaaaagcuuacguguagcuagguugcuguguaaaucaaaagguucaucccucauaaucucaauauuauuaucuauguugauacugagcuuuguuacaccaauagaggggacauuaacuaauuauccagaaucaagaaaauacaaccuagaggagauugcugaugucuuagaaggauucguuguggaaaaaggaauaaaggaauauguagucuuuuauacuucuauuuucggagcuuuauuuuuauuaauggcacuaauugucauaauagcacuaaauagaguuacagaauaucucacaaacaucaauguuuuguacugucaugaauguucaauguaucacucaaagaagaauauaaaauauauuggagauuucacaaacaaauguggcuuuuguacauguggagagcuagaagaucaagaaggcuuaaaaauacauaaaguaagcagaaagugcauauauaaauaucagcucaccugguccaaaauaauuaugaugauauuagugugucuacugauugcucaaaacaccauccuaauaguugcagcaucagacgauugcuggacaaaaaagucuuuggagauggaauguauaggcccuuuacagcaaguggauacaugugaagacaaaacaagcaggucuuacaguggagaggcaaaaaaacuagugagggcaucaaaaauaucagauuuagaugcagcacagguagggcuguuaggauccacgauagaaucagcaauagcaagcauaagaaggcaaagaacauauucaacuaugcaucuucuugaaucaguauuccuggggaagcauugugauuacuauaaaguuuuugagcauaacaguggcuacucucaggcgaaauggagguuaacagcuaaaacacaucauuuugauauuugcucaagacauagcacccaucauuucugcagaugcaucucagauggaacuaaaugucaaaauggggauugggauuuugcaggugaaaugaacucaauauaccaaucaaagagagacuuuuuuaagcaugacuucaaacuguucuguacucuuauagaagaugcuuucccaggcacaacugagucacucuuuuaugaaaugcuaucaaagaaaaacacaacugguauuacaaaacuauuagauaaauuaacaaaaaaauuugggaacaacaauauguucguaggaauuuggaaauuugggcaauaucuaaugucacugccauaugucaaugaaacaucauuauccccuacucaacuugcuaaaguauuagagguuacagaucaucaucaccggucuauaucuggaaggcaagagucgcuggcuagugcuaccucugggaguaaguccagugagugugaccaugcaaagaagguuucuugcauaaguccuagguuugguguuccaauggaaggauuaauagcauguggaaacucaccaaauuacaagauuuauaagacaccagcaaagcuuuacaaaucaaacaacaagggagaagugugguguucaggugauguucauuguuuccaagaacuaaucccugccucacaagaaucuguugacaggauaaaacaaaugacuugcuuuuuaacugaaccugaaguaaaugaugacguuuucuccauugcaauaucuaugugcaaaguccaagacaagggaguauguacaauaagugaagauagguggaacguaauaaaaugugauaguggccugauauauuauacugaccagagagaagggcaagacacaggcaaugauuuuggggaauauuguuuaucccacagcuguagaauagaaagguucccaauaaauccgacaauaaucagugauuguuuaugggaauaucauucacgaaaaucaaaauauauuaccaguuuagaucuagaaagcuuagaagaguuuaaaagagcuauuucugagaaauugucacauacucuuauaguguauaauuuuaaaccgacagccaaucuuccucauauaaagccaguauacaaguauaucacaguucaagggguugaaaauucugaugggguagauucagcauauauaacugcuaguaugccagcuuuaaguggaacaagcauagguuauaauauaaugucuagggauaacuucccacuauuugauauaauuauauucauaaaaagugccauuauuaaggcgacuuauaaucacauauaugacacagguccuacuauagggauuaauguaaugcaugaugaacauuguacaggacaauguccgacagacauaccacauaaagaaaauuggaucacauuugcccaagagagaacuagucguuggggaugugaagaauuugggugccuugcugucaacacuggcuguguuuuuggcucuugucaagacauaauaaggccagaaacaaagguuuauaggaaagcaguugaggagagugucuuauugacaguuuguauaacuuauccugguaaaacauuuugcacagaaauaaaugccauagagccuaaaauuacagaugaauuagaauugcaguuuaaaacaguugauacaaaaacacugcccaacaucuuggcuguccaaaaccauaaauuauacaguggacagaucaaugacuuaggaucauucucacaaggcugugguaacauacagaaaaccaauucauccaucauaggcacaggcacugcaaaguuugauuaugugugucauggugccucuagaaaagauauaauugugaggagaugcuacaauaauaauuaugaaucauguaaauuauugaaggaggaacaauccuuaauguuugcagauaaucaugaaacaaucgauguagccaaugucagacaccuucuuggggaucugcaauuuaaauuaauguuaggagaucugagguacaaaucauuugcggaaaauccagauuuggaaauagaagcaaaguguguugggugcccaucauguuuuacuaguuauuccugcaguuuuaagauuguuucaaauauugacacugugugcucaauugaagggccuuguacaacuuuucacaacagauugaugaucaccuccacaaaacaagauuauggcauuaaaaugagcugcaagacaaagccagggccaauagaggaguuccagauuugcaagaaaacuuacacaauacuguuuacaacaguugaaaagaaugauaaaaucgaaauaagcacaggggaccaaacaucuuucauccaagaaaaagaugauagaugcaaaacaugguuauguagaguuagagaugaagggaucaguguuauuuucgaaccaauaagagcuuucuuuggaagcuacuuuaguauagcuuuuuauauaguaauugguaucauuguccuguuccuaguaauuuacauuuuuuuaccuaugauguuuaaacuuagagauguauuaaaaagaaaugaauaccuguaccuacaggaaauaaaacauaaguaa

SEQ ID NO: 4141 - RNA, 4305 nt, Artificial Sequence
  derived and/or modified CDS sequence (wt) from BATV(MM2222)__JX846596.1__GP
auguugcuacuucuugucuuauuaaucucuugcuguguaucagccucuccuguaauaacgagauguuuucauggagggcaacugauagcagaaaggaagucccaaacagcuauaucagaauuuugccucaaggaugaugucucuacuauuaagucagaaauaauauaugaaaaaaaugacacugguuuauuugcacauaauaaaguuuuacgaaauuggaucauaaaagacuggaaaaauugcaauccuguucccacagcagggggcaguauaaauguuauagaagucaauacagauuugagcuugaccacaaaaacauauguguguagcagagauugcacaaucacaguugauaaagaagaugcccaaauaguuuuccaaacugaaaaauugaaucauuuugagguuucuggaaccacauugagcucagguugguucaaaaccaaggcaucaguaacauuagauagaaccugcgaacacauuaaagugacaugugggaagaagaccuuacaauuccaugccuguuucaaacaccacaugucguguauuagauuuuuccaugguacuauccuuccuggaacaauggcuacuucuaucugccagaauauagaacucauaauuauaauaagucuaacauuaauuauuuuuaucuuaauggugauacugaccaaaaccuacauauguuaucuauuaaugccacuauuuaugccaaucgcauacuuuuaugguuggucauacaacaaaaguugcaaaaaaugcccguguuguggccuagcauaucacccuuucacaaauuguggaucacauugugugugcggguugaaauuugaggcaucagauaggaugaggauacauagagaaucaggauuaugucaaggcuacaaaagcuuacguguagcuagguugcuguguaaaucaaaagguucaucccucauaaucucaauauuauuaucuauguugauacugagcuuuguuacaccaauagaggggacauuaacuaauuauccagaaucaagaaaauacaaccuagaggagauugcugaugucuuagaaggauucguuguggaaaaaggaauaaaggaauauguagucuuuuauacuucuauuuucggagcuuuauuuuuauuaauggcacuaauugucauaauagcacuaaauagaguuacagaauaucucacaaacaucaauguuuuguacugucaugaauguucaauguaucacucaaagaagaauauaaaauauauuggagauuucacaaacaaauguggcuuuuguacauguggagagcuagaagaucaagaaggcuuaaaaauacauaaaguaagcagaaagugcauauauaaauaucagcucaccugguccaaaauaauuaugaugauauuagugugucuacugauugcucaaaacaccauccuaauaguugcagcaucagacgauugcuggacaaaaaagucuuuggagauggaauguauaggcccuuuacagcaaguggauacaugugaagacaaaacaagcaggucuuacaguggagaggcaaaaaaacuagugagggcaucaaaaauaucagauuuagaugcagcacagguagggcuguuaggauccacgauagaaucagcaauagcaagcauaagaaggcaaagaacauauucaacuaugcaucuucuugaaucaguauuccuggggaagcauugugauuacuauaaaguuuuugagcauaacaguggcuacucucaggcgaaauggagguuaacagcuaaaacacaucauuuugauauuugcucaagacauagcacccaucauuucugcagaugcaucucagauggaacuaaaugucaaaauggggauugggauuuugcaggugaaaugaacucaauauaccaaucaaagagagacuuuuuuaagcaugacuucaaacuguucuguacucuuauagaagaugcuuucccaggcacaacugagucacucuuuuaugaaaugcuaucaaagaaaaacacaacugguauuacagaacuauuagauaaauuaacaaaaaaauuugggaacaacaauauguucguaggaauuuggaaauuugggcaauaucuaaugucacugccauaugucaaugaaacaucauuauccccuacucaacuugcuaaaguauuagagguuacagaucaucaucaccggucuauaucuggaaggcaagagucgcuggcuagugcuaccucugggaguaaguccagugagugugaccaugcaaagaagguuucuugcauaaguccuagguuugguguuccaauggaaggauuaauagcauguggaaacucaccaaauuacaagauuuauaagacaccagcaaagcuuuacaaaucaaacaacaagggagaagugugguguucaggugauguucauuguuuccaagaacuaaucccugccucacaagaaucuguugacaggauaaaacaaaugacuugcuuuuuaacugaaccugaaguaaaugaugacguuuucuccauugcaauaucuaugugcaaaguccaagacaagggaguauguacaauaaaugaagauagguggaacguaauaaaaugugauaguggccugauauauuauacugaccagagagaagggcaagacacaggcaaugauuuuggggaauauuguuuaucccacagcuguagaauagaaagguucccaauaaauccgacaauaaucagugauuguuuaugggaauaucauucacgaaaaucaaaauauauuaccaguuuagaucuagaaagcuuagaagaguuuaaaagagcuauuucugagaaauugucacauacucuuauaguguauaauuuuaaaccgacagccaaucuuccucauauaaagccaguauacaaguauaucacaguucaagggguugaaaauucugaugggguagauucagcauauauaacugcuaguaugccagcuuuaaguggaacaagcauagguuauaauauaaugucuagggauaacuucccacuauuugauauaauuauauucauaaaaagugccauuauuaaggcgacuuauaaucacauauaugacacagguccuacuauagggauuaauguaaugcaugaugaacauuguacaggacaauguccgacagacauaccacauaaagaaaauuggaucacauuugcccaagagagaacuagucguuggggaugugaagaauuugggugccuugcugucaacacuggcuguguuuuuggcucuugucaagacauaauaaggccagaaacaaagguuuauaggaaagcaguugaggagagugucuuauugacaguuuguauaacuuauccugguaaaacauuuugcacagaaauaaaugccauagagccuaaaauuacagaugaauuagaauugcaguuuaaaacaguugauacaaaaacacugcccaacaucuuggcuguccaaaaccauaaauuauacaguggacagaucaaugacuuaggaucauucucacaaggcugugguaacauacagaaaaccaauucauccaucauaggcacaggcacugcaaaguuugauuaugugugucauggugccucuagaaaagauauaauugugaggagaugcuacaauaauaauuaugaaucauguaaauuauugaaggaggaacaauccuuaauguuugcagauaaucaugaaacaaucgauguagccaaugucagacaccuucuuggggaucugcaauuuaaauuaauguuaggagaucugagguacaaaucauuugcggaaaauccagauuuggaaauagaagcaaaguguguugggugcccaucauguuuuacuaguuauuccugcaguuuuaagauuguuucaaauauugacacugugugcucaauugaagggccuuguacaacuuuucacaacagauugaugaucaccuccacaaaacaagauuauggcauuaaaaugagcugcaagacaaagccagggccaauagaggaguuccagauuugcaagaaaacuuacacaauacuguuuacaacaguugaaaagaaugauaaaaucgaaauaagcacaggggaccaaacaucuuucauccaagaaaaagaugauagaugcaaaacaugguuauguagaguuagagaugaagggaucaguguuauuuucgaaccaauaagagcuuucuuuggaagcuacuuuaguauagcuuuuuauauaguaauugguaucauuguccuguuccuaguaauuuacauuuuuuuaccuaugauguuuaaacuuagagauguauuaaaaagaaaugaauaccuguaccuacaggaaauaaaacauaaguaa

SEQ ID NO: 4142 - RNA, 4305 nt, Artificial Sequence
  derived and/or modified CDS sequence (wt) from BATV(MS50)__JX846605.1__GP
augaagaugcugacucugauuauuauuguuucaugcuggguugcaacuuugcaaaacccacucaucucaagauguuuccacgguggucaacuaauagcagaaaagaaaucauugacaucgauaucugaauucugcaucaaagaugauguaucuauguuaaaaucagaagugauauaccaaaaaaaugauacuggaaucuauggucauagcaaaguuuucagacauuggacuauugcagauuggaaauacuguaacccagucccuacagcaggaggcagcauuaauguaauugaguuggauaaaaacuugaaucugauagcaaaaaacuauguaugcacuagagauugcacuauuaccguagacaaagaaaaugcacagauuguguuccagacugacaaacuuaaucauuuugaagugacugguacaacaauaaguacggggugguucaaaaccaaagcaucaguagcacuagauagaacuugugaacauaucaaagucaguugcggaaagaaaacacugcaauuccaugcuugcuucaaacaacacaugucauguguuagauuuuuacacagaaguaugcuaccagggucuauggcaaacucuauuugccagaauauagaguuaauuauaauuauaacauugacauuaguuauauuuauacuuauguugauagcaacuagauuuuauauauguuaucuucuaauaccaguguuuaugccuauugcuuaugcuuauggcugggcuuacaaucguaguuguaagaaauguaguuguuguggcuuagcauaccacccguuuacaaacuguggaucuuauuguguauguggagcuagguuugaaacaucugacaggaugaggcuacauagggaaucagggcuaugucaaggcuuuaaaagucuuaggauggcacgaagauuauguaaaucaaaagggucuucccuuguuauaucuauuuugcuagcgacauuaaucuuaucuuuuguaacaccaauagaagguacaaugacaaauuacccuaccaaugagaaauacucucuagaugaaauugcagauguucuaaaauggaaagaacaagaaagugaauauaaauauuaugccauacuauaugcuucuauaauuggugcguguuuuacaguauuauuugcaggcacugcuuuagcccucaacauaguguuagaguuauugacaaaaauaaauguuauauauugugaagaauguaguauguaccacagcaagucaaauauaaaguauauuggugauuuuacaaacaaauguggguuuugcacauguggauuacuagaagauccagaugguguugugguccauaaggugaagagaucaugcacauaccaguacaaacucacuuggguuaaaacaauaaugauaguguuaucuauuuuauucuugcuacaaaauauuauaguuauaguugcugcagauagugauuguuggacuaaugaagaacucaaaccagaauguguagggccucuaauugcaccagcagauuguaccgaaaaagauaagaagacauaccuaacagaagcagcugcauugguaaaaacuaaaaagauaucacagguagaugcagauaauguugaaauucuaggaaagacgauagagucagcaauaaaggcuauagaaaagcaaaaaaccuaccacaggaugcaccucuuggaagcaguuuuuuuaaauaaacauugcgauuauuauaaauuguuugagcauaauagugguuacucacaaguaaaguggagaauguuagcaaaaacccaacacuuugauauaugugcuuuugcaaaagaaagcaaauucugcaaauguauggcugguggugcuugcgcugaagacucuugggacuuugauacaaccaugaauucaacauauacaucgaaaggagacaauuuuaaacaugacaugucucuauuuuuaaaaauauuugaggcagcauuuccagguacaucguaugucuacaugcuuaauaaaaucaaggaaaagaaaccuuaccaaucaguaacuaugauagacaaaaucaaaacuaaauauccuaauaauaaaaugcugguagcuuaccuagaguuuggaaaauguuugauggguguaggacaugcaucaaccuuugaacuucaacagagucaacuagaaagauuauaccaaccagcagagcugaguagaucgguuggucaacuuacuucauuaucaaaugcacaagugggcacaaucacaaaagaaugcucuaaguauaaagauauaaguugcuuaaguccaagguuuggaauaccuauggaaaauaugguugccuguggggauaguccaaauuauaaaauauauaaaaaacccauuaagguuuacaaagcacaugauagaguagaaacaugguguauuaaagaccagcauuguuugguagacuacacgccagcagaggcagaugugguaaaaaaacucaaaacaaugaaguguugguuaaaugauccggguacugaaacugaugccuacaccacugcuauuaaaaguugcaggaucauggacaaagguguuuguacaguuaaugggcaaaaauggucaauaauaaaaugugacucugauuuacuuuauuauacagaucauauagagggagaggauacuggaaaugacauuggccacuauuguauaucuguugguugcaaaacagauagauacccaauuaauccagauauaguuacugauuguacuugggaguuuaaaucaagaaaaucaucuuacauagguaaaauaucaaugcaaucauuagaagauuauaaaaaagcacucacagacaaauuaacacacacacuugaaacauacagcuuugcaccaacugcagacuugccccauauaaaacccauuuauaaauauauuacagcacaaggugucgaaaacucugauggaauagagggugcuuauauaacagcaaccaucccugcacuggggggaacuagcauaggauauaguguucaaucaaaggaugguuucccucuauuagaccugauuauauauauaaaagcugcaguuauuagaagcacauauauacacuuauaugauacugggccaacuauuagcauaaauaccaaacaugaugagaaaugcacuggccaaugcccagcagaaauagaacaugaagcuaauugguugacuuucucacaagagagaacuagcagaugggguugugaagaauuuggguguuuagcaaucaauacuggcugugucuuuggaucaugccaagacgugauaaggccagaaacuaaaguauacagaaagucaguagaagaagaaguuguucuaacugucuguauaaauuauccuggcaacacauucuguacagagauaaaugcaauagaaccgaaaauaacugaagagguagagcuccaguuuaagacuguagacacaaaaacacuaccaacuuuacuagcagugacaaaucauaaauuauuuaguggccaaaucaaugauuuaggaacauuuggucagaugugugguaauguacagaaaacuaacucuagcaucuuaggcuccggcacaccuaaguuugauuacacaugccauggugcuaguagaaaagacauaauuguuagaaaauguuacaauaauaauuaugauucuuguaaacugcugaaggaagagaagcagcuuguauuuaaugacgaccaugagacuauaacuguuguaaauaaccgacauuugguuggggaauuagcaauaaaauuaaucuuaggagacauacaguacaagcuuuuuacagaaaaauuagaccuucagauagaugcaaaauguguugggugcccagauugcuuugagaguuaugccugcaauuuccagauuguuucuaauauagauaccgucugugcuauuaaugggccaugugacauauuccacaauagaauuucuauucgaucaacgcagcaaaauuaugguguuaaaaugucuuguaaaagaacaccagaucaaaaugagaaauuugugaucuguggaagggaguacagugucuuuuuccauacuguucaaaagaaugauaaaauugaaauaaacacuggcgaucagaccucuuauauaaaggagauggauacuagauguaaaaccugguuaugcagaguaagggaugaaggccuuaguguuauauuugagccuauuaaagccuucuuugguaguuacuucaguauugcuuuuuauauaguacuauucauaauuauagccuucuugguaaucuauauauuuaugccaauguucaugaagcuaagggauauauuaaagcagaaugaaaagcuuuaucuucaagaaaucaaacagaaauaa

SEQ ID NO: 4143 - RNA, 4305 nt, Artificial Sequence
  derived and/or modified CDS sequence (wt) from BATV(NM/12)__KJ187039.1__GP
auguugcuacuucuugucuuauuaaucccuugcuguguaucagccucuccugcaauaacaagauguuuucauggagggcaacugauagcagaaaggaagucccaaacagcuauaucagaauuuugccuuaaggaugaugucucuacuauuaagucagaaauaauauaugaaaaaaaugacacugguuuauuugcgcauaauaagguuuuacgaaauuggaucauaaaggacuggaaaaauugcaauccuguucccacagcagggggcaguauaaauguuauagaagucaauacagauuugagcuugacuacaaaaacauauguguguagcagagauugcacaaucacaguugauaaagaagaugcucaaauaauuuuccgaacugaaaaauugaaucauuuugagguuucugggaccacauugagcucagguugguucaaaaccaaagcaucaguaacauuagauagaaccugcgaacacauuaaagugacaugugggaagaagacccuacaguuccaugccuguuuuaagcaccacaugucguguauuagauuuuuucauggcacuauccuuccuggaacaauggcuacuucuaucugucagaauauagaacucauaauuauaauaagucugacauugauuauuuuuaucuuaauggugauauugaccagaaccuacauauguuaucuauuaaugccacuauuuaugccaaucgcauacuuuuaugguuggucauauaacaaaaguugcaaaaaaugucaauguuguggccuagcauaucauccuuuuacaaauuguggaucacauugugugugcggauugaaauuugaggcaucagauaggaugaggauacauagagaaucaggauugugucaaggcuacaaaagcuuacguguagcuagguugcuguguaaaucaaaagguucaucccucauaaucucaauauuauuaucuauguugauacugagcuuuguuacaccaauagaggggacauuaacuaauuacccagaaucaagaaaauacgaucuggaggaaauugcugaugucuuagaaggauucguuguggaaaaaggaauaaaagaauauguagucuuuuauacuucuauuuucggagcuuuauucuuauuaauggcauugauuauuauaauagcacuaaacagaguuacagaauaucucacaaacaucaauguuuucuacugccaugaauguucaauguaucacucaaagaagaauauaaaguauauuggagauuucacaaacaaauguggcuuuuguacauguggggaacuagaagaucaagagggcuuaaaaauacauaaaguaagcaggaagugcauauauaaauaucagcucaccugguccaaaauaauuaugaugauauuaguguguuuacuaauugcucaaaacacuauccuaauaguugcagcaucagacgacuguuggacaaaaaggucuuuagagaugggauguauaggcccucuacagcaaguggauacaugcgacgacaaaacaagcaggucuuacaguggggaagcaaaaaaacuagugagggcaucaaaaauaucggauuuggaugcagcacagguggggcuguuaggauccacaauagaaucagcaauagcaagcauaagaaagcaaagaacguauucaacuaugcaucuucuugaaucaguauuccuggggaagcauugugauuacuauaagguuuuugagcauaacaguggcuacucucaggcaaaauggagguugacagcuaaaacacaucauuuugauauuugcucaagacauagcacccaucauuucuguagaugcaucucagauggaacuaaaugucaaaauggagauugggauuuugcaagugaaaugaacucaacauaccaaucaaagagagacuuuuuugaacaugacuuuaaacaguucugcacucuuauagaaaaugcuuucccaggcacaacugagucacucuuuuaugaaaugcuaucaaagaaaaacacaacugguaucacaaaacuauuagauaaauuaacaaaaaaauucgggaacaacaauauguucguaggaauauggaaauuugggcaauaucuaaugucauugccauacgucaaugaaacaucauuaucuccuacucaacuugcuaaaguauuagagguuacagaucaucaucaccggucuauaucuggaaggcaagagucgcuggcuagugcagccccugggaguaaguccagugagugugaccaugcaaggaggguuucuugcauaaguccuagguuugguguuccaauugaaggauuaacugcuugugggagcucaccaaauuacaaaauuuauaagacaccagcaaagcuuuacaaaucaaacaacaagggcgaagugugguguucaggugauguccacugucuucaagagcugaucccugccccacaggaaucuguugacaggauaaaacaaaugacuugcuuuuugacugaaccuggagugaaugaugauauuuuuucuauugcaauaucuaugugcaagguccaagacaaagggguauguacaauaaaugaagauagguggaacguaguaaaaugugauaggggccugauauauuauacugaccagagagaagggcaagacacaggcaaugauuuuggaaaguauuguuuaucucacagcuguagaauagaaagguucccaauaaauccggcaauaauuaaugauuguuuaugggaauaucauucacgaaaaucaaaguauauuaccagcuuagaccuagaaagcuuagaagaauuuaaaagagcuauuucugagaaauugucacauacucuuauaguacauaauuuuaagccgacagccaaucuuccucauauaaagccgguauacaaguauaucacagugcaagggguugaaaauucugaugggguagauucagcauauauaacugcuaguaugccagcuuuaaguggaacaagcauagguuauaacauaaugucuagggauaacuuuccacuauuugauauaauuauauucauaaaaagugccauuauuaaggcaacuuauaaucacauauaugacacagguccuacuauagggaucaaugugauucaugaugaacauuguacaggacaaugcccaacagacauaccacauaaagaaaauuggauuacauuugcccaagagagaacuagucguuggggaugugaagaauuugggugucuugcuaucaacacuggcuguguuuuuggcucuugucaagauauaauaaggccagaaacaaagguuuauagaaaagcaguugaggagagugucuuauuaacaguuuguauaacuuauccugguaaaacauuuugcacagaaauaaaugccauagagccuaaaauuacagacgaauuagaauugcaguucaaaacaguugauacaaaaacacugcccaacaucuuagcuguccaaaaccauaaauuauauaguggacagauuaaugacuuaggaucauucucacaaggcugugguaauauacagaagaccaauucauccaucauaggcacaggcacugcaaaguuugauuaugugugucauggcgccucuagaaaagauaucauuguaaggagaugcuacaauaauaauuaugagucauguaaauuauugaaggaggaacaauccuuaauguuugcggauaaucaugaaacaaucgauguagccaauguuagacaucuccuuggagaucugcaguuuaaauuaauguugggagaucuaagguacaaaucauuugcugaaaacccagauuuggaaauagaagcaaaauguguugggugcccaucaugcuuuacuaguuauuccugcaguuuuaagauuguuucaaauauugauacugugugcucaauugaagggccuugcacaauuuuucauagcagauugaugaucaccucuacaaaacaagauuauggcauuaaaaugagcuguaagacaaagccagggccaacagaggaguuccagauuugcaagaaaacuuacacaauacuauuuacaacaauugaaaagaaugauaaaaucgaaauaagcacaggggaucaaacaucuuuuauccaagaaagagaugauagaugcagaacaugguuauguaggguuagggaugaagggaucgguguuauuuucgaaccaauaagagcuuucuuuggaagcuacuuuaguauagcuuuuuauauaguaauugguaucauuauccuguuucuaguaaucuacauuuucuugccuaugguguuuaaacuuagagauguauugaaaagaaaugaguaccuguaccuacaggaaauaaaacauaaguaa

SEQ ID NO: 4144 - RNA, 4305 nt, Artificial Sequence
  derived and/or modified CDS sequence (wt) from BATV(ON-1/E/94)__AB257764.1__GP
auguugcuauuucuuguauuauuaaucucuugcuaugugucagccucuccuguaauaacaagauguuuucauggagggcaacugauagcagaaaggaagucacaaacagcuauaucagaauuuugccuuaaagaugaugucucuacuauuaagucagaaauaauauaugaaaaaaaugacacugguuuauuugcgcauaguaaaguuuuacgaaauuggauuauaaaggacuggaaaaauugcaauccuguucccacagcagggggcaguauaaauguuauagaggucaaugcagauuugagcuuggccacaaaaacauauguguguagcagagauugcacaaucacaguugauaaagaagaugcucaaauaguauuccaaacugaaaaauugaaucauuuugagguuucuggaaccacauugagcucagguugguuuaaaaccaaggcaucaguaacguuagauagaaccugcgaacacaucaaaguaacaugugggaagaagacccuacaauuucaugccuguuucaaacaccacaugucgugcauuagauuuuuccauggcacuauccuuccuggaacaauggcuacuucuaucugucagaauauagagcucauaauuauaauaagucuaacauuaauuauuuuuaucuuaaugguaauacuaaccaaaaccuacauauguuaucuauugaugccacuauuuaugccaaucgcauacuuuuaugguuggucauacaacaaaagcugcaaaaaaugcucaugcuguggcuuagcauaucauccuuuuacaaauuguggaucacauugugugugcggguugaaauuugaggcaucagauagaaugcggauacauagagaaucaggguuaugucaaggcuauaaaagcuuacguguagcuagguugcuguguaaaucaaaggguucaucucucauaaucucaauauuauuaucuauguugauacugagcuuuguuacaccaauagaggggacauuaacuaauuacccagaaucaaggaaauacgaccuggaggaaauugcugacgucuuagaaggauuuguuguggaaaaaggaauuaaagaauauguagucuuuuauacuucuauuuucggagcuuuauuuuuauuaauggcacuuauugucauaauagcacuaaacagaguuacagaauaucucacaaacaucaauguuuuguacugucaugaauguucgauguaucauucaaagaagaauauaaaguacauuggagauuucacaaauaaauguggcuuuuguacauguggagagcuagaagaccaggaaggcuuaaaaauacauaaaguaagcagaaagugcauauauaaauaucagcucaccugguccaaaauaaucaugauaauauuagugugucuacugauugcccaaaacaccaucuuaauaguugcagcaucagacgauugcuggacaaagaaaucucuggagauggaauguguaggcccuuuacagcaaguggacacaugugaagacaaaacaagcaggucuuauaguggagaagcaaaaaaacuagugagggcaucaaaaauaucagauuuggaugcagcacagguggggcuguuaggauccacaauagaaucagcaauagcaagcauaagaaagcaaagaacauauucaacuaugcaucuucuugaaucagucuucuuggggaaacauugugauuacuauaaaguuuuugagcacaacaguggcuauucucaagcaaaguggagguuaacagcuaaaacacaucauuuugauauuugcucaagacauagcacccaccauuuuuguagaugcauuucagauggaacuaagugucaaaauggagauugggauuuugcaggugaaaugaacucaacauaccaaucaaagagagacuuuuuugagcaugacuuuaaacuguucuguacccuuauagaaaaugcuuuuccaggcacaacagagucacuguuuuaugaaaugcuaucaaagaaaaacacaacugguauuacaaaauuauuagauaaauuaacaaagaaauuuggaaauaacaauauguucguaggaauauggaaauuugggcaauaucuaaugucauugccauaugucaaugaaacaucauuauccccuacucaacuugcuaaaguacuagagguuacagaucaucuucaccgauccauaucuggaaggcaagaguuacugacuagugcuaccccugggaguaaguccagugagugugaccaugcaaagaagguuucuugcauaagcccuagguuugguguaccaauggaaggauuaauagcauguggaaacucaccaaguuacaaaauuuauaagacaccaacaaagcuuuacaaaucaaacaacaagggagaagugugguguucaggugauguccacuguuuccaagaacuaaucccugccucacaagaaucuguugacaggauaaaacaaaugacuugcuuuuuaacugaaccugaaguaagugaugacguuuuuuccauugcaauaucuaugugcaaaguccaggacaagggaguaugcacaauaaaugaagauagguggaauguaauaaaaugugauaguggccugauauauuauacugaccagagagaagggcaagauacaggcaaugauuuaggggaguauuguuugucucacaguuguagaauagaaagguucccaauaaacccaauaauaauuagugauuguuuaugggaauaucauucacgaaaaucaaaguauauuaccaguuuagaccuagaaagcuuggaagaauuuaaaagggcuaucucugaaaaauugucacauacucuuauagucuauaauuuuaaaccaacagccaaucuuccucauauaaagccaguauacaaguauaucacaguucaagggguugaaaauucugaugggguagauucagcauauauaacugcuagcaugccagcuuuaagugggacaagcauagguuauaauauaauguccagagacaacuuuccacuauuugauauaauuauauucauaaaaagugccauuauuaaggcgacauauaaucacauauaugacacagguccuacuauagggauuaauguaaugcacgaugaacauuguacaggacaaugcccuacagacauaccgcauaaggaaaauuggaucacauucgcccaagagaggacuagucguuggggaugugaagaauucgggugucuugcuguuaauacuggcugcguuuuuggcucuugucaagauauaauaaggccagaaacaaagguuuauaggaaagcaguugaagagaguguauuauugacaguuuguauaacuuacccugguaaaacauuuugcacagaaauaaaugccauagagccuaaaauuacagacgaauuagaauugcaguuuaaaacaguggauacaaaaacacuacccaacauuuuagcuguccaaaaccauaaauuauauaguggacaaauuaaugacuuaggaucauucucacaagguugugguaacauacagaaaaccaauucauccaucauaggcacaggcacugcaaaguuugauuaugugugucauggugcuucuagaaaagauaucguugugaggagaugcuauaauaacaacuaugagucaugcaaauuauugaaggaggagcaauccuuaauguuugcagauaaucaugaaacaauugauguagccaaugucagacaucuucuuggggaccuacaguucaaauuaaugcugggagaucuaagguacaaaucauuugcagaaaauccagauuuggaaauagaagcaaaguguguugggugcccaucauguuucacuagcuauucuugcaguuuuaagauuguuucaaauauugauacuguaugcucaauugaagggccuuguacaacuuuccauaacagauugaugaucaccuccacaaaacaagauuauggcauuaagaugagcugcaagacaaagccagggccuacagaggaauuccagauuugcaagaaaacuuacacaauacuguuuacaacaguugaaaagaaugauaaaauugaaauaagcacaggggaccaaacaucuuuuauccaagaaaaagaugauagaugcaaaacaugguuauguaggguuagggaugaggggaucaguguuauuuucgaaccaauaagagcuuucuuuggaagcuacuuuaguauagcuuuuuauauaguaauugguaucauuguccuguuucuaguaaucuacauuuuuuugccuaugauuuuuaaacuuagggauguauuaaaaagaaaugaauacuuguaccuacaagagauaaaacauaaguaa

SEQ ID NO: 4145 - RNA, 4305 nt, Artificial Sequence
  derived and/or modified CDS sequence (wt) from BATV(ON-7/B/01)__AB257765.1__GP
auguugcuacuucuugucuuauuaauccccugcuguguaucagccucuccuguaauaacaagauguuuucauggagggcagcugauagcagaaaggaagucccaagcggcuauaucagaauuuugccucaaggaugaugucucuacuaucaaaucagaaauaauauaugaaaaaaaugacacugguuuauuugcacauaauaaagucuuacgaaauuggauuauaaaggacuggaaaaacugcaauccuguccccacagcagggggcaguauaaauguuauagaagucaauacagauuugagcuugaccacaaaaacauauguguguagcagggauugcacaauuacaguugauaaagaagaugcucaaauaauuuuccaaacugaaaaacugaaucauuuugaaguuucugggacuacauugagcucagguugguucaaaaccaaagcaucaguaacauuggauaggaccugcgaacacauuaaaguaacaugugggaaaaagacccuacaauuccaugccuguuucaagcaccacaugucauguauuagauuuuuucauggcacuauccuuccugggacaauggccaccucuaucugucagaauauagaacucauaauuauaauaagucugacauugauuauuuuuaucuuaaugguaauacugaccaaaacuuacauauguuaucuauuaaugccacuauuuaugccaaucgcauacuucuaugguuggucauauaacaaaaguuguaaaaaauguccauguuguggcuuagcauaucacccuuuuacaaauuguggaucacauugugugugcggauugaaauuugaggcaucagauaggaugaggauacauagagaaucaggauugugucaaggcuacaaaagcuuacguguugcuagguugcuauguaaaucaaaagguucaucccucauaaucucaauauuauuaucuauguugauacuaagcuuuguuacaccaauagaggggacauuaacuaauuauccagaaucaaggaaauacgaccuagaggaaauugcugaugucuuagaaggauucauuguggaaaaaggaauaaaagaauauguggucuuuuauacuucuauuuucggagcuuuauuuuuauuaauagcacugauugucauaauagcacuaaacagaguuacagaauaucucacaaacaucaauguuuuauacugucaugaauguucaauguaucauucaaagaagaauauaaaauauauuggagauuucacaaauaaauguggcuuuuguacauguggagagcucgaagaucaagagggcuuaaaaauacauaaagugaguaggaagugcauauauaaauaucagcuuaccugguccaaaguaauuaugaugauauuaguguguuuacugauugcucaaaacacuauucugauaguugcagcaucggaugauugcuggacuaaaaagucuuuagagaugggauguauaggcccuuuacagcaaguggacacaugugaugacaaagcaagcaggucauacaguggggaggcaaaaaaacuagugagggcaucaaaaauaucagauuuggaugcagcacagguggggcaguugggauccacaauagaaucagcaauagcaagcauaagaaggcagagaacauauucaacuaugcaucuucuugaaucaguuuuccuggggaagcauugugauuacuauaagguuuuugagcauaacaguggcuacucucaggcaaaauggagguuaacagcuaaaacacaucauuuugacauuuguucaagacacagcacccaucacuucuguagaugcaucucagauggaaccaaaugucaaaauggagauugggacuuugcaggugaaaugaacucaacauaccagucaaagagagacuuuuuugagcaugacuucaaccuguucugcacucuuauagaaaaugccuucccaggcacaacagagucucucuucuaugaaaugcuaucaaagaaaaacacaacugguaucacaaaacuauuagauaaauuaacaaaaaaauuugggaacaacaauauguucguaggaauauggaaguuugggcaauaucuaauaucacuaccauaugucaaugaaacaucauugucuccuacucaacuugcaaaaguauuagugguuacagaucaacaucacagguccauuucuggaaggcaagagucgcuggcuagugcuacuccugggaguaaguccagugaauguggccaugcaaaaaagguuucuugcauaagccccagguuugguguuccaauggaaggauuaauggcaugugggagcucaccaaauuauaaaauuuauaagacaccagcaaagcuuuacaaaucaaauaacaagggagaagugugguguucaggugauguucacuguuuucaagaucuuaucccugccucacaagaaucuguugacaggauaaaacaaaugacuugcuuuuugaccgaaccugaaguaaaugaugacguuuuuucuauugcaauagcuaugugcaaaguccaagacaaaggaguauguacaauaaaugaagauagguggaacuuaauaaaaugugauaguggccugauauauuauacugaccagagggaggggcaagacacaggcaaugauuuuggggaguauuguuuaucccacaacuguaaaauggaaagauucccaauaaauccggcaauaauuagugauugucuaugggaauaucauucacgaaaaucaaaguauauaacuaguuuagacuuagaaagcuuagaagaguuuaaaagagccauuucugaaaaauugucgcauacucucguaguguauaauuuuaaaccaacagcaaaucuuccucauauaaagccaguauacaaguauaucacaguacaaggaguugaaaauucugauggaguagauucagcauauauaacugcuaguaugccagcuuugagugggacaagcauaggcuauaacauaauguccagggauaacuucccacuauucgauauaauuauauuuauaaaaagugccauuauuaaagcaacuuacaaucauauauaugacacagguccuacuauagggauuaauguaaugcaugaugaacauuguacaggacaaugcccgacagauauaccgcacaaagagaauuggaucacguuugcccaagagagaacuagucgcugggggugugaagaauuugggugucuugcugucaacaccggcuguguuuuuggcucuugucaagauauaauaaggccagaaacaaagguuuauagaaaagcaguugaggagagugucuuauuaacaguuuguauaacuuacccuggcaaaacauuuugcacagaaauaaaugccauagagccuaaaauuacagacgaauuagaguuacaguuuaaaacagucgauacaaaaacacugcccaacaucuuagcuguccaaaaccacaaauuauauaguggacagauuaacgauuugggaucauucucccagggcuguggcaacauacagaaaaccaaucuaucuaucauaggaacaggcacugcaaaguuugauuaugugugccauggugccucuaggaaagauaucauuguaagaagaugcuacaauaacaauuaugagucauguaaauuauugaaagaggaacaauccuuaauguuugcagauaaucaugaaacaaucgauguagccaaugucagacaucuccuuggggaucugcaguuuaaauuaaugcugggagaucuaagguacaaaucauuugcagaaaauccggauuuagaaauagaagcaaaguguguuggaugcccaucauguuuuacuaguuacuccugcaauuucaaaauuguuucaaauauugauacugugugcucaauugaagggccuuguacaacuuuucauaacagauuaaugaucacuuccgcuaaacaagauuauggcauuaaaaugagcuguaagacaaagccaggacugacagaagaguuccagauuuguaagaaaacuuauacaguacuguuugcaacagucgaaaagaaugaugaaauugaaauaagcacaggagaucaaacaucuuuuauccaagaaagagaugauagaugcaaaacaugguuauguaggguuagagaugaaggcaucaguguuauuuuugaaccgauaagggcuuucuuuggaagcuacuuuaguauagcuuuuuauauaguaauuggcaucauuguucuguuccuaguaauuuacauuuucuugcccaugguguuuaaacuuagagauguguuaaaaagaaaugaauaccuguaucuacaagaaauaaaacauaaguaa

SEQ ID NO: 4146 - RNA, 4305 nt, Artificial Sequence
  derived and/or modified CDS sequence (wt) from BATV(UgMP-6830)__DQ436460.1__GP
auguugcuacuucuugucuuauuaauccccugcuauguaucagccucuccuguaguaacaagaugcuuccauggagggcaauugauagcagagaagaaaucccaaacagcuguaucagaauuuugccugaaagaugaugucucuacuauuaagucagaaauaacauaugagaagaacaacacuggcuuauuugcacauaacaaaguuuuacgaaacuggaucauaaaagacuggaaaaauuguaacccuguucccacagcagggggcagcauaaauguuauagaagucaauacggauuugagcuugaccacaaaaacauauguguguagcagagauugcacaauuacaguugauaaagaagaugcucagauaauuuuccaaacugagaaguugaaccauuuugaggucucugggacuacauugagcucaggcugguuuaagaccaaggcaucaguaacauuagauaggacuugugaacauauuaaaguaacaugugggaaaaagaccuuacaauuccaugccuguuuuaagcaccacaugucuuguauuagauucuuucauggcacuauucuuccuggaacaauggcuacuuccaucugucaaaauauagaacucauaauuauaauaagucugacauuaauuaucuuuauccugaugguaauauugaccaaaaccuacauaugcuaucuacugaugccacuauuuaugccaauugcauacuuuuaugguuggucauauaacaaaagcuguaaaaaaugcucauguuguggccuagcuuaucaccccuuuacaaauuguggaucacacuguguaugcgggcuaaaauuugaagcaucagauaggaugagaauacacagagaaucaggauuaugucaaggcuacaaaagucuacguguggcuagguuguugugcaaaucaaaagguucaucucuuauaaucucaauauuauuaucuauguugauacuaagcuuuguuacaccaauagaggggacauuaacuaauuacccagaaucaaggaaguaugaucuggaggaaauugcugauguccuagaaggauucauuguagaaaaagggauaaaagaauacguagucuuuuauacuucuauuuuuggggcuuuauucuuacuaauggcauuaguuaucauaauagcacuaaacaagguuacagaguaucuuacaaacaucaauguuuuauacugucaugaauguucaauguaucacucaaagaaaaauauaaaauauauuggggauuuuacaaauaaauguggcuuuugcacauguggagaguuggaagaucaagaagguuuaaaaauacauaaaguuagcagaaagugcauauauaaauaucaacucaccugguccaaaauaaucaugaugauauuaguguguuuacugauugcucaaaacaccauccuaauagucgcagcaucagaugauugcuggacaaaaaaaucuuuagagauggaauguauaggcccuuuacagcaaguggauacaugcgaugauaaaucaagcaggucuuacaguggggaggcaaaaaagcuagugagagcaucuaaaauaucagauuugaaugcagcacagguggggcuauugggaucuacgauagaaucagcaauagcaagcauaagaaagcagagaacauauucaaccaugcaucuccuugaaucaguauuccugggaaagcauugugauuacuauaaagcuuucgaacauaacaguggcuacucucaggcaaaguggagguuaacagcuaaaacacaucauuuugauauuugcucaagacauaguacucaucauuucuguagaugcaucucagaugggacaaagugccaaaauggggauugggauuuugcaggugaaaugaacucaacauaccagucgaaaaaagacuuuuuugagcaugaccucaagcuguucugcacucuuguagaaaaugcuuuuccaggcacaacagagucacucuuuuaugaaauguuaucuaagaaaaacacaacuggugucaaaaagcuauuagauaaacuaacaaaaaaauuuggaaauaacaauauguucguaggaauauggaaauuugggcaauaucuaaugucacugccauaugucaaugaaacaucauuaaccccugcucaacuugcuaaaauauuggagguuacagaucagcaccaucggucuauaucuggaaggcaagagucauuggcuagugcuaccccugggaguaaguccaaggaguguggucaugcaaaaaaggucucuuguauaagcccuagguuugguguuccgauggaaggauuauuggcauguggggacucaccaaauuacaaaauuuauaaaacaccagcaaagcuuuauaaaucaaacaacaagggggaagugugguguucaggugacguucauuguucccaggagcuaagcccagcaucacaagaaucuguugacaggauaaaacaaauuacuugcuuuuugacggaaccugaaguaagugaugacguuuuuucaauugcaauauccacgugcaaaguucaagauaagggaguauguacaguaaaugaagauagauggaacguaauaaaaugugauagugggcugauauauuacacugaccagagagaugggcaggauacaggcaaugauuucggagaguauuguuugucccauagcugcagaauagaaagguuucccauaaacccggcaauaaucagugauuguuuaugggaguaccauucccgaaaauccaaguacaucaccagcuuggaccuggaaagucuagaagaauuuaaaagagcuauuucugaaaaauugucacauacucuuauaguguauaauuucaaaccaacagcuaaucuuccucauauaaagccgauauacaaauauaucacagugcaagggguggagaauucugauggaguggauucagcauauauaacugcuaguaugccagcuuuaagcggaacaaguauaggauauaauauaaugucuagagauaacuuuccauuauuugauauaaucauauuuauaaagagcgccauuauuaaggcaacuuacaaucauauauaugacacaggccccacuauaggaaucaauguaaugcaugaugaacauugcacagggcaaugcccaacagacauaccacacaaagaaaauuggauuacauuugcucaagagagaacuagucguuggggaugcgaagaauuugggugccuugcuguaaauacaggcugugucuuugguucuugucaggauauaauaaggccagaaacaaagguguauagaaaggcaguugaggagagugucuuauuaacaguauguauaacuuacccugguaaaacauucugcacggaaauaaaugcuauagaaccuaaaaucacagaugaauuagaauuacaguucaaaacaguugauacaaaaacauuacccaauaucuuagcuguccaaaaccauaagcuauauaguggacaaauuaaugauuugggaucauuuucacaagguugugggaacauacagaaaaccaauucauccauuauaggaacagguacugcaaaguuugauuaugugugucacggugcuuccagaaaagauaucauuguaagaagauguuacaauaauaacuaugagucaugcaaauuguugaaggaggaacaaucuuuaauguucgcagauaaccaugaaacuauugacguagcuaaugucagacaucuccuuggagaucugcaguuuaaauugauguugggagaucugagguacaagucauuugcagaaaacccagauuuggaaauagaggcaaaguguguuggaugcccaucauguuuuacuaguuacuccugcagcuucaagauuguuucaaauauugacacuguaugcucaauugaagggccuuguacaacuuuucauaauagguugaugaucaccucuacaaaacaagauuauggcaucaaaaugagcuguaagacaaagccagaagaaacagaagaguuucagauuugcaagaaaacuuacacaguauuguuuacaacaguugagaaaaaugauaaaaucgaaauaagcacaggggaucaaacauccuuuauccaagagagggaugauagaugcaaaacaugguuaugcagaguuagagaugaagggaucaguguuauuuuugagccaauaagggcuuucuuuggaagcuacuuuaguauagcuuuuuauguaguggucaguauuauuguccuauuucuagcaaucuacaucuucuuaccuaugguguucaaacucagagauguguuaaaaaagaaugaauaucuauacuugcaggaaauaaagcauaaguaa

SEQ ID NO: 4147 - RNA, 4305 nt, Artificial Sequence
  derived and/or modified CDS sequence (wt) from BATV(ZJ2014)__KU746870.1__GP
auguugguacuucuugucuuauuaaucccuugcuguguaucagccucuccugcaauaacaagauguuuucauggagggcaacugauagcagagaggaagucccaaacagcuauaucagaauuuugccuuaaggaugaugucucuacuauuaagucagaaauaauauaugaaaaaaaugacacugguuuauuugcgcauaauaagguuuuacgaaauuggaucauaaaggacuggaaaaauugcaauccuguucccacagcagggggcaguauaaauguuauagaagucaauacagauuugagcuugacuacaaaaacauauguguguagcagagauugcacaaucacaguugauaaagaagaugcucaaauaauuuuccaaacugaaaaauugaaucauuuugagguuucugggaccacauugagcucagguugguucaaaaccaaagcaucaguaacauuagauagaaccugcgaacacauuaaagugacaugugggaagaagacccuacaguuccaugccuguuucaagcaccacaugucguguauuagauuuuuucauggcacuauccuuccuggaacaauggcuacuucuaucugucagaauauagaacucauaauuauaauaagucugacauugauuauuuuuaucuuaauggugauauugaccagaaccuacauauguuaucuauuaaugccacuauuuaugccaaucgcauacuuuuaugguuggucauauaacaaaaguugcaaaaaaugucaauguuguggccuagcauaucauccuuuuacaaauuguggaucacauugugugugcggauugaaauuugaggcaucagauaggaugaggauacauagagaaucaggauugugucaaggcuacaaaagcuuacguguagcuagguugcuguguaaaucaaaggguucaucccucauaaucucaauauuauuaucuauguugauacugagcuuuguuacaccaauagaggggacauuaacuaauuacccagaaucaagaaaauacgaccuggaggaaauugcugaugucuuagaaggauucguuguggaaaaaggaauaaaagaauauguagucuuuuauacuucuauuuucggagcuuuauucuuauuaauggcauugauugucauaauagcacuaaacagaguuacagaauaucucacaaacaucaauguuuucuacugccaugaauguucaauguaucacucaaagaagaauauaaaguauauuggagauuucacaaacaaauguggcuuuuguacauguggggaacuagaagaucaagagggcuuaaaaauacauaaaguaagcagaaagugcauauauaaauaucagcucaccugguccaaaauaauuaugaugauauuaguguguuuacuaauugcucaaaacacuauccuaauaguugcagcaucagacgacugcuggacaaaaaagucuuuagagaugggauguauaggcccuuuacagcaaguggauacaugcgacgacaaaacaagcaggucuuacaguggggaagcaaaaaaacuagugagggcaucaaaaauaucggauuuggaugcagcacagguggggcuguuaggauccacaauagaaucagcaauagcaagcauaagaaagcaaagaacguauucaacuaugcaucuucuugaaucaguauuccuggggaaguauugugauuacuauaagguuuuugagcauaacaguggcuacucucaggcaaaauggagguugacagcuaaaacacaucauuuugauauuugcucaagacauagcacccaucauuucuguagaugcaucucagauggaacuaaaugucaaaauggagauugggauuuugcaagugaaaugaacucaacauaccaaucaaagagggacuuuuuugaacaugacuuuaaaguguucugcacucuuauagaaaaugcuuucccagguacaacagagucacucuuuuaugaaaugcuaucaaagaaaaacacaacugguaucacaaaacuauuagauaaauuaacaaaaaaauucgggaacaauaauauguucguaggaauauggaaauuugggcaauaucuaaugucacugccauacgucaaugaaacaucauuaucuccuacucaacuugcuaaaguauuagagguuacagaucaucaucaccggucuauaucuggaaggcaagagucacuggcuagugcugccccugggaguaaguccagugagugugaccaugcaaagaagguuucuugcauaaguccuagguuugguguuccaauugaaggauuaacugcuugugggagcucaccaaauuacaaaauuuauaagacaccagcaaagcuuuacaaaucaaacagcaagggcgaagugugguguucaggugauguccacugucuucaagagcuaauccccgccucacaggaaucuguugacaggauaaaacaaaugacuugcuuuuugacugagccuggagugaaugaugauauuuuuucuauugcaauaucuaugugcaaaguccaagacaaagggguaugcacaauaaaugaagauagguggaacguaguaaaaugugauaguggccugauauauuauacugaccagagagaagggcaagacacaggcaaugauuucggagaauauuguuuaucucacagcuguagaauaaaaagguucccaauaaauccggcaauaauuaaugauuguuuaugggaauaucauucacgaaaaucaaaguauauuaccagcuuagaccuagaaagcuuagaagaauuuaaaagagcgauuucugagaaauugucacauacucuuauaguauauaauuuuaagccgacagccaaucuuccucauauaaagccgguauacaaguauaucacagugcaagggguugaaaauuccgaugggguagauucagcauauauaacugcuaguaugccagcuuuaagugggacaagcauagguuauaacauaaugucuagggauaacuucccacuauuugauauaauuauauucauaaaaagugccauuauuaaggcaacuuauaaucacauauaugacacagguccuacuauagggaucaauguaauucaugaugaacauuguacaggacaaugcccaacagacauaccacauaaagaaaauuggauuacauuugcccaagagagaacuagucguuggggaugugaagaauuugggugucuugcuaucaacacuggcuguguuuuuggcucuugucaagauauaauaaggccagaaacaaagguuuauagaaaagcaguugaggagagugucuuauuaacaguuuguauaacuuauccugguaaaacauuuugcacagaaauaaaugccauagagccuaaaauuacagacgaauuagaauugcaguucaaaacaguugauacaaaaacacugcccaacaucuuagcuguccaaaaccauaaauuauauaguggacagauuaaugacuuaggaucauucucacaaggcugugguaauauacagaagaccaauucauccaucauaggcacaggcacugcaaaguuugauuaugugugucauggcgccucuagaaaagauaucauuguaaggagaugcuacaauaauaauuaugagucauguaaauuauugaaggaggaacaauccuuaauguuugcggauaaucaugaaacaaucgauguagccaauguuagacaucuucuuggggaucugcaguuuaaauuaauguugggagaucuaagguacaaaucauuugcugaaaacccagauuuggaaaucgaagcaaaauguguugggugcccaucauguuuuacuaguuauuccugcaguuucaagauuguuucaaauauugauacugugugcucaauugaugggccuuguacaauuuuucauaacagauugaugaucaccucuacaaaacaagauuauggcauuaaaaugagcuguaagacaaagccagggccgacagaggaguuccagauuugcaagaaaacuuacacaauacuauuuacaacaauugaaaagaaugauaaaaucgaaauaagcacaggggaucaaacaucuuuuauccaagaaagagaugauagaugcagaacaugguuauguaggguuagggaugaagggaucaguguuauuuucgaaccaauaagagcuuucuuuggaagcuacuuuaguauagcuuuuuauauaguaauugguaucauuauccuauuucuaguaaucuacauuuucuugccuaugguguuuaaacuuagagauguauugaaaagaaaugaauaccuguaccuacaggaaauaaaacauaaguaa

SEQ ID NO: 4148 - RNA, 4305 nt, Artificial Sequence
  derived and/or modified CDS sequence (wt) from CVV__AF082576.1__GP
augcuauuccugcucauacuagccuuuuuaggguucucaacaagcaacccuauugcaacuagguguuuccaugggggccaauuaauagcagagucaaagucugcuacaucuauaucagaauucugccucaaggaugaugucucaauguuaaaaucugaagugguauacauaaagaaugauacuggauuauuuggucauaauaaaguuuuuagaagcuggacaauaaaagauuggaaacucugcaacccuauaccuacugcaggaggaacaauaaauguaauugagguuaacaaagaucuuagucuaaugacaaagacauacauauguaguagagauugcacuauaaccauagauaaagaggaagcucagauuaucuuccaaacagauaagcuaaaucauuuugaagugucuggcacuacauuaaguucaggaugguuuaaaagcaaggcgucugucacccuggauagaaccugugagcauguuaagguuacuuguggaaagaaaucucugcaauuccaugcauguuuuaaacaccacaugucauguguuagguucuuccacaauaccauauuaccuggcaauaugauaaccucaaugugccagaauauagaauuaauaauuaucuuagggcuaacauuagccauauucauauuaaugguuaugcuuacaaaaacuuauauauguuauuuacugaugccaauuuucaugccgauagcuuaucuuuaugguugggccuacaauaagagcugcaaaaagugcaacuguugugguuuagcauaccauccauuuacuaauugugggucacauuguguuuguggcuugaaauuugaggcaucagauaggaugagaauccauagagaaucuggcuugugucaaggguacaagaguuuacgaauugccagacuuuuguguaaaucuaaagggucaucuuuaguuauaucuggauuauuguccauguuaaucuuaagcuucguaacgccuauagaggggacuauaacuagcuacccagagagcagaaaauauacacuggaagagauaacagauguuguugaaggacugguaucugagcagaauauaaaggaguauauuguuuucuauaccucauuguuuggaaguuuaauacuauuauuagcauuuauaaugucuauaacuuuaagcaaaauaacaagcauauuagcaaaaagaaauguuauuuauugcgaagaaugcucaauguaucauucaaaaagaggcauaaaguacaauggugacuucacaaacaaaugcggcuuuugcacaugcaaugaacaagaggauacagaaggauuaguaauacauaaaguuaguaagagaugcacauauaaauaccagcuaaagugggcuaaagugcugaugauuacacuagucuugcuucuaauagcgcaaaacacuauucuaauuguugcagcugaaacagauugcuggacaaaaaaaagccuagauauagacuguauaggaccaaugcuagauauaggcucuugcacaaauaagaauaccagaagcuaugaugcagaagcacagaaauuggugagccagucuaaaauaagucaacuagaugcagaccaagcaucguuguuaggcaacucuauagauagugcuauuaaggcaaucagagcccagaaaacuuacccuacaaugcacuuguuggaaacaauauucuuaaugaaaaauugcgauuauuacacgaguuucaaccauaacaguggcuauucacaagccaaauggcgauugauugcaaaaacaggacacuuugacauaugcuccagacauagcacccaccauuucugccaauguauaaaugauggaaccaaaugucagaauggugauugggauuucgcuggugaaaugaaugaaacuuacaauagcaaaaaugauuuuuauucacaugaucugaauuuguuuuacacaauuuuugaaaaugcauucccaggaacaacugaauccuuauuuuaucaauugauccaaaagaaaaauacuacaggggccuccaaagucuuggggaaguuaauaacuaaauaugguaauaauaacauguucguuggaaucuggaaauuuggacaguacuuacuuacauuaccauauauaaauaauacugaauugagccagaauaggagacuaacaauccuggcaacacaagaacuauuaaguaggucgcacucuggcaggcaggagucuauguccaaugcaauucagggcaguauuacaaaagaaugccauaaugcaaaagguguugggugcauaaguccucaguuugguauuccaauugguaaccuuacagcauguggugacucaccuaauuauaaaauauauaagacuccagaaaaauuguauaaaucaaauaauaaaggggaaguuugguguucaaaugauguucacugccugaaugauuuugagccugcagaugaagaaguugucaauaaaauuaagaaacucacuugcuucuuaacagacgucucaguugaaguagacaucuuuucaguggcugcauccacauguaagauggcagacaaaggcgucuguacaguaaauggugcuaaauggaauauaaucaagugugauaguggauuauacuauuuuacagaccauagagaaggccaggacacaggcaaugacuuuggugaguauuguauaucucacaguugcaauacugagcgauucccuaucaacccagacacauuaaaagauuguacuugggaguuccauuccagaaagucuaaauauauuucaaccaucaguuuagaaucauuggaagaauucaggagggcaauggcagaaaaguuaucacacacccuaacaauuuacaauuuuaaaccaacagcuaaccuuccucauauuaggccaaccuacaaauucauuacagccaauggugucgaaaacucugacgguauugaaucagcauacaucuugucuagcaucccugcauuagguggaauuaguguugguuauaauguucaaaccaaagacaacuucccauuguuggauauaauuguauuuauuaaaagcgcagucaucaggacaacauacaaucauauuuaugauaccgggccuacuauagguauaaacacacaacaugaugagcacuguacagggccgugcccagcuguggugccacauaaagagaacuggaugacauuuucucaggaaagaacaaguagauggggaugugaagaauuugguugcuuggccaucaacacaggguguguuuuugguucuugccaagauauaauacauccagaaacuaaaguauaccgcaaagcaguagaagaggaaguugucuuaacggugugcaucaauuuuccaggcaauaauuacugcacugaaauaaaugccauugagccuaagauaacagaugagauagagcuccaguucaaaacagucgauacaaaaaccuuacccaaccuucuugcagugcagaaucacaagcuuuacaguggccagauaaacgauuugggcucuuuuucacaagguuguggaaauguccaaaaaacaaaucacucaauccuaggcauggguacagucaaauuugauuaugucugccacggcgcuaguaggaaagaugugauagucaggaggugcuacaacaauaauuuugauucaugcaaauuacugaaagaagaaacaucauuaauauuugcagauaaucaugagacucuagagguagcacacacaaagcaucugauaggugaauuacaguuuaagauaauguuaggagauauaagauacaaaucauuugcugaaucaccugaguuggaaauugaugcaaaaugugucggguguccaucauguuuugaaagcuacuccugcaacuuucaaauagugucaaauauagacacugugugcucagucgaagggccaugcacacuauuucauaaucgaauuauuauaucagcuaacaaacagucauaugggcuuaaaaugaguugccaaacaaagccuaaccaaaaugaagaguucauuaucuguaacaggaaauacagugucuuauucacaacaauugauaaaaaugacaaaauagaagugaacacaggggaccagacuucauauauuuaugaaaaggacagcagauguaagacuugguugugcaggguuagagaugaggggaucaguguccuauuugaaccauugaaagcauucuuugggagcuauuuuagcauaauauuuuauguuguuguuggaauuauuguccuuuucuugauuauauacauauuuuugccaauguucuucaaacuaaaagauguuuugaaaagaaaugaauauuuguaucuucaggaacugaaacauaaauga

SEQ ID NO: 4149 - RNA, 4305 nt, Artificial Sequence
  derived and/or modified CDS sequence (wt) from CVV(Montgomery County/VA/2015 4b)__KX583998.1__GP
augcuauucuugcucauacuagccuuuuuaggguucucaacgagcaacccuauugcgacuagguguuuccaugggggccaauuaauagcagagucaaagucugcuacaucuauaucagaauucugccucaaggaugacgucucaauguuaaaaucugaagugguauauacaaagaaugauacugggcuauuuggucauaauaaaguuuuuagaagcuggacaauaaaagauuggaaacucugcaauccuauaccuacugcaggaggaacaauaaauguaauugaggucaauaaagaucuuagucuaaugacaaagacauacauauguaguagagauugcaccauaacuauagauaaagaggaagcucagauuaucuuccaaacagauaaguuaaaucauuuugaagugucugguaccacauuaaauucaggaugguucaaaagcaaagcaucuguuacccuggauagaaccugugaacauguuaagguuacuuguggaaaaaagucucugcaauuccaugcaugcuuuaagcaccacaugucauguguuagguucuuccacaauaccauauuaccuggcaauaugauaaacucuaugugccagaauauagaauuaauaauuaucuuagggcuaacauuagcuauauuuauauuaaugguuaugcuuacaaagacuuauauauguuacuuauugaugccaauuuucaugccaauagcuuaucuuuaugguugggcauauaacaaaagcugcaaaaaguguaacugcuguggucuagcauaucauccauuuacuaauuguggcucacacuguguuuguggcuuaaaauuugaggcaucagauaggaugaggauccauagagaaucuggcuuaugucaaggguacaagaguuuacgaauugccaggcuuuuguguaaaucuaaagggucaucucuaguuauaucuggauuauuauccauguuaaucuuaagcuuuguaacgccuauagagggaacuauaacuagcuacccagaaagcaggaaauauacacuggaagagauaacagauguuguugaaggauuaguaucugagcagaauauaaaggaguacauuguuuucuacaccucauuguuuggaaguuuaauauuguuacuagcauuuauaauguccauaacuuuaagcaaaauaacaagcauacuagcaagaagaaauguuauuuauugugaagaaugcucaauguaucauucaaaaagaggcauaaaguauaacggugacuuuacaaacaaaugcggcuuuugcacaugcaaugaacaggaggaugcagaaggguugguaauacauaaaguuaguaagagaugcacauauaaauaucaacuaaagugggcuaaagugcugauggucacacuggucuugcuucuaauagcacaaaacacuauucuaauuguugcagcuggaacagauugcugggcaaaaaaaagccuagauauggacuguauagggccaauguuagacauaggcucuugcacaaauaagaauaccagaaacuaugauacagaagcacagaaauuggugagccaaucuaaaguaagucaacuagaugcagaccaggcaucauuauugggcaacucuauagauagugcuauuaaagcaauaagagcccagaaaacuuauccuacaaugcacuuauuggaaacaauauucuuaaugaagaauugugauuauuacacaaguuuuaaccauaauaguggcuauucacaagcuaaauggcgauuaauugcaaaaacagggcacuuugauauauguucuaggcauagcacccaccacuuuugccgauguauaaaugaugggaccaaaugucagaauggugauugggauuuugcuggugaaaugaaugaaacuuauaauagcaaaaaugauuuuuauucacaugaucugaacuuguuuuacacaauuuuugaaaaugcauucccagggacuacugaauccuuauuuuaccaguuaauccagaagaaaaauacuacaggagccuccaaaaucuugggaaaguuaauaaccaaguaugguaauaauaacauguuuguuggagucuggaaauuuggacaguacuuacuuacauugccauauauaaauaauacugaauugagccagaauaggaggcaaacaaucuuggcaacacaagaaucauuaaguagaucacacucuggcaggcaagagucuauguccagugcaauucagggcaguguuacaaaagaaugccacaaugcaaaggauguugggugcauaagcccucgguuuggcauuccaauuggcaaccucacagcauguggcgacucaccuaauuauaagauauauaaaacuccagaaaaguuguauaaaucaaauaauaaaggggaaguuugguguucgaaugauguucacugccugaaugauuuugagccugcagaugaagaaguugucaauaaaguuaaaaaacucacuuguuucuuaacagacgucucagucaaaacagacaucuuuucaguagcuguaucuacauguaagauggcagauaaaggcacuuguacagugaaggaugcuaaauggaauauaaucaagugugauaguggauuauacuauuuuacagaccauagagaaggucaagacacaggcaaugauuuuggugaguauuguauaucucacaguugcaacacugagcgauucccuauuaacccagacauauuaaaagauugcacuugggaguuccauuccaggaagucuaaauauauuucaaccauuaguuuagaaucauuggaagaauucaggagagcaaugacagagaaguuaucacacacccuaacaauuuacaauuuuaaaccaacagcuaaccucccucauauuaggccaacuuauaaauucaucacagcaaauggugucgaaaacucugaugguauugaaucggcauauaucuuaucuaguaucccugcauuaggugggauuaguguugguuauaauguucaaaccaaagacaauuucccauuauuggauauaauuguauuuauuaaaagugcagucaucaggacaacauacaaccauauuuaugauacugggccuacuauaggcauaaacacacaacaugaugagcacugcacaggaccaugcccggcuguggugccacauaaagaaaacuggauaacauucucucaggaaagaacaagcagaugggggugugaagaguuugguugcuuggccaucaacacaggguguguuuuugguucuugccaagauauaauacauccagaaaccaaaguauaccguaaagcaguagaagaagaaguugucuuaacagugugcauuaauuucccagguaauaauuacugcacagagauaaaugccguugagcccaagauaacagaugagauagagcuccaguucaaaacaguugauacaaaaaccuugcccaaccuucuugcagugcaaaaucgcaaacuuuacaguggccagauaaacgauuugggcucuuuuucacaagguuguggaaauguccaaaaaacaaaucacucaauccuaggcauggguacagccaaauuugauuaugucugucauggugcuaguagaaaagaugugauagucaggaggugcuauaauaauaauuuugauucauguagauuacugaaagaggaaacaucauugauauuugcagauaaucaugagacucuagagguagcacacacaaagcaucugauaggugaauuacaguuuaagauaauguuaggagauauaagauacaaaucauuugcugaaucaccugagcuggaaauugaugcaaaauguguuggguguccaucauguuuugaaaguuauuccugcaacuuccaaauagugacaaacauagacaccguaugcucaguugaagggccaugcacacuauuucauaacagaaucauuauaucagcuaacaagcagucauauggacucaaaaugaguugccaaacaaagccuaaucaaaaugaagaguucauuaucugcaacaggaaauauaguguccuauucacaacaauugauaaaaaugauaaaauagaagugaauacaggggaucagacuucauauauuuaugaaaaggauagcagauguaagacuugguugugcaggguuagagaugaggggaucaguguccuauuugaaccauuaaaggcauucuuuggaaguuacuuuaguauaauauuuuauguugucguuggaauuauuguccuuuuuuugauuauauacauauuuuugccaauguucuucaaacuaaaagauguuuugaaaagaaaugaauauuuguaucuucaagaacugaaacauaaauga

SEQ ID NO: 4150 - RNA, 4305 nt, Artificial Sequence
  derived and/or modified CDS sequence (wt) from CVV(Montgomery County/VA/2015 K)__KX583999.1__GP
augcuauucuugcucauacuagccuuuuuaggguucucaacgagcaacccuauugcgacuagguguuuccaugggggccaauuaauagcagagucaaagucugcuacaucuauaucagaauucugccucaaggaugacgucucaauguuaaaaucugaagugguauauacaaagaaugauacugggcuauuuggucauaauaaaguuuuuagaagcuggacaauaaaagauuggaaacucugcaauccuauaccuacugcaggaggaacaauaaauguaauugaggucaauaaagaucuuagucuaaugacaaagacauacauauguaguagagauugcaccauaacuauagauaaagaggaagcucagauuaucuuccaaacagauaaguuaaaucauuuugaagugucugguaccacauuaaauucaggaugguucaaaagcaaagcaucuguuacccuggauagaaccugugaacauguuaagguuacuuguggaaaaaagucucugcaauuccaugcaugcuuuaagcaccacaugucauguguuagguucuuccacaauaccauauuaccuggcaauaugauaaacucuaugugccagaauauagaauuaauaauuaucuuagggcuaacauuagcuauauuuauauuaaugguuaugcuuacaaagacuuauauauguuacuuauugaugccaauuuucaugccaauagcuuaucuuuaugguugggcauauaacaaaagcugcaaaaaguguaacugcuguggucuagcauaucauccauuuacuaauuguggcucacacuguguuuguggcuuaaaauuugaggcaucagauaggaugaggauccauagagaaucuggcuuaugucaaggguacaagaguuuacgaauugccaggcuuuuguguaaaucuaaagggucaucucuaguuauaucuggauuauuauccauguuaaucuuaagcuuuguaacgccuauagagggaacuauaacuagcuacccagaaagcaggaaauauacacuggaagagauaacagauguuguugaaggauuaguaucugagcagaauauaaaggaguacauuguuuucuacaccucauuguuuggaaguuuaauauuguuacuagcauuuauaauguccauaacuuuaagcaaaauaacaagcauacuagcaagaagaaauguuauuuauugugaagaaugcucaauguaucauucaaaaagaggcauaaaguauaacggugacuuuacaaacaaaugcggcuuuugcacaugcaaugaacaggaggaugcagaaggguugguaauacauaaaguuaguaagagaugcacauauaaauaucaacuaaagugggcuaaagugcugauggucacacuggucuugcuucuaauagcacaaaacacuauucuaauuguugcagcuggaacagauugcugggcaaaaaaaagccuagauauggacuguauagggccaauguuagacauaggcucuugcacaaauaagaauaccagaaacuaugauacagaagcacagaaauuggugagccaaucuaaaguaagucaacuagaugcagaccaggcaucauuauugggcaacucuauagauagugcuauuaaagcaauaagagcccagaaaacuuauccuacaaugcacuuauuggaaacaauauucuuaaugaagaauugugauuauuacacaaguuuuaaccauaauaguggcuauucacaagcuaaauggcgauuaauugcaaaaacagggcacuuugauauauguucuaggcauagcacccaccacuuuugccgauguauaaaugaugggaccaaaugucagaauggugauugggauuuugcuggugaaaugaaugaaacuuauaauagcaaaaaugauuuuuauucacaugaucugaacuuguuuuacacaauuuuugaaaaugcauucccagggacuacugaauccuuauuuuaccaguuaauccagaagaaaaauacuacaggagccuccaaaaucuugggaaaguuaauaaccaaguaugguaauaauaacauguuuguuggagucuggaaauuuggacaguacuuacuuacauugccauauauaaauaauacugaauugagccagaauaggaggcaaacaaucuuggcaacacaagaaucauuaaguagaucacacucuggcaggcaagagucuauguccagugcaauucagggcaguguuacaaaagaaugccacaaugcaaaggauguugggugcauaagcccucgguuuggcauuccaauuggcaaccucacagcauguggcgacucaccuaauuauaagauauauaaaacuccagaaaaguuguauaaaucaaauaauaaaggggaaguuugguguucgaaugauguucacugccugaaugauuuugagccugcagaugaagaaguugucaauaaaguuaaaaaacucacuuguuucuuaacagacgucucagucaaaacagacaucuuuucaguagcugcaucuacauguaagauggcagauaaaggcacuuguacagugaaugaugcuaaauggaauauaaucaagugugauaguggauuauacuauuuuacagaccauagagaaggucaagacacaggcaaugauuuuggugaguauuguauaucucacaguugcaacacugagcgauucccuauuaacccagacauauuaaaagauugcacuugggaguuccauuccaggaagucuaaauauauuucaaccauuaguuuagaaucauuggaagaauucaggagagcaaugacagagaaguuaucacacacccuaacaauuuacaauuuuaaaccaacagcuaaccucccucauauuaggccaacuuauaaauucaucacagcaaauggugucgaaaacucugaugguauugaaucggcauauaucuuaucuaguaucccugcauuaggugggauuaguguugguuauaauguucaaaccaaagacaauuucccauuauuggauauaauuguauuuauuaaaagugcagucaucaggacaacauacaaccauauuuaugauacugggccuacuauaggcauaaacacacaacaugaugagcacugcacaggaccaugcccggcuguggugccacauaaagaaaacuggauaacauucucucaggaaagaacaagcagaugggggugugaagaguuugguugcuuggccaucaacacaggguguguuuuugguucuugccaagauauaauacauccagaaaccaaaguauaccguaaagcaguagaagaagaaguugucuuaacagugugcauuaauuucccagguaauaauuacugcacagagauaaaugccguugagcccaagauaacagaugagauagagcuccaguucaaaacaguugauacaaaaaccuugcccaaccuucuugcagugcaaaaucacaaacuuuacaguggccagauaaacgauuugggcucuuuuucacaagguuguggaaauguccaaaaaacaaaucacucaauccuaggcauggguacagccaaauuugauuaugucugucauggugcuaguagaaaagaugugauagucaggaggugcuauaauaauaauuuugauucauguagauuacugaaagaggaaacaucauugauauuugcagauaaucaugagacucuagagguagcacacacaaagcaucugauaggugaauuacaguuuaagauaauguuaggagauauaagauacaaaucauuugcugaaucaccugagcuggaaauugaugcaaaauguguuggguguccaucauguuuugaaaguuauuccugcaacuuccaaauagugacaaacauagacaccguaugcucaguugaagggccaugcacacuauuucauaacagaaucauuauaucagcuaacaagcagucauauggacucaaaaugaguugccaaacaaagccuaaucaaaaugaagaguucauuaucugcaacaggaaauauaguguccuauucacaacaauugauaaaaaugauaaaauagaagugaauacaggggaucagacuucauauauuuaugaaaaggauagcagauguaagacuugguugugcaggguuagagaugaggggaucaguguccuauuugaaccauuaaaggcauucuuuggaaguuacuuuaguauaauauuuuauguugucguuggaauuauuguccuuuuuuugauuauauacauauuuuugccaauguucuucaaacuaaaagauguuuugaaaagaaaugaauauuuguaucuucaagaacugaaacauaaauga

SEQ ID NO: 4151 - RNA, 4305 nt, Artificial Sequence
  derived and/or modified CDS sequence (wt) from CVV(1156)__EU583730.1__GP
augcuauuccugcucauacuagccuuuuuaggguucucaacaagcaacccuauugcaacuagguguuuccaugggggccaauuaauagcagagucaaagucugcuacaucuauaucagaauucugccucaaggaugaugucucaauguuaaaaucugaagugguauacauaaagaaugauacuggauuauuuggucauaauaagguuuuucgaagcuggacaauaaaagauuggaaacucugcaauccuauaccuacugcaggaggaacaauaaauguaauugagguuaacaaagaucuuagucuaaugacaaaaacauacauauguaguagagauugcacuauaaccauagacaaagaggaagcucagaucaucuuccaaacggauaagcuaaaucauuuugaagugucuggcacuacauuaaguucagggugguuuaaaagcaaggcgucugucacccuggauagaaccugugagcauguuaagguuacuuguggaaagaaaucucugcaauuccaugcauguuuuaaacaccacaugucauguguuagguucuuccacaauaccauauuaccuggcaauaugauaaccucaaugugucagaauauagaauuaauaaucauuuuagggcuaacauuagccauauucauauuaaugguuauucuuacaaaaacuuauauauguuauuuacugaugccaauuuucaugccgauagcuuaucuuuaugguugggccuacaauaagagcugcaaaaagugcaacuguugugguuuagcauaccauccauuuacuaauugugggucacauuguguuuguggccugaaauuugaggcaucagauaggaugagaauccauagggaaucuggcuugugucaaggguacaagaguuuacgaauugccagacuuuuguguaaaucuaaagggucaucuuuaguuauaucuggauuauuguccauguuaaucuuaagcuucguaacaccuauagaggggacuauaacuagcuacccagagagcagaaaauauacacuagaagagauaacagauguuguugaaggacugguaucugaacagaauauaaaggaguacauuguuuucuauaccucauuguuuggaaguuuaauacuauuauuagcauuuauaaugucuauaacuuuaagcaaaauaacaagcauauuagcaaaaagaaauguuauuuauugcgaagaaugcucaauguaucauucaaaaagaggcauaaaguacaauggugacuucacaaacaaaugcggcuuuugcacaugcaaugaacaagaagauacggaaggauuaguaauacauaaaauuaguaagagaugcacauauaaauaccagcuaaagugggcuaaagugcugaugaucacacuagucuugcuucuaauagcgcaaaacacuauucuaauuguugcagcugaaacagauugcuggacaaaaaaaagccuagauauagacuguauaggaccaaugcuagauauaggcucuuguacaaauaagaauaccagaagcuaugaugcagaagcacagaaauuggugagccagucuaaaauaagucaacuagaugcagaccaaguaucguuguuaggcaacucuauagauagugcuauuaaggcaaucagagcccagaaaacuuacccuacaaugcacuuguuggaaacaauauucuuaaugaaaaauugcgauuauuacacgaguuucaaccauaacagugguuauucacaagccaaauggagauuaauugcaaaaacaggacauuuugacauauguuccagacauagcacccaccauuucugccgauguauaaaugaugggaccaaaugucagaauggugauugggauuucgcuggugaaaugaaugaaacuuacaauagcaaaaaugauuuuuauucacaugaccugaauuuguuuuacacaauuuuugaaaaugcauucccaggaacaacugaauccuuauuuuaucaauugauccaaaagaaaaauacuacaggggccuccaaggucuuggggaaguuaauaacuaaauaugguaauaauaacauguuuguuggagucuggaaauuuggacaguacuuacuuacauuaccauauauaaauaauacugaauugagccaaaauaggaggcuaacaauccugacaacacaagaacuauuaaguagaucgcacucuggcaggcaggagucuaugucuaaugcaauucagggcaguauuacaaaagaaugccauaaugcaaaggguguugggugcauaaguccucgguuugguauuccaauugguaaccuuacagcauguggugacucaccuaauuauaagauauauaaaacuccagaaaaauuguauaaaucaaauaauaaaggggaaguuugguguucaaaugauguucacugccugaaugauuuugagccugcagaugaagaaguugucaauaaaauuaagaaacucacuugcuucuuaacagacgucucaguugaaguagacaucuuuucaguggcugcauccacauguaaaauggcagacaaaggcgucuguacaguaaauggugcuaaauggaauauaaucaagugugauaguggguuauacuauuuuacagaccauagagaaggccaagacacaggcaaugacuuuggugaguauuguauaucucacaguugcaauacugagcgauucccuaucaacccagacauauuaaaagauuguacuugggaauuccauuccagaaagucuaaauauauuucaaccaucaguuuagaaucauuggaagaauucaggagggcaauggcagagaagcuaucacacacccuaacaauuuacaauuuuaaaccaacagcuaaccuuccucauauuaggccaacuuacaaauucauuacagccaauggugucgaaaacucugacgguauugaaucagcauacaucuugucuagcaucccugcauuagguggaaucaguguugguuauaauguucaaaccaaagacaacuucccauuguuggauauaauuguauuuauuaaaagcgcagucaucaggacaacauacaaucauauuuaugauaccgggccuacuauagguauaaacacacaacaugaugagcacuguacagggccgugcccagcuguggugccacauaaagagaacuggaugacauuuucucaggaaagaacaaguagaugggggugugaggaauuugguuguuuggccaucaacacaggguguguuuuugguucuugccaagauauaauacauccagaaacuaaaguauaccgcaaagcgguagaagaggaaguugucuuaacggugugcauuaauuuuccaggcaacaauuacugcacugaaauaaaugccauugagccuaagauaacagaugagauagagcuccaguucaaaacagucgauacaaaaaccuuacccaaccuccuugcagugcagaaucacaagcuuuacaguggccagauaaacgauuugggcucuuuuucacaagguuguggaaauguccaaaaaacaaaucacucaauccuaggcauggguacagucaaauuugauuaugucugucacggcgcuaguaggaaagaugugauagucaggaggugcuacaacaauaauuuugauucaugcaaauuacugaaagaagaaacaucauuaauauuugcagauaaucaugagacucuagagguagcacacacaaagcauuugauaggugaauuacaguuuaagauaauguuaggagauauaagauacaaaucauuugcugaaucaccugaguuggaaauugaugcaaaaugugucggguguccaucauguuuugaaagcuauuccugcaacuuucaaauagugacaaauauagacacugugugcucagucgaagggccaugcacacuauuucauaaucgaauuauuauaucagcuaacaaacagucauaugggcuuaaaaugaguugccaaacaaagccuaaccaaaaugaagaguucauuaucuguaaccggaaauacagugucuuauucacaacaauugauaaaaaugacaaaauagaagugaacacaggggaccagaccucauauauuuaugaaaaagacagcagauguaagacuugguuaugcaggguuagagaugaggggaucaguguccuauuugaaccauugaaagcauucuuuggaaguuauuuuagcauaauauuuuauguugucauuggaauuauuguccuuuucuugauuauauacauauuuuugccaauguucuucaaauuaaaagauguuuugaaaagaaaugaauacuuguaucuucaggaacugaaacauaaauaa

SEQ ID NO: 4152 - RNA, 4305 nt, Artificial Sequence
  derived and/or modified CDS sequence (wt) from CVV(6V633)__KX100134.1__GP
augcuauuccugcucauacuagccuuuuuaggguucucaacaagcaacccuauugcaacuagguguuuccaugggggccaauuaauagcagagucaaagucugcuacaucuauaucagaauucugccucaaggaugaugucucaauguuaaaaucugaagugguauacauaaagaaugauacuggauuauuuggucauaauaaaguuuuuagaagcuggacaauaaaagauuggaaacucugcaacccuauaccuacugcaggaggaacaauaaauguaauugagguuaacaaagaucuuagucuaaugacaaagacauacauauguaguagagauugcacuauaaccauagauaaagaggaagcucagauuaucuuccaaacagauaagcuaaaucauuuugaagugucuggcacuacauuaaguucaggaugguuuaaaagcaaggcgucugucacccuggauagaaccugugagcauguuaagguuacuuguggaaagaaaucucugcaauuccaugcauguuuuaaacaccacaugucauguguuagguucuuccacaauaccauauuaccuggcaauaugauaaccucaaugugccagaauauagaauuaauaauuaucuuagggcuaacauuagccauauucauauuaaugguuaugcuuacaaaaacuuauauauguuauuuacugaugccaauuuucaugccgauagcuuaucuuuaugguugggccuacaauaagagcugcaaaaagugcaacuguugugguuuagcauaccauccauuuacuaauugugggucacauuguguuuguggcuugaaauuugaggcaucagauaggaugagaauccauagagaaucuggcuugugucaaggguacaagaguuuacgaauugccagacuuuuguguaaaucuaaagggucaucuuuaguuauaucuggauuauuguccauguuaaucuuaagcuucguaacgccuauagaggggacuauaacuagcuacccagagagcagaaaauauacacuggaagagauaacagauguuguugaaggacugguaucugagcagaauauaaaggaguauauuguuuucuauaccucauuguuuggaaguuuaauacuauuauuagcauuuauaaugucuauaacuuuaagcaaaauaacaagcauauuagcaaaaagaaauguuauuuauugcgaagaaugcucaauguaucauucaaaaagaggcauaaaguacaauggugacuucacaaacaaaugcggcuuuugcacaugcaaugaacaagaggauacagaaggauuaguaauacauaaaguuaguaagagaugcacauauaaauaccagcuaaagugggcuaaagugcugaugauuacacuagucuugcuucuaauagcgcaaaacacuauucuaauuguugcagcugaaacagauugcuggacaaaaaaaagccuagauauagacuguauaggaccaaugcuagauauaggcucuugcacaaauaagaauaccagaagcuaugaugcagaagcacagaaauuggugagccagucuaaaauaagucaacuagaugcagaccaagcaucguuguuaggcaacucuauagauagugcuauuaaggcaaucagagcccagaaaacuuacccuacaaugcacuuguuggaaacaauauucuuaaugaaaaauugcgauuauuacacgaguuucaaccauaacaguggcuauucacaagccaaauggcgauugauugcaaaaacaggacacuuugacauaugcuccagacauagcacccaccauuucugccgauguauaaaugauggaaccaaaugucagaauggugauugggauuucgcuggugaaaugaaugaaacuuacaauagcaaaaaugauuuuuauucacaugaucugaauuuguuuuacacaauuuuugaaaaugcauucccaggaacaacugaauccuuauuuuaucaauugauccaaaagaaaaauacuacaggggccuccaaagucuuggggaaguuaauaacuaaauaugguaauaauaacauguucguuggaaucuggaaauuuggacaguacuuacuuacauuaccauauauaaauaauacugaauugagccagaauaggagacuaacaauccuggcaacacaagaacuauuaaguaggucgcacucuggcaggcaggagucuauguccaaugcaauucagggcaguauuacaaaagaaugccauaaugcaaaagguguugggugcauaaguccucgguuugguauuccaauugguaaccuuacagcauguggugacucaccuaauuauaaaauauauaagacuccagaaaaauuguauaaaucaaauaauaaaggggaaguuugguguucaaaugauguucacugccugaaugauuuugagccugcagaugaagaaguugucaauaaaauuaagaaacucacuugcuucuuaacagacgucucaguugaaguagacaucuuuucaguggcugcauccacauguaagauggcagacaaaggcgucuguacaguaaauggugcuaaauggaauauaaucaagugugauaguggauuauacuauuuuacagaccauagagaaggccaggacacaggcaaugacuuuggugaguauuguauaucucacaguugcaauacugagcgauucccuaucaacccagacacauuaaaagauuguacuugggaguuccauuccagaaagucuaaauauauuucaaccaucaguuuagaaucauuggaagaauucaggagggcaauggcagaaaaguuaucacacacccuaacaauuuacaauuuuaaaccaacagcuaaccuuccucauauuaggccaaccuacaaauucauuacagccaauggugucgaaaacucugacgguauugaaucagcauacaucuugucuagcaucccugcauuagguggaauuaguguugguuauaauguucaaaccaaagacaacuucccauuguuggauauaauuguauuuauuaaaagcgcagucaucaggacaacauacaaucauauuuaugauaccgggccuacuauagguauaaacacacaacaugaugagcacuguacagggccgugcccagcuguggugccacauaaagagaacuggaugacauuuucucaggaaagaacaaguagauggggaugugaagaauuugguugcuuggccaucaacacaggguguguuuuugguucuugccaagauauaauacauccagaaacuaaaguauaccgcaaagcaguagaagaggaaguugucuuaacggugugcaucaauuuuccaggcaauaauuacugcacugaaauaaaugccauugagccuaagauaacagaugagauagagcuccaguucaaaacagucgauacaaaaaccuuacccaaccuucuugcagugcagaaucacaagcuuuacaguggccagauaaacgauuugggcucuuuuucacaagguuguggaaauguccaaaaaacaaaucacucaauccuaggcauggguacagucaaauuugauuaugucugucacggcgcuaguaggaaagaugugauagucaggaggugcuacaacaauaauuuugauucaugcaaauuacugaaagaagaaacaucauuaauauuugcagauaaucaugagacucuagagguagcacacacaaagcaucugauaggugaauuacaguuuaagauaauguuaggagauauaagauacaaaucauuugcugaaucaccugaguuggaaauugaugcaaaaugugucggguguccaucauguuuugaaagcuacuccugcaacuuucaaauagugacaaauauagacacugugugcucagucgaagggccaugcacacuauuucauaaucgaauuauuauaucagcuaacaaacagucauaugggcuuaaaaugaguugccaaacaaagccuaaccaaaaugaagaguucauuaucuguaacaggaaauacagugucuuauucacaacaauugauaaaaaugacaaaauagaagugaacacaggggaccagacuucauauauuuaugaaaaggacagcagauguaagacuugguugugcaggguuagagaugaggggaucaguguccuauuugaaccauugaaagcauucuuugggagcuauuuuagcauaauauuuuauguuguuguuggaauuauuguccuuuucuugauuauauacauauuuuugccaauguucuucaaacuaaaagauguuuugaaaagaaaugaauauuuguaucuucaggaacugaaacauaaauga

SEQ ID NO: 4153 - RNA, 4305 nt, Artificial Sequence
  derived and/or modified CDS sequence (wt) from CVV(807270)__AF186243.1__GP
augcuauuccugcucauacuagccuuuuuaggguucucaacaagcaacccuauugcaacuagguguuuccaugggggccaauuaauagcagagucaaagucugcuacaucuauaucagaauucugccucaaggaugaugucucaauguuaaaaucugaagugguauacauaaagaaugauacuggauuauuuggucauaauaaaguuuuucgaagcuggacaauaaaagauuggaaacucugcaauccuauaccuacugcaggaggaacaauaaauguaauugagguuaacaaagaucuuagucuaaugacaaaaacauacauauguaguagagauugcacuauaaccauagauaaagaggaagcucagaucaucuuccaaacagauaagcuaaaucauuuugaagugucuggcacuacauuaaguucaggaugguuuaaaagcaaggcgucugucacccuggauagaaccugugagcauguuaagguuacuuguggaaagaaaucucugcaauuccaugcauguuuuaaacaccacaugucauguguuagguucuuccacaauaccauauuaccuggcaauaugauaaccucaaugugucagaauauagaauuaauaaucaucuuagggcuaacauuagccauauucauauuaaugguuauucuuacaaaaacuuauauauguuauuuacugaugccaauuuucaugccgauagcuuaucuuuaugguugggccuacaauaagagcugcaaaaagugcaacuguugugguuuagcauaccauccauuuacuaauugugggucacauuguguuuguggccugaaauuugaggcaucagauaggaugagaauccauagagaaucuggcuugugucaaggguacaagaguuuacgaauugccagacuuuuguguaaaucuaaagggucaucuuuaguuauaucuggauuauuguccauguuaaucuuaagcuucguaacgccuauagaaggaacuauaacuagcuacccagagagcagaaaauauacacuagaagagauaacagauguuguugaaggacugguaucugagcagaauauaaaggaguacauuguuuucuauaccucauuguuuggaaguuuaauacuauuauuagcauuuauaaugucuauaacuuuaagcaaaauaacaagcauauuagcaaaaagaaauguuauuuauugcgaagaaugcucaauguaucauucaaaaagaggcauaaaguacaauggugacuucacaaacaaaugcggcuuuugcacaugcaaugaacaagaggauacggaaggauuaguaauacauaaaguuaguaagagaugcacauauaaauaccagcuaaagugggcuaaagugcugaugaucacacuagucuugcuucuaauagcgcaaaacacuauccuaauuguugcagcugaaacagauugcuggacaaaaaaaagccuagauauagacuguauaggaccaaugcuagauauaggcucuugcacaaauaagaauaccagaagcuaugaugcagaagcacagaaauuggugagucagucuaaaauaagucaacuagaugcagaccaaguaucguuguuaggcaacucuauagauagugcuauuaaggcaaucagagcccagaaaacuuacccuacaaugcacuuguuggaaacaauauucuuaaugaaaaauugcgauuauuacacaaguuucaaccauaacaguggcuauucacaagccaaauggcgauugauugcaaaaacaggacauuuugacauaugcuccagacauagcacccaccauuucugccaauguauaaaugauggaaccaaaugucagaauggugauugggauuucgcuggugaaaugaaugaaacuuacaauagcaaaaaugauuuuuauucacaugaccugaauuuguuuuacacaauuuuugaaaaugcauucccaggaacaacugaauccuuauuuuaucaauugauccaaaagaaaaauacuacaggggccuccaaggucuuggggaaguuaauaacuaaauaugguaauaauaacauguuuguuggagucuggaaauuuggacaguacuuacuuacauuaccauauauaaauaauacugaauugagccagaauaggaggcuaacaauacuggcaacacaagaacuauuaaguagaucgcacucuggcaggcaggagucuauguccaaugcaauucagggcaguauuacaaaagaaugccauaaugcaaaggguguugggugcauaaguccucgguuugguauuccaauugguaaccuuacagcauguggugacucaccuaauuauaagauauauaagacuccagaaaaauuguauaaaucaaauaauaaaggggaaguuugguguucaaaugauguucacugccugaaugauuuugagccugcagaugaagaaguugucaauaaaauuaagaaacucacuugcuucuuaacagacgucucaguugaaguagacaucuuuucaguggcugcaucuacauguaaaauggcagacaaaggcgucuguacaguaaauggugcuaaauggaauauaaucaagugugauaguggguuauacuauuuuacagaccauagagaaggccaagacacaggcaaugacuuuggugaguauuguauaucucacaguugcaauacugagcgauucccuaucaacccagacauauuaaaagauuguacuugggaauuccauuccagaaagucuaaauauauuucaaccaucaguuuagaaucauuggaagaauucaggagggcaauggcagagaagcuaucacacacccuaacaauuuacaauuuuaaaccaacagcuaaccuuccccauauuaggccaacuuacaaauucauuacagccaauggugucgaaaacucugacgguauugaaucagcauacauuuugucuagcaucccugcauuagguggaauuaguguugguuauaauguucaaaccaaagacaacuucccauuguuggauauaauuguauuuauuaaaagcgcagucaucaggacaacauacaaucauauuuaugauaccgggccuacuauagguauaaacacacaacaugaugagcacuguacagggccgugcccagcuguggugccacauaaagagaacuggaugacauuuucucaggaaagaacaaguagauggggaugugaagaauuugguuguuuggccaucaacacaggguguguuuuugguucuugccaagauauaauacauccagaaacuaaaguauaccgcaaagcaguagaagaggaaguugucuuaacagugugcaucaauuuuccaggcaacaauuacugcacugaaauaaaugccauugagccuaagauaacagaugagauagagcuccaguucaaaacagucgauacaaaaaccuuacccaaccuucuugcagugcaaaaucacaagcuuuacaguggccagauaaacgauuugggcucuuuuucacaagguuguggaaauguccaaaaaacaaaucacucaauccuaggcauggguacagucaaauuugauuaugucugucauggcgcuaguaggaaagaugugauagucaggaggugcuacaacaauaauuuugauucaugcaaauuacugaaagaagaaacaucauuaauauuugcagauaaucaugagacucuagagguagcacacacaaagcauuugauaggugaauuacaguuuaagauaauguugggagauauaagauacaaaucauuugcugaaucaccugaguuggaaauugaugcaaaaugugucggguguccaucauguuuugaaagcuacuccugcaacuuucaaauagugacaaauauagacacugugugcucagucgaagggccaugcacacuauuucauaaucgaauuauuauaucagcuaacaaacagucauaugggcuuaaaaugaguugccaaacaaagccuaaccaaaaugaagaguucauuaucuguaaccggaaauacagugucuuauucacaacaauugauaaaaaugacaaaauagaagugaacacaggggaccagaccucauauauuuaugaaaaagacagcagauguaagacuugguuaugcaggguuagagaugaggggaucaguguccuauuugaaccguugaaagcauucuuuggaaguuauuuuagcauaauauuuuauguugucguuggaauuauuguccuuuucuugauuauauacauauuuuugccaauguucuucaaauuaaaagauguuuugaaaagaaaugaguauuuguaucuucaagaacugaaacauaaauga

SEQ ID NO: 4154 - RNA, 4305 nt, Artificial Sequence
  derived and/or modified CDS sequence (wt) from CVV(856 clone 1)__EU583732.1__GP
augcuauuccugcucauacuagccuuuuuaggguucucaacaagcaacccuauugcaacuagguguuuccaugggggccaauuaauagcagagucaaagucugcuacaucuauaucagaauucugccucaaggaugaugucucaauguuaaaaucugaagugguauacauaaagaaugauacuggauuauuuggucauaauaagguuuuucgaagcuggacaauaaaagauuggaaacucugcaauccuauaccuacugcaggaggaacaauaaauguaauugagguuaacaaagaucuuagucuaaugacaaaaacauacauauguaguagagauugcacuauaaccauagacaaagaggaagcucagaucaucuuccaaacggauaagcuaaaucauuuugaagugucuggcacuacauuaaguucagggugguuuaaaagcaaggcgucugucacccuggauagaaccugugagcauguuaagguuacuuguggaaagaaaucucugcaauuccaugcauguuuuaaacaccacaugucauguguuagguucuuccacaauaccauauuaccuggcaauaugauagccucaaugugucagaauauagaauuaauaaucauuuuagggcuaacauuagccauauucauauuaaugguuauucuuacaaaaacuuauauauguuauuuacugaugccaauuuucaugccgauagcuuaucuuuaugguugggccuacaauaagagcugcaaaaagugcaacuguugugguuuagcauaccauccauuuacuaauugugggucacauuguguuuguggccugaaauuugaggcaucagauaggaugagaauccauagggaaucuggcuugugucaaggguacaagaguuuacgaauugccagacuuuuguguaaaucuaaagggucaucuuuaguuauaucuggauuauuguccauguuaaucuuaagcuucguaacaccuauagaggggacuauaacuagcuacccagagagcagaaaauauacacuagaagagauaacagauguuguugaagggcugguaucugaacagaauauaaaggaguacauuguuuucuauaccucauuguuuggaaguuuaauacuauuauuagcauuuauaaugucuauaacuuuaagcaaaauaacaagcauauuagcaaaaagaaauguuauuuauugcgaagaaugcucaauguaucauucaaaaagaggcauaaaguacaauggugacuucacaaacaaaugcggcuuuugcacaugcaaugaacaagaagauacggaaggauuaguaauacauaaaguuaguaagagaugcacauauaaauaccagcuaaagugggcuaaagugcugaugaucacacuagucuugcuucuaauagcgcaaaacacuauucuaauuguugcagcugaaacagauugcuggauaaaaaaaagccuagauauagacuguauaggaccaaugcuagauauaggcucuugcacaaauaagaauaccagaagcuaugaugcagaagcacagaaauuggugagccagucuaaaauaagucaacuagaugcagaccaaguaucguuguuaggcaacucuauagauagugcuauuaaggcaaucagagcccagaaaacuuacccuacaaugcacuuguuggaaacaauauucuuaaugaaaaauugcgauuauuacacgaguuucaaccauaacagugguuauucacaagccaaauggagauugauugcaaaaacaggacauuuugacauauguuccagacauagcacccaccauuucugccgauguauaaaugaugggaccaaaugucagaauggugauugggauuucgcuggugaaaugaaugaaacuuacaauagcaaaaaugauuuuuauucacaugaccugaauuuguuuuacacaauuuuugaaaaugcauucccaggaacaacugaauccuuauuuuaucaauugauccaaaggaaaaauacuacaggggccuccaaggucuuggggaaguuaauaacuaaauaugguaauaauaacauguuuguuggagucuggaaauuuggacaguacuuacuuacauuaccauauauaaauaauacugaauugagccaaaauaggaggcuaacaauccugacaacacaagaacuauuaaguagaucgcacucuggcaggcaggagucuaugucuaaugcaauucagggcaguauuacaaaagaaugccauaaugcaaaggguguugggugcauaaguccucgguuugguauuccaauugguaaccuuacagcauguggugacucaccuaauuauaagauauauaagacuccagaaaaauuguauaaaucaaauaauaaaggggaaguuugguguucaaaugauguucacugccugaaugauuuugagccugcagaugaagaaguugucaauaaaauuaagaaacucacuugcuucuuaacagacgucucaguugaaguagacaucuuuucaguggcugcauccacauguaaaauggcagacaaaggugucuguacaguaaauggugcuaaauggaauauaaucaaaugugauaguggguuauacuauuuuacagaccauagagaaggccaagacacaggcaaugacuuuggugaguauuguauaucucacaguugcaauacugagcgauucccuaucaacccagacauauuaaaagauuguacuugggaauuccauuccagaaagucuaaauauauuucaaccaucaguuuagaaucauuggaagaauucaggagggcaauggcagagaagcuaucacacacccuaacaauuuacaauuuuaaaccaacagcuaaccuuccucauauuaggccaacuuacaaauucauuacagccaauggugucgaaaacucugacgguauugaaucagcauacaucuugucuagcaucccugcauuagguggaaucaguguugguuauaauguucaaaccaaagacaacuucccauuguuggauauaauuguauuuauuaaaagcgcagucaucaggacaacauacaaucauauuuaugauaccgggccuacuauagguauaaacacacaacaugaugagcacuguacagggccgugcccagcuguggugccacauaaagagaacuggaugacauuuucucaggaaagaacaaguagaugggggugugaggaauuugguuguuuggccaucaacacaggguguguuuuugguucuugccaagauauaauacauccagaaacuaaaguauaccgcaaagcgguagaagaggaaguugucuuaacggugugcaucaauuuuccaggcaacaauuacugcacugaaauaaaugccauugagccuaagauaacagaugagauagagcuccaguucaaaacagucgauacaaaaacuuuacccaaccuucuugcagugcagaaucacaagcucuacaguggccagauaaacgauuugggcucuuuuucacaagguuguggaaauguccaaaaaacaaaucacucaauccuaggcauggguacagucaaauuugauuaugucugucacggcgcuaguaggaaagaugugauagucaggaggugcuacaacaauaauuuugauucaugcaaauuacugaaagaagaaacaucauuaauauuugcagauaaucaugagacucuagagguagcacacacaaagcauuugauaggugaauuacaguuuaagauaauguuaggagauauaagauacaaaucauuugcugaaucaccugaguuggaaauugaugcaaaaugugucggguguccaucauguuuugaaagcuauuccugcaacuuucaaauagugacaaauauagacacugugugcucagucgaagggccaugcacacuauuucauaaucgaauuauuauaucagcuaacaaacagucauaugggcuuaaaaugaguugccaaacaaagccuaaccaaaaugaagaguucauuaucuguaaccggaaauacagugucuuauucacaacaauugauaaaaaugacaaaauagaagugaacacaggggaccagaccucauauauuuaugaaaaagacagcagauguaagacuugguuaugcaggguuagagaugaggggaucaguguccuauuugaaccguugaaagcauucuuuggaaguuauuuuagcauaauauuuuauguugucauuggaauuauuguccuuuucuugauuauauacauauuuuugccaauguucuucaaauuaaaagauguuuugaaaagaaaugaauacuuguaucuucaggaacugaaacauaaauaa

SEQ ID NO: 4155 - RNA, 4305 nt, Artificial Sequence
  derived and/or modified CDS sequence (wt) from CVV(856 clone 3)__EU583731.1__GP
augcuauuccugcucauacuagccuuuuuaggguucucaacaagcaacccuauugcaacuagguguuuccaugggggccaauuaauagcagagucaaagucugcuacaucuauaucagaauucugccucaaggaugaugucucaauguuaaaaucugaagugguauacauaaagaaugauacuggauuauuuggucauaauaagguuuuucgaagcuggacaauaaaagauuggaaacucugcaauccuauaccuacugcaggaggaacaauaaauguaauugagguuaacaaagaucuuagucuaaugacaaaaacauacauauguaguagagauugcacuauaaccauagacaaagaggaagcucagaucaucuuccaaacggauaagcuaaaucauuuugaagugucuggcacuacauuaaguucagggugguuuaaaagcaaggcgucugucacccuggauagaaccugugagcauguuaagguuacuuguggaaagaaaucucugcaauuccaugcauguuuuaaacaccacaugucauguguuagguucuuccacaauaccauauuaccuggcaauaugauagccucaaugugucagaauauagaauuaauaaucauuuuagggcuaacauuagccauauucauauuaaugguuauucuuacaaaaacuuauauauguuauuuacugaugccaauuuucaugccgauagcuuaucuuuaugguugggccuacaauaagagcugcaaaaagugcaacuguugugguuuagcauaccauccauuuacuaauugugggucacauuguguuuguggccugaaauuugaggcaucagauaggaugagaauccauagggaaucuggcuugugucaaggguacaagaguuuacgaauugccagacuuuuguguaaaucuaaagggucaucuuuaguuauaucuggauuauuguccauguuaaucuuaagcuucguaacaccuauagaggggacuauaacuagcuacccagagagcagaaaauauacacuagaagagauaacagauguuguugaagggcugguaucugaacagaauauaaaggaguacauuguuuucuauaccucauuguuuggaaguuuaauacuauuauuagcauuuauaaugucuauaacuuuaagcaaaauaacaagcauauuagcaaaaagaaauguuauuuauugcgaagaaugcucaauguaucauucaaaaagaggcauaaaguacaauggugacuucacaaacaaaugcggcuuuugcacaugcaaugaacaagaagauacggaaggauuaguaauacauaaaguuaguaagagaugcacauauaaauaccagcuaaagugggcuaaagugcugaugaucacacuagucuugcuucuaauagcgcaaaacacuauucuaauuguugcagcugaaacagauugcuggauaaaaaaaagccuagauauagacuguauaggaccaaugcuagauauaggcucuugcacaaauaagaauaccagaagcuaugaugcagaagcacagaaauuggugagccagucuaaaauaagucaacuagaugcagaccaaguaucguuguuaggcaacucuauagauagugcuauuaaggcaaucagagcccagaaaacuuacccuacaaugcacuuguuggaaacaauauucuuaaugaaaaauugcgauuauuacacgaguuucaaccauaacagugguuauucacaagccaaauggagauugauugcaaaaacaggacauuuugacauauguuccagacauagcacccaccauuucugccgauguauaaaugaugggaccaaaugucagaauggugauugggauuucgcuggugaaaugaaugaaacuuacaauagcaaaaaugauuuuuauucacaugaccugaauuuguuuuacacaauuuuugaaaaugcauucccaggaacaacugaauccuuauuuuaucaauugauccaaaggaaaaauacuacaggggccuccaaggucuuggggaaguuaauaacuaaauaugguaauaauaacauguuuguuggagucuggaaauuuggacaguacuuacuuacauuaccauauauaaauaauacugaauugagccaaaauaggaggcuaacaauccugacaacacacgaacuauuaaguagaucgcacucuggcaggcaggagucuaugucuaaugcaauucagggcaguauuacaaaagaaugccauaaugcaaaggguguugggugcauaaguccucgguuugguauuccaauugguaaccuuacagcauguggugacucaccuaauuauaagauauauaagacuccagaaaaauuguauaaaucaaauaauaaaggggaaguuugguguucaaaugauguucacugccugaaugauuuugagccugcagaugaagaaguugucaauaaaauuaagaaacucacuugcuucuuaacagacgucucaguugaaguagacaucuuuucaguggcugcauccacauguaaaauggcagacaaaggugucuguacaguaaauggugcuaaauggaauauaaucaaaugugauaguggguuauacuauuuuacagaccauagagaaggccaagacacaggcaaugacuuuggugaguauuguauaucucacaguugcaauacugagcgauucccuaucaacccagacauauuaaaagauuguacuugggaauuccauuccagaaagucuaaauauauuucaaccaucaguuuagaaucauuggaagaauucaggagggcaauggcagagaagcuaucacacacccuaacaauuuacaauuuuaaaccaacagcuaaccuuccucauauuaggccaacuuacaaauucauuacagccaauggugucgaaaacucugacgguauugaaucagcauacaucuugucuagcaucccugcauuagguggaaucaguguugguuauaauguucaaaccaaagacaacuucccauuguuggauauaauuguauuuauuaaaagcgcagucaucaggacaacauacaaucauauuuaugauaccgggccuacuauagguauaaacacacaacaugaugagcacuguacagggccgugcccagcuguggugccacauaaagagaacuggaugacauuuucucaggaaagaacaaguagaugggggugugaggaauuugguuguuuggccaucaacacaggguguguuuuugguucuugccaagauauaauacauccagaaacuaaaguauaccgcaaagcgguagaagaggaaguugucuuaacggugugcaucaauuuuccaggcaacaauuacugcacugaaauaaaugccauugagccuaagauaacagaugagauagagcuccaguucaaaacagucgauacaaaaacuuuacccaaccuucuugcagugcagaaucacaagcucuacaguggccagauaaacgauuugggcucuuuuucacaagguuguggaaauguccaaaaaacaaaucacucaauccuaggcauggguacagucaaauuugauuaugucugucacggcgcuaguaggaaagaugugauagucaggaggugcuacaacaauaauuuugauucaugcaaauuacugaaagaagaaacaucauuaauauuugcagauaaucaugagacucuagagguagcacacacaaagcauuugauaggugaauuacaguuuaagauaauguuaggagauauaagauacaaaucauuugcugaaucaccugaguuggaaauugaugcaaaaugugucggguguccaucauguuuugaaagcuauuccugcaacuuucaaauagugacaaauauagacacugugugcucagucgaagggccaugcacacuauuucauaaucgaauuauuauaucagcuaacaaacagucauaugggcuuaaaaugaguugccaaacaaagccuaaccaaaaugaagaguucauuaucuguaaccggaaauacagugucuuauucacaacaauugauaaaaaugacaaaauagaagugaacacaggggaccagaccucauauauuuaugaaaaagacagcagauguaagacuugguuaugcaggguuagagaugaggggaucaguguccuauuugaaccguugaaagcauucuuuggaaguuauuuuagcauaauauuuuauguugucauuggaauuauuguccuuuucuugauuauauacauauuuuugccaauguucuucaaauuaaaagauguuuugaaaagaaaugaauacuuguaucuucaggaacugaaacauaaauaa

SEQ ID NO: 4156 - RNA, 4305 nt, Artificial Sequence
  derived and/or modified CDS sequence (wt) from CVV(CK102)__AF186242.1__GP
augcuauuccugcucauacuagccuuuuuaggguucucaacaagcaacccuauugcaacuagguguuuccaugggggccaauuaauagcagagucaaagucugcuacaucuauaucagaauucugccucaaggaugaugucucaauguuaaaaucugaagugguauacauaaagaaugauacuggauuauuuggucauaauaaaguuuuucgaagcuggacaauaaaagauuggaaacucugcaauccuauaccuacugcaggaggaacaauaaauguaauugagguuaacaaagaucuuagucuaaugacaaaaacauacauauguaguagagauugcacuauaaccauagauaaagaggaagcucagaucaucuuccaaacagauaagcuaaaucauuuugaagugucuggcacuacauuaaguucaggaugguuuaaaagcaaggcgucugucacccuggauagaaccugugagcauguuaagguuacuuguggaaagaaaucucugcaauuccaugcauguuuuaagcaccacaugucauguguuagguucuuccacaauaccauauuaccuggcaauaugauaaccucaaugugucagaauauagaauuaauaaucaucuuagggcuaacauuagccauauucauauuaaugguuauucuuacaaaaacuuauauauguuauuuacugaugccaauuuucaugccgauagcuuaucuuuaugguugggccuacaauaagagcugcaaaaagugcaacuguugugguuuagcauaccauccauuuacuaauugugggucacauuguguuuguggccugaaauuugaggcaucagauaggaugagaauccauagagaaucuggcuugugucaaggguacaagaguuuacgaauugccagacuuuuguguaaaucuaaagggucaucuuuaguuguaucuggauuauuguccauguuaaucuuaagcuucguaacgccuauagaggggacuauaacuagcuacccagagagcagaaaauauacacuagaagagauaacagauguuguugaaggacugguaucugagcagaauauaaaggaguacauuguuuucuauaccucauuguuuggaaguuuaauacuauuauuagcauuuauaaugucuauaacuuuaagcaaaauaacgagcauauuagcaaaaagaaauguuauuuauugcgaagaaugcucaauguaucauucaaaaagaggcauaaaguacaauggugacuucacaaacaagugcggcuuuugcacaugcaaugaacaagaggauacggaaggauuaguaauacauaaaguuaguaagagaugcacauauaaauaccagcuaaagugggcuaaagugcugaugaucacacuagucuugcuucuaauagcgcaaaacacuauucuaauuguugcagcugaaacagauugcuggacaaaaaaaagccuagauauagacuguauaggaccaaugcuagauauaggcucuugcacaaauaagaauaccagaagcuaugauacagaagcacagaaauuggugagccagucuaaaauaagucaacuagaugcagaccaaguaucguuguuaggcaacucuauagauagugcuauuaaggcaaucagagcccagaaaacuuacccuacaaugcacuuguuggaaacaauauucuuaaugaaaaauugcgauuauuacacgaguuucaaccauaacaguggcuauucacaagccaaauggcgauugauugcaaaaacaggacauuuugacauaugcuccagacauagcacccaccauuucugccgauguauaaaugauggaaccaaaugucagaauggugauugggauuucgcuggugaaaugaaugaaacuuacaauagcaaaaaugauuuuuauucacaugaccugaauuuguuuuacacaauuuuugaaaaugcauucccaggaacaacugaauccuuauuuuaucaauugauccaaaagaaaaauacuacaggggccuccaaggucuuggggaaguuaauaacuaaauaugguaauaauaacauguuuguuggagucuggaaauuuggacaguacuuacuuacauuaccauauauaaauaauacugaauugagccagaauaggaggcuaacaauccuggcaacacaagaacuauuaaguagaucgcacucuggcaggcaggagucuauguccaaugcaauucagggcaguauuacaaaagaaugccauaaugcaaaggguguugggugcauaaguccucgguuugguauuccaauugguaaccuuacagcauguggugacucaccuaauuauaagauauauaagacuccagaaaaauuguauaaaucaaauaauaaaggggaaguuugguguucaaaugauguucacugccugaaugauuuugagccugcagaugaagaaguugucaauaaaauuaagaaacucacuugcuucuuaacggacgucucaguugaaguagacaucuuuucaguggcugcauccacauguaaaauggcagacaaaggcgucuguacaguaaauggugcuaaauggaauauaaucaagugugauaguggguuauacuauuuuacagaccauagagaaggccaagacacaggcaaugacuuuggugaguauuguauaucucacaguugcaauacugagcgauucccuaucaacccagacauauuaaaagauuguacuugggaauuccauuccagaaagucuaaauauauuucaaccaucaguuuagaaucauuggaagaauucaggagggcaauggcagagaagcuaucacacacccuaacaauuuacaauuuuaaaccaacagcuaaccuuccucauauuaggccaacuuacaaauucauuacagccaauggugucgaaaacucugacgguauugaaucagcauacaucuugucuagcaucccugcauuagguggaauuaguguugguuauaauguucaaaccaaagacaaccucccauuguuggauauaauuguauuuauuaaaagcgcagucaucaggacaacauacaaucauauuuaugauaccgggccuacuauagguauaaacacacaacaugaugagcacuguacagggccgugcccagcuguggugccacauaaagagaacuggaugacauuuucucaggaaagaacaaguagauggggaugugaagaauuugguuguuuggccaucaacacaggguguguuuuugguucuugccaagauauaauacauccagaaacuaaaguauaccgcaaagcaguagaagaggaaguugucuuaacggugugcaucaauuuuccaggcaacaauuacugcacugaaauaaaugccauugagccuaagauaacagaugagauagagcuccaguucaaaacagucgauacaaaaaccuuacccaaccuucuugcagugcagaaucacaagcuuuacaguggccagauaaaugauuugggcucuuuuucacaagguuguggaaauguccaaaaaacaaaucacucaauccuaggcauggguacagucaaauuugauuaugucugucacggcgcuaguaggaaagaugugauagucaggaggugcuacaacaauaauuuugauucaugcaaauuacugaaagaagaaacaucauuaauauuugcagauaaucaugagacucuagagguagcacacacaaagcauuugauaggugaauuacaguuuaagauaauguuaggagauauaagauacaaaucauuugcugaaucaccugaguuggaaauugaugcaaaaugugucggguguccaucauguuuugaaagcuacuccugcaacuuucaaauagugacaaauauagacacugugugcucagucgaagggccaugcacacuauuucauaaucgaauuauuauaucagcuaacaaacagucauaugggcuuaaaaugaguugccaaacaaagccuaaccaaaaugaagaguucauuaucuguaaccggaaauacagugucuuauucacaacaauugauaaaaaugacaaaauagaagugaacacaggggaccagaccucauauauuuaugaaaaagacagcagauguaagacuugguuaugcaggguuagagaugaggggaucaguguccuauuugaaccguugaaagcauucucuggaaguuauuuuagcauaauauuuuauguugucguuggaauuauuguucuuuucuugauuauauacauauuuuugccaauguucuucaaauuaaaagauguuuugaaaagaaaugaauauuuguaucuucaggaacugaaacauaaauga

SEQ ID NO: 4157 - RNA, 4305 nt, Artificial Sequence
  derived and/or modified CDS sequence (wt) from CVV(CK-102)__KX100146.1__GP
augcuauuccugcucauacuagccuuuuuaggguucucaacaagcaacccuauugcaacuagguguuuccaugggggccaauuaauagcagagucaaagucugcuacaucuauaucagaauucugccucaaggaugaugucucaauguuaaaaucugaagugguauacauaaagaaugauacuggauuauuuggucauaauaaaguuuuucgaagcuggacaauaaaagauuggaaacucugcaauccuauaccuacugcaggaggaacaauaaauguaauugagguuaacaaagaucuuagucuaaugacaaaaacauacauauguaguagagauugcacuauaaccauagauaaagaggaagcucagaucaucuuccaaacagauaagcuaaaucauuuugaagugucuggcacuacauuaaguucaggaugguuuaaaagcaaggcgucugucacccuggauagaaccugugagcauguuaagguuacuuguggaaagaaaucucugcaauuccaugcauguuuuaagcaccacaugucauguguuagguucuuccacaauaccauauuaccuggcaauaugauaaccucaaugugucagaauauagaauuaauaaucaucuuagggcuaacauuagccauauucauauuaaugguuauucuuacaaaaacuuauauauguuauuuacugaugccaauuuucaugccgauagcuuaucuuuaugguugggccuacaauaagagcugcaaaaagugcaacuguugugguuuagcauaccauccauuuacuaauugugggucacauuguguuuguggccugaaauuugaggcaucagauaggaugagaauccauagagaaucuggcuugugucaaggguacaagaguuuacgaauugccagacuuuuguguaaaucuaaagggucaucuuuaguuguaucuggauuauuguccauguuaaucuuaagcuucguaacgccuauagaggggacuauaacuagcuacccagagagcagaaaauauacacuagaagagauaacagauguuguugaaggacugguaucugagcagaauauaaaggaguacauuguuuucuauaccucauuguuuggaaguuuaauacuauuauuagcauuuauaaugucuauaacuuuaagcaaaauaacaagcauauuagcaaaaagaaauguuauuuauugcgaagaaugcucaauguaucauucaaaaagaggcauaaaguacaauggugacuucacaaacaagugcggcuuuugcacaugcaaugaacaagaggauacggaaggauuaguaauacauaaaguuaguaagagaugcacauauaaauaccagcuaaagugggcuaaagugcugaugaucacacuagucuugcuucuaauagcgcaaaacacuauucuaauuguugcagcugaaacagauugcuggacaaaaaaaagccuagauauagacuguauaggaccaaugcuagauauaggcucuugcacaaauaagaauaccagaagcuaugauacagaagcacagaaauuggugagccagucuaaaauaagucaacuagaugcagaccaaguaucguuguuaggcaacucuauagauagugcuauuaaggcaaucagagcccagaaaacuuacccuacaaugcacuuguuggaaacaauauucuuaaugaaaaauugcgauuauuacacgaguuucaaccauaacaguggcuauucacaagccaaauggcgauugauugcaaaaacaggacauuuugacauaugcuccagacauagcacccaccauuucugccgauguauaaaugauggaaccaaaugucagaauggugauugggauuucgcuggugaaaugaaugaaacuuacaauagcaaaaaugauuuuuauucacaugaccugaauuuguuuuacacaauuuuugaaaaugcauucccaggaacaacugaauccuuauuuuaucaauugauccaaaagaaaaauacuacaggggccuccaaggucuuggggaaguuaauaacuaaauaugguaauaauaacauguuuguuggagucuggaaauuuggacaguacuuacuuacauuaccauauauaaauaauacugaauugagccagaauaggaggcuaacaauccuggcaacacaagaacuauuaaguagaucgcacucuggcaggcaggagucuauguccaaugcaauucagggcaguauuacaaaagaaugccauaaugcaaaggguguugagugcauaaguccucgguuugguauuccaauugguaaccuuacagcauguggugacucaccuaauuauaagauauauaagacuccagaaaaauuguauaaaucaaauaauaaaggggaaguuugguguucaaaugauguucacugccugaaugauuuugagccugcagaugaagaaguugucaauaaaauuaagaaacucacuugcuucuuaacggacgucucaguugaaguagacaucuuuucaguggcugcauccacauguaaaauggcagacaaaggcgucuguacaguaaauggugcuaaauggaauauaaucaagugugauaguggguuauacuauuuuacagaccauagagaaggccaagacacaggcaaugacuuuggugaguauuguauaucucacaguugcaauacugagcgauucccuaucaacccagacauauuaaaagauuguacuugggaauuccauuccagaaagucuaaauauauuucaaccaucaguuuagaaucauuggaagaauucaggagggcaauggcagagaagcuaucacacacccuaacaauuuacaauuuuaaaccaacagcuaaccuuccucauauuaggccaacuuacaaauucauuacagccaauggugucgaaaacucugacgguauugaaucagcauacaucuugucuagcaucccugcauuagguggaauuaguguugguuauaauguucaaaccaaagacaaccucccauuguuggauauaauuguauuuauuaaaagcgcagucaucaggacaacauacaaucauauuuaugauaccgggccuacuauagguauaaacacacaacaugaugagcacuguacagggccgugcccagcuguggugccacauaaagagaacuggaugacauuuucucaggaaagaacaaguagauggggaugugaagaauuugguuguuuggccaucaacacaggguguguuuuugguucuugccaagauauaauacauccagaaacuaaaguauaccgcaaagcaguagaagaggaaguugucuuaacggugugcaucaauuuuccaggcaacaauuacugcacugaaauaaaugccauugagccuaagauaacagaugagauagagcuccaguucaaaacagucgauacaaaaaccuuacccaaccuucuugcagugcagaaucacaagcuuuacaguggccagauaaaugauuugggcucuuuuucacaagguuguggaaauguccaaaaaacaaaucacucaauccuaggcauggguacagucaaauuugauuaugucugucacggcgcuaguaggaaagaugugauagucaggaggugcuacaacaauaauuuugauucaugcaaauuacugaaagaagaaacaucauuaauauuugcagauaaucaugagacucuagagguagcacacacaaagcauuugauaggugaauuacaguuuaagauaauguuaggagauauaagauacaaaucauuugcugaaucaccugaguuggaaauugaugcaaaaugugucggguguccaucauguuuugaaagcuacuccugcaacuuucaaauagugacaaauauagacacugugugcucagucgaagggccaugcacacuauuucauaaucgaauuauuauaucagcuaacaaacagucauaugggcuuaaaaugaguugccaaacaaagccuaaccaaaaugaagaguucauuaucuguaaccggaaauacagugucuuauucacaacaauugauaaaaaugacaaaauagaagugaacacaggggaccagaccucauauauuuaugaaaaagacagcagauguaagacuugguuaugcaggguuagagaugaggggaucaguguccuauuugaaccguugaaagcauucuuuggaaguuauuuuagcauaauauuuuauguugucguuggaauuauuguucuuuucuugauuauauacauauuuuugccaauguucuucaaauuaaaagauguuuugaaaagaaaugaauauuuguaucuucaggaacugaaacauaaauga

SEQ ID NO: 4158 - RNA, 4305 nt, Artificial Sequence
  derived and/or modified CDS sequence (wt) from CVV(MI80-1-450)__AF186241.1__GP
augcuauuccugcucauacuagccuuuuuaggguucucaacaagcaacccuauugcaacuagguguuuccaugggggccauuuaauagcagagucaaagucugcuacaucuauaucagaauucugccucaaggaugaugucucaauguuaaaaucugaagugguauacauaaagaaugauacuggauuauuuggucauaauaaaguuuuucgaagcuggacaauaaaagauuggaaacucugcaauccuauaccuacugcaggaggaacaauaaauguaauugagguuaacaaagaucuuagucuaaugacaaagacauacauauguaguagagauugcacuauaaccauagauaaagaggaagcucagaucaucuuccaaacagauaagcuaaaucauuuugaagugucuggcacuacauuaaguucaggaugguuuaaaagcaaggcgucugucacccuggauagaaccugugagcauguuaagguuacuuguggaaagaaaucucugcaauuccaugcauguuuuaaacaccacaugucauguguuagguucuuccacaauacuauauuaccuggcaauaugauaaccucaaugugccagaauauagaauuaauaauuauuuuagggcuaacauuggccauauucauauuaaugguuauucuuacaaaaacuuauauauguuauuuacugaugccaauuuucaugccgauagcuuaucuuuaugguugggccuacaauaagagcugcaaaaagugcaacuguugugguuuagcauaccauccauuuacuaauugugggucacauuguguuuguggccugaaauuugaggcaucagauaggaugagaauccauagagaaucuggcuugugucaaggguacaagaguuuacgaauugccagacuuuuguguaaaucuaaagggucaucuuuaguuauaucuggauuauuguccauguuaaucuuaagcuucguaacaccuauagaggggacuauaacuagcuacccagagagcagaaaauauacacuggaagagauaacagauguuguugaaggacugguaucugagcagaauauaaaggaguacauuguuuucuauaccucauuguuuggaaguuuaauacuauuauuagcauuuauaaugucuauaacuuuaagcaaaauaacaagcauauuagcaaaaagaaauguuauuuauugcgaagaaugcucaauguaucauucaaaaagaggcauaaaguacaauggugacuucacaaacaaaugcggcuuuugcacaugcaaugaacaagaggauacggaaggauuaguaauacauaaaguuaguaagagaugcacauauaaauaccagcuaaagugggcuaaagugcugaugaucacacuagucuugcuuuuaauagcgcaaaacacuauucuaauuguugcagcugaaacagauugcuggacaaaaaaaagccuagauauagacuguauaggaccaaugcuagauauaggcucuugcacaaauaagaauaccagaagcuaugaugcagaagcacagaaauuggugagccagucuaaaauaagucaacuagaugcagaccaaguaucguuguuaggcaacucuauagauagugcuauuaaggcaaucagagcccagaaaacuuacccuacaaugcacuuguuggaaacaauauucuuaaugaaaaauugcgauuauuacacgaguuucaaccauaacaguggcuauucacaagccaaauggcgauugauugcaaaaacaggacauuuugacauaugcuccagacauagcacccaccauuucugccgauguauaaaugauggaaccaaaugucagaaugguaauugggauuucgcuggugaaaugaaugaaacuuacaauagcaaaaaugauuuuuauucacaugaucugaauuuguuuuacacaauuuuugaaaaugcauucccaggaacaacugaguccuuauuuuaucaauugauccaaaagaaaaauacuacaggggccucccaagucuuggggaaguuaauaacuaaauaugguaauaauaacauguucguuggagucuggaaauuuggacaguacuuacuuacauuaccauauauaaauaauacugaauugagccagaauaggaggcuaacaauccuggcaacacaagaacuauuaaguagaucgcacucuggcaggcaggagucuauguccaaugcaauucagggcaguauuacaaaagaaugccauaaugcaaaggguguuggguguauaaguccucgguuugguauuccaauugguaaccuuacagcauguggugacucaccuaauuauaagauauauaagacuccagaaaaauuguauaaaucaaauaauaaaggggaaguuugguguucaaaugauguucacugccugaaugauuuugagccugcagaugaagaaguugucaauaaaauuaagaaacucacuugcuucuuaacagacgucucaguugaaguagacaucuuuucaguggcugcauccacauguaaaauggcagacaaaggcgucuguacaguaaauggugcuaaauggaauauaaucaagugugauaguggguuauacuauuuuacagaccauagagaaggccaagacacaggcaaugacuuuggugaguauuguauaucucacaguugcaauacugagcgauucccuaucaacccagacauauuaaaagauuguacuugggaauuccauuccagaaagucuaaauauauuucaaccaucaguuuagaaucauuggaagaauucaggagggcaauggcagagaaguuaucacacacccuaacaauuuacaauuuuaaaccaacagcuaaccuuccucauauuaggccaacuuacaaauucauuacagccaaugguguugaaaacucugacgguauugaaucagcauacaucuugucuagcaucccugcauuagguggaauuaguguugguuauaauguucaaaccaaagacaacuucccauuguuggauauaauuguauuuauuaaaagcgcagucaucaggacaacauacaaucauauuuaugauaccgggccuacuauagguauaaacacacaacaugaugagcacuguacagggccgugcccagcuguggugccacauaaagagaacuggaugacauuuucucaggaaagaacaaguagauggggaugugaagaauuugguugcuuggccaucaacacaggguguguuuuugguucuugccaagauauaauacauccagaaacuaaaguauaccgcaaagcaguagaagaggaaguugucuuaacggugugcaucaauuuuccaggcaacaauuacugcacugaaauaaaugccauugagccuaagauaacagaugagauagagcuccaguucaaaacagucgauacaaaaaccuuacccaaccuucuugcagugcagaaucacaagcuuuacaguggccagauaaacgauuugggcucuuuuucacaagguuguggaaauguccaaaaaacaaaucacucaauccuaggcaugggcacagucaaauuugauuaugucugucacggugcuaguaggaaagaugugauagucaggaggugcuacaacaauaauuuugauucaugcaaauuacugaaagaagaaacaucauuaauauuugcagauaaucaugagacucuagagguagcacacacaaagcauuugauaggugaauuacaguuuaagauaauguuaggagauauaagauacaagucauuugcugaaucaccugaguuggaaauugaugcaaaaugugucgggugcccaucauguuuugaaagcuacuccugcaacuuucaaauagugacaaauauagacacugugugcucagucgaagggccaugcacacuauuucauaaucgaauuauuauaucagcuaacaaacagucauaugggcuuaaaaugaguugccaaacaaagccuaaccaaaaugaagaguucauuaucuguaaccggaaauacagugucuuauucacaacaauugauaaaaaugacaaaauagaagugaacacaggggaccagaccucauauauuuaugaaaaggacagcagauguaagacuugguuaugcaggguuagagaugaagggaucaguguccuauuugaaccguugaaagcauucuuuggaaguuauuuuagcauaauauuuuauguugucguuggaauuauuguccuuuucuugauuauauacauauuuuugccaauguucuucaaauuaaaagauguuuugaaaagaaaugaauauuuguaucuucaggaacugaaacauaaauga

SEQ ID NO: 4159 - RNA, 4305 nt, Artificial Sequence
  derived and/or modified CDS sequence (wt) from CVV(MI80-1-450)__KX100149.1__GP
augcuauuccugcucauacuagccuuuuuaggguucucaacaagcaacccuauugcaacuagguguuuccaugggggccaauuaauagcagagucaaagucugcuacaucuauaucagaauucugccucaaggaugaugucucaauguuaaaaucugaagugguauacauaaagaaugauacuggauuauuuggucauaauaaaguuuuucgaagcuggacaauaaaagauuggaaacucugcaauccuauaccuacugcaggaggaacaauaaauguaauugagguuaacaaagaucuuagucuaaugacaaagacauacauauguaguagagauugcacuauaaccauagauaaagaggaagcucagaucaucuuccaaacagauaagcuaaaucauuuugaagugucuggcacuacauuaaguucaggaugguuuaaaagcaaggcgucugucacccuggauagaaccugugagcauguuaagguuacuuguggaaagaaaucucugcaauuccaugcauguuuuaaacaccacaugucauguguuagguucuuccacaauacuauauuaccuggcaauaugauaaccucaaugugccagaauauagaauuaauaauuauuuuagggcuaacauuggccauauucauauuaaugguuauucuuacaaaaacuuauauauguuauuuacugaugccaauuuucaugccgauagcuuaucuuuaugguugggccuacaauaagagcugcaaaaagugcaacuguugugguuuagcauaccauccauuuacuaauugugggucacauuguguuuguggccugaaauuugaggcaucagauaggaugagaauccauagagaaucuggcuugugucaaggguacaagaguuuacgaauugccagacuuuuguguaaaucuaaagggucaucuuuaguuauaucuggauuauuguccauguuaaucuuaagcuucguaacaccuauagaggggacuauaacuagcuacccagagagcagaaaauauacacuggaagagauaacagauguuguugaaggacugguaucugagcagaauauaaaggaguacauuguuuucuauaccucauuguuuggaaguuuaauacuauuauuagcauuuauaaugucuauaacuuuaagcaaaauaacaagcauauuagcaaaaagaaauguuauuuauugcgaagaaugcucaauguaucauucaaaaagaggcauaaaguacaauggugacuucacaaacaaaugcggcuuuugcacaugcaaugaacaagaggauacggaaggauuaguaauacauaaaguuaguaagagaugcacauauaaauaccagcuaaagugggcuaaagugcugaugaucacacuagucuugcuuuuaauagcgcaaaacacuauucuaauuguugcagcugaaacagauugcuggacaaaaaaaagccuagauauagacuguauaggaccaaugcuagauauaggcucuugcacaaauaagaauaccagaagcuaugaugcagaagcacagaaauuggugagccagucuaaaauaagucaacuagaugcagaccaaguaucguuguuaggcaacucuauagauagugcuauuaaggcaaucagagcccagaaaacuuacccuacaaugcacuuguuggaaacaauauucuuaaugaaaaauugcgauuauuacacgaguuucaaccauaacaguggcuauucacaagccaaauggcgauugauugcaaaaacaggacauuuugacauaugcuccagacauagcacccaccauuucugccgauguauaaaugauggaaccaaaugucagaaugguaauugggauuucgcuggugaaaugaaugaaacuuacaauagcaaaaaugauuuuuauucacaugaucugaauuuguuuuacacaauuuuugaaaaugcauucccaggaacaacugaguccuuauuuuaucaauugauccaaaagaaaaauacuacaggggccucccaagucuuggggaaguuaauaacuaaauaugguaauaauaacauguucguuggagucuggaaauuuggacaguacuuacuuacauuaccauauauaaauaauacugaauugagccagaauaggaggcuaacaauccuggcaacacaagaacuauuaaguagaucgcacucuggcaggcaggagucuauguccaaugcaauucagggcaguauuacaaaagaaugccauaaugcaaaggguguuggguguauaaguccucgguuugguauuccaauugguaaccuuacagcauguggugacucaccuaauuauaagauauauaagacuccagaaaaauuguauaaaucaaauaauaaaggggaaguuugguguucaaaugauguucacugccugaaugauuuugagccugcagaugaagaaguugucaauaaaauuaagaaacucacuugcuucuuaacagacgucucaguugaaguagacaucuuuucaguggcugcauccacauguaaaauggcagacaaaggcgucuguacaguaaauggugcuaaauggaauauaaucaagugugauaguggguuauacuauuuuacagaccauagagaaggccaagacacaggcaaugacuuuggugaguauuguauaucucacaguugcaauacugagcgauucccuaucaacccagacauauuaaaagauuguacuugggaauuccauuccagaaagucuaaauauauuucaaccaucaguuuagaaucauuggaagaauucaggagggcaauggcagagaaguuaucacacacccuaacaauuuacaauuuuaaaccaacagcuaaccuuccucauauuaggccaacuuacaaauucauuacagccaaugguguugaaaacucugacgguauugaaucagcauacaucuugucuagcaucccugcauuagguggaauuaguguugguuauaauguucaaaccaaagacaacuucccauuguuggauauaauuguauuuauuaaaagcgcagucaucaggacaacauacaaucauauuuaugauaccgggccuacuauagguauaaacacacaacaugaugagcacuguacagggccgugcccagcuguggugccacauaaagagaacuggaugacauuuucucaggaaagaacaaguagauggggaugugaagaauuugguugcuuggccaucaacacaggguguguuuuugguucuugccaagauauaauacauccagaaacuaaaguauaccgcaaagcaguagaagaggaaguugucuuaacggugugcaucaauuuuccaggcaacaauuacugcacugaaauaaaugccauugagccuaagauaacagaugagauagagcuccaguucaaaacagucgauacaaaaaccuuacccaaccuucuugcagugcagaaucacaagcuuuacaguggccagauaaacgauuugggcucuuuuucacaagguuguggaaauguccaaaaaacaaaucacucaauccuaggcaugggcacagucaaauuugauuaugucugucacggugcuaguaggaaagaugugauagucaggaggugcuacaacaauaauuuugauucaugcaaauuacugaaagaagaaacaucauuaauauuugcagauaaucaugagacucuagagguagcacacacaaagcauuugauaggugaauuacaguuuaagauaauguuaggagauauaagauacaagucauuugcugaaucaccugaguuggaaauugaugcaaaaugugucgggugcccaucauguuuugaaagcuacuccugcaacuuucaaauagugacaaauauagacacugugugcucagucgaagggccaugcacacuauuucauaaucgaauuauuauaucagcuaacaaacagucauaugggcuuaaaaugaguugccaaacaaagccuaaccaaaaugaagaguucauuaucuguaaccggaaauacagugucuuauucacaacaauugauaaaaaugacaaaauagaagugaacacaggggaccagaccucauauauuuaugaaaaggacagcagauguaagacuugguuaugcaggguuagagaugaagggaucaguguccuauuugaaccguugaaagcauucuuuggaaguuauuuuagcauaauauuuuauguugucguuggaauuauuguccuuuucuugauuauauacauauuuuugccaauguucuucaaauuaaaagauguuuugaaaagaaaugaauauuuguaucuucaggaacugaaacauaaauga

SEQ ID NO: 4160 - RNA, 4305 nt, Artificial Sequence
  derived and/or modified CDS sequence (wt) from CVV(MNZ-92011)__KC436107.1__GP
augcuauucuugcucauacuagccuuuuuaggguucucaacgagcaacccuauugcgacuagguguuuccaugggggccaauuaauagcagagucaaagucugcuacaucuauaucagaauucugccucaaggaugacgucucaauguuaaaaucugaagugguauauacaaagaaugauacugggcuauuuggucauaauaaaguuuuuagaagcuggacaauaaaagauuggaaacucugcaauccuauaccuacugcaggaggaacaauaaauguaauugaggucaauaaagaucuuagucuaaugacaaagacauacauauguaguagagauugcaccauaacuauagauaaagaggaagcucagauuaucuuccaaacagauaaguuaaaucauuuugaagugucugguaccacauuaaauucaggaugguucaaaagcaaagcaucuguuacccuggauagaaccugugaacauguuaagguuacuuguggaaaaaagucucugcaauuccaugcaugcuuuaagcaccacaugucauguguuagguucuuccacaauaccauauuaccuggcaauaugauaaacucuaugugccagaauauagaauuaauaauuaucuuagggcuaacauuagcuauauuuauauuaaugguuaugcuuacaaagacuuauauauguuacuuauugaugccaauuuucaugccaauagcuuaucuuuaugguugggcauauaacaaaagcugcaaaaaguguaacugcuguggucuagcauaucauccauuuacuaauuguggcucacacuguguuuguggcuuaaaauuugaggcaucagauaggaugaggauccauagagaaucuggcuuaugucaaggguacaagaguuuacgaauugccaggcuuuuguguaaaucuaaagggucaucucuaguuauaucuggauuauuauccauguuaaucuuaagcuuuguaacgccuauagagggaacuauaacuagcuacccagaaagcaggaaauauacacuggaagagauaacagauguuguugaaggauuaguaucugagcagaauauaaaggaguacauuguuuucuacaccucauuguuuggaaguuuaauauuguuacuagcauuuauaauguccauaacuuuaagcaaaauaacaagcauacuagcaagaagaaauguuauuuauugugaagaaugcucaauguaucauucaaaaagaggcauaaaguauaacggugacuuuacaaacaaaugcggcuuuugcacaugcaaugaacaggaggaugcagaaggguuaguaauacauaaaguuaguaagagaugcacauauaaauaucaacuaaagugggcuaaagugcugauggucacacuggucuugcuuuuaauagcacaaaacacuauucuaauuguugcagcuggaacagauugcugggcaaaaaaaagccuagauauggacuguauagggccaauguuagacauaggcucuugcacaaauaagaauaccagaaacuaugauacagaagcacagaaauuggugagccaaucuaaaguaagucaacuagaugcagaccaggcaucauuauugggcaacucuauagauagugcuauuaaagcaauaagagcccagaaaacuuauccuacaaugcacuuauuggaaacaauauucuuaaugaaaaauugugauuauuacacaaguuuuaaccauaauaguggcuauucacaagcuaaauggcgauuaauugcaaaaacagggcacuuugauauauguucuaggcauagcacccaccacuuuugccgauguauaaaugaugggaccaaaugucagaauggugauugggauuuugcuggugaaaugaaugaaacuuauaauagcaaaaaugauuuuuauucacaugaucugaacuuguuuuacacaauuuuugaaaaugcauucccagggacuacugaauccuuauuuuaccaguuaauccagaagaaaaauacugcaggagccuccaaaaucuugggaaaguuaauaaccaaguaugguaauaauaacauguuuguuggagucuggaaauuuggacaguacuuacuuacauugccauauauaaauaauacugaauugagccagaauaggaggcaaacaaucuuggcaacacaagaaucauuaaguagaucacacucuggcaggcaagagucuauguccagugcaauucagggcaguguuacaaaagaaugccacaaugcaaaggauguugggugcauaagcccucgguuuggcauuccaauuggcaaccucacagcauguggcgacucaccuaauuauaagauauauaaaacuccagaaaaguuguauaaaucaaauaauaaaggggaaguuugguguucgaaugauguucacugccugaaugauuuugagccugcagaugaagaaguugucaauaaaguuaaaaaacucacuuguuucuuaacagacgucucagucaaaacagacaucuuuucaguagcugcaucuacauguaagauggcagauaaaggcauuuguacagugaaugaugcuaaauggaauauaaucaagugugauaguggauuauacuauuuuacagaccauagagaaggucaagacacaggcaaugacuuuggugaguauuguauaucucacaguugcaacacugagcgauucccuauuaacccagacauauuaaaagauugcacuugggaguuccauuccaggaagucuaaauauauuucaaccauuaguuuagaaucauuggaagaauucaggagagcaaugacagagaaguuaucacacacccuaacaauuuacaauuuuaaaccaacagcuaaccucccucauauuaggccaacuuauaaauucaucacagcaaauggugucgaaaacucugaugguauugaaucggcauauaucuuaucuaguaucccugcauuaggugggauuaguguugguuauaauguucaaaccaaagacaauuucccauuauuggauauaauuguauuuauuaaaagugcagucaucaggacaacauacaaccauauuuaugauacugggccuacuauaggcauaaacacacaacaugaugagcacugcacaggaccaugcccggcuguggugccacauaaagaaaacuggauaacauucucucaggaaagaacaagcagaugggggugugaagaguuugguugcuuggccaucaacacaggguguguuuuugguucuugccaagauauaauacauccagaaaccaaaguauaccguaaagcaguagaagaagaaguugucuuaacagugugcauuaauuucccagguaauaauuacugcacagagauaaacgccguugagcccaagauaacagaugagauagagcuccaguucaaaacaguugauacaaaaaccuugcccaaccuucuugcagugcaaaaucacaaacuuuacaguggccagauaaacgauuugggcucuuuuucacaagguuguggaaauguccaaaaaacaaaucacucaauccuaggcauggguacagccaaauuugauuaugucugucauggugcuaguagaaaagaugugauagucaggaggugcuauaauaauaauuuugauucauguagauuacugaaagaggaaacaucauugauauuugcagauaaucaugagacucuagagguagcacacacaaagcaucugauaggugaauuacaguuuaagauaauguuaggagauauaagauacaaaucauuugcugaaucaccugagcuggaaauugaugcaaaauguguuggguguccaucauguuuugaaaguuauuccugcaacuuccaaauagugacaaacauagacaccguaugcucaguugaagggccaugcacacuauuucauaacagaaucauuauaucagcuaacaagcagucauauggacucaaaaugaguugccaaacaaagccuaaucaaaaugaagaguucauuaucugcaacaggaaauauaguguccuauucacaacaauugauaaaaaugauaaaauagaagugaauacaggggaucagacuucauauauuuaugaaaaggauagcagauguaagacuugguugugcaggguuagagaugaggggaucaguguccuauuugaaccauuaaaggcauucuuuggaaguuacuuuaguauaauauuuuauguugucguuggaauuauuguccuuuuuuugauuauauacauauuuuugccaauguucuucaaacuaaaagauguuuugaaaagaaaugaauauuuguaucuucaagaacugaaacauaaauga

SEQ ID NO: 4161 - RNA, 4305 nt, Artificial Sequence
  derived and/or modified CDS sequence (wt) from CVV(MPB1-1551)__KX100143.1__GP
augcuauuccugcucauacuagccuuuuuaggguucucaacaagcaacccuauugcaacuagguguuuccaugggggccaauuaauagcagagucaaagucugcuacaucuauaucagaauucugccucaaggaugaugucucaauguuaaaaucugaagugguauacauaaagaaugauacuggauuauuuggucauaauaaaguuuuuagaagcuggacaauaaaagauuggaaacucugcaacccuauaccuacugcaggaggaacaauaaauguaauugagguuaacaaagaucuuagucuaaugacaaagacauacauauguaguagagauugcacuauaaccauagauaaagaggaagcucagauuaucuuccaaacagauaagcuaaaucauuuugaagugucuggcacuacauuaaguucaggaugguuuaaaagcaaggcgucugucacccuggauagaaccugugagcauguuaagguuacuuguggaaagaaaucucugcaauuccaugcauguuuuaaacaccacaugucauguguuagguucuuccacaauaccauauuaccuggcaauaugauaaccucaaugugccagaauauagaauuaauaauuaucuuagggcuaacauuagccauauucauauuaaugguuaugcuuacaaaaacuuauauauguuauuuacugaugccaauuuucaugccgauagcuuaucuuuaugguugggccuacaauaagagcugcaaaaagugcaacuguugugguuuagcauaucauccauuuacuaauugugggucacauuguguuuguggccugaaauuugaggcaucagauaggaugagaauccauagagaaucuggcuugugucaaggguacaagaguuuacgaauugccagacuuuuguguaaaucuaaagggucaucuuuaguuauaucuggauuauuguccauguuaaucuuaagcuucguaacgccuauagaggggacuauaacuagcuacccagagagcagaaaauauacacuggaagagauaacagauguuguugaaggacugguaucugagcagaauauaaaggaguacauuguuuucuauaccucauuguuuggaaguuuaauacuauuauuagcauuuauaaugucuauaacuuuaagcaaaauaacaagcauauuagcaaaaagaaauguuauuuauugugaagaaugcucaauguaucauucaaaaagaggcauaaaguacaauggugacuucacaaacaaaugcggcuuuugcacaugcaaugaacaagaggauacagaaggauuaguaauacauaaaguuaguaagagaugcacauauaaauaccagcuaaagugggcuaaagugcugaugaucacacuagucuugcuucuaauagcgcaaaacacuauucuaauuguugcagcugaaacagauugcuggacaaaaaaaagccuagauauagacuguauaggaccaaugcuagauauaggcucuugcacaaauaagaauaccagaagcuaugaugcagaagcacagaaauuggugagccagucuaaaauaagucaacuagaugcagaccaagcaucguuguuaggcaacucuauagauagugcuauuaaggcaaucagagcccagaaaacuuacccuacaaugcacuuguuggaaacaauauucuuaaugaaaaauugcgauuauuacacgaguuucaaccauaacaguggcuauucacaagccaaauggcgauugauugcaaaaacaggacacuuugacauaugcuccagacauagcacccaccauuucugccgauguauaaaugauggaaccaaaugucagaauggugauugggauuucgcuggugaaaugaaugaaacuuacaauagcaaaaaugauuuuuauucacaugaucugaauuuguuuuacacaauuuuugaaaaugcauucccaggaacaacugaauccuuauuuuaucaauugauccaaaagaaaaacacuacaggggccuccaaagucuuggggaaguuaauaacuaaauaugguaauaauaacauguucguuggagucuggaaauuuggacaguacuuacuuacauuaccauauauaaauaauacugaauugagccagaauaggagacuaacaauccuggcaacacaagaaauauuaaguaggucgcacucuggcaggcaggagucuauguccaaugcaauucagggcaguauuacaaaagaaugccauaaugcaaaagguguugggugcauaaguccucgguuugguauuccaauugguaaccuuacagcauguggugacucaccuaauuauaagauauauaagacuccagaaaaauuguauaaaucaaauaauaaaggggaaguuugguguucaaaugauguucacugccugaaugauuuugagccugcagaugaagaaguuaucaauaaaauuaagaaacucacuugcuucuuaacagacgucucaguugaaguagacaucuuuucaguggcugcauccacauguaagauggcagacaaaggcgucuguacaguaaauggugcuaaauggaauauaaucaagugugauaguggauuauacuauuuuacagaccauagagaaggccaagacacaggcaaugacuuuggugaguauuguauaucucacaguugcaauacugagcgauucccuaucaacccagacacauuaaaagauuguacuugggaguuccauuccagaaagucuaaauauauuucaaccaucaguuuagaaucauuggaagaauucaggagggcaauggcagagaaguuaucacacacccuaacaauuuacaauuuuaaaccaacagcuaaccuuccucauauuaggccaaccuacaaauucauuacagccaauggugucgaaaacucugacgguauugaaucagcauacaucuugucuagcaucccugcauuagguggaauuaguguugguuauaauguucaaaccaaagacaacuucccauuguuggauauaauuguauuuauuaagagcgcaguuaucaggacaacauacaaucauauuuaugauaccgggccuacuauagguauaaacacacaacaugaugagcacuguacagggccgugcccagcuguggugccacauaaagagaacuggaugacauuuucucaggaaagaacaaguagauggggaugugaagaauuugguugcuuggccaucaacacaggguguguuuucgguucuugucaagauauaauacauccagaaacuaaaguauaccgcaaagcaguagaagaggaaguugucuuaacggugugcaucaauuuuccaggcaauaguuacugcacugaaauaaaugccauugagccuaagauaacagaugagauagagcuccaguucaaaacagucgauacaaaaaccuuacccaaccuucuugcagugcagaaucacaagcuuuacaguggccagauaaacgauuugggcucuuuuucacaagguuguggaaauguccaaaaaacaaaucacucaauccuaggcauggguacagucaaauuugauuaugucugucacggcgcuaguaggaaagaugugauagucaggaggugcuacaacaauaauuuugauucaugcaaauuacugaaagaagaaacaucauuaauauuugcagauaaucaugagacucuagagguagcacacacaaagcaucugauaggugaauuacaguuuaagauaauguuaggagauauaagauacaaaucauuugcugaaucaccugaguuggaaauugaugcaaaaugugucggguguccaucauguuuugaaagcuacuccugcaacuuucaaauagugacaaauauagacacugugugcucagucgaagggccaugcacacuauuucauaaucgaauuauuauaucagcuaacaaacagucauaugggcuuaaaaugaguugccaaacaaagccuaaccaaaaugaagaguucauuaucuguaacaggaaauacagugucuuauucacaacaauugauaaaaaugacaaaauagaagugaacacaggggaccagaccucauauauuuaugaaaaggacagcagauguaagacuugguugugcaggguuagagaugaggggaucaguguccuauuugaaccauugaaagcauucuuuggaaguuauuuuagcauaauauuuuauguugucguuggaauuauuguccuuuucuugauuauauacauauuuuugccaauguucuucaaauuaaaagauguuuugaaaagaaaugaauauuuguaucuucaggaacugaaacauaaauga

SEQ ID NO: 4162 - RNA, 4305 nt, Artificial Sequence
  derived and/or modified CDS sequence (wt) from CVV(W308-67)__KX100140.1__GP
augcuauuccugcucauacuagccuuuuuaggguucucaacaagcaacccuauugcaacuagguguuuccaugggggccaauuaauagcagagucaaagucugcuacaucuauaucagaauucugccucaaggaugaugucucaauguuaaaaucugaagugguauacauaaagaaugauacuggauuauuuggucauaauaaaguuuuuagaagcuggacaauaaaagauuggaaacucugcaacccuauaccuacugcaggaggaacaauaaauguaauugagguuaacaaagaucuuagucuaaugacaaagacauacauauguaguagagauugcacuauaaccauagauaaagaggaagcucagauuaucuuccaaacagauaagcuaaaucauuuugaagugucuggcacuacauuaaguucaggaugguuuaaaagcaaggcgucugucacccuggauagaaccugugagcauguuaagguuacuuguggaaagaaaucucugcaauuccaugcauguuuuaaacaccacaugucauguguuagguucuuccacaauaccauauuaccuggcaauaugauaaccucaaugugccagaauauagaauuaauaauuaucuuagggcuaacauuagccauauucauauuaaugguuacgcuuacaaaaacuuauauauguuauuuacugaugccaauuuucaugccgauagcuuaucuuuaugguugggccuacaauaagagcugcaaaaagugcaacuguugugguuuagcauaccauccauuuacuaauugugggucacauuguguuuguggccugaaauuugaggcaucagauaggaugagaauccauagagaaucuggcuugugucaaggguacaagaguuuacgaauugccagacuuuuguguaaaucuaaagggucaucuuuaguuauaucuggauuauuguccauguuaaucuuaagcuucguaacgccuauagaggggacuauaacuagcuacccagagagcagaaaauauacacuggaagagauaacagauguuguugaaggacugguaucugagcagaauauaaaggaguacauuguuuucuauaccucauuguuuggaaguuuaauacuauuauuagcauuuauaaugucuauaacuuuaagcaaaauaacaagcauauuagcaaaaagaaauguuauuuauugugaagaaugcucaauguaucauucaaaaagaggcauaaaguacaauggugacuucacaaacaaaugcggcuuuugcacaugcaaugaacaagaggauacagaaggauuaguaauacauaaaguuaguaagagaugcacauauaaauaccagcuaaagugggcuaaagugcugaugaucacgcuagucuugcuucuaauagcgcaaaacacuauucuaauuguugcagcugaaacagauugcuggacaaaaaaaagccuagauauagacuguauaggaccaaugcuagauauaggcucuugcacaaauaagaauaccagaagcuaugaugcagaagcacagaaauuggugagccagucuaaaauaagucaacuagaugcagaccaagcaucguuguuaggcaacucuauagauagugcuauuaaggcaaucagagcccagaaaacuuacccuacaaugcacuuguuggaaacaauauucuuaaugaaaaauugcgauuauuacacgaguuucaaccauaacaguggcuauucacaagccaaauggcgauugauugcaaaaacaggacacuuugacauaugcuccagacauagcacccaccauuucugccgauguauaaaugaugaaaccaaaugucagaauggugauugggauuucgcuggugaaaugaaugaaacuuacaaaagcaaaaaugauuuuuauucacaugaucugaauuuguuuuacacaauuuuugaaaaugcauucccaggaacaacugaauccuuauuuuaucaauugauccaaaagaaaaauacuacaggggccuccaaagucuuggggaaguuaauaacuaaauaugguaauaauaacauguucguuggagucuggaaauuuggacaguacuuacuuacauuaccauauauaaauaauacugaauugagccagaauaggagacuaacaauccuggcaacacaagaaauauuaaguaggucguacucuggcaggcaggagucuauguccaaugcaauucagggcaguauuacaaaagaaugccauaaugcaaaagguguugggugcauaaguccucgguuugguauuccaauugguaaccuuacagcauguggugacucaccuaauuauaagauauauaagacuccagaaaaauuguauaaaucaaauaauaaaggggaaguuugguguucaaaugauguucacugccugaaugauuuugagccugcagaugaagaaguuaucaauaaaauuaagaaacucacuugcuucuuaacagacgucucaguugaaguagacaucuuuucaguggcugcauccacauguaagauggcagacaaaggcgucuguacaguaaauggugcuaaauggaauauaaucaagugugauaguggauuauacuauuuuacagaccauagagaaggccaagacacaggcaaugacuuuggugaguauuguauaucucacaguugcaauacugagcgauucccuaucaacccagacacauuaaaagauuguacuugggaguuccauuccagaaagucuaaauauauuucaaccaucaguuuagaaucauuggaagaauucaggagggcaauggcagagaaguuaucacacacccuaacaauuuacaauuuuaaaccaacagcuaaccuuccucauauuaggccaaccuacaaauucauuacagccaauggugucgaaaacucugacgguauugaaucagcauacaucuugucuagcaucccugcauuagguggaauuaguguugguuacaauguucaaaccaaagacaacuucccauuguuggauauaauuguauuuauuaagagcgcagucaucaggacaacauacaaucauauuuaugauaccgggccuacuauagguauaaacacacaacaugaugagcacuguacagggccgugcccagcuguggugccacauaaagagaacuggaugacauuuucucaggaaagaacaaguagauggggaugugaagaauuugguugcuuggccaucaacacaggguguguuuucgguucuugccaagauauaauacauccagaaacuaaaguauaccgcaaagcaguagaagaggaaguugucuuaacggugugcaucaauuuuccaggcaauaauuacugcacugaaauaaaugccauugagccuaagauaacagaugagauagagcuccaguucaaaacagucgauacaaaaaccuuacccaaccuucuugcagugcagaaucacaagcuuuacaguggccagauaaacgauuugggcucuuuuucacaagguuguggaaauguccaaaaaacaaaucacucaauccuaggcauggguacagucaaauuugauuaugucugucacggcgcuaguaggaaagaugugauagucaggaggugcuacaacaauaauuuugauucaugcaaauuacugaaagaagaaacaucauuaauauuugcagauaaucaugagacucuagagguagcacacacaaagcaucugauaggugaauuacaguuuaagauaauguuaggagauauaagauacaaaucauuugcugaaucaccugaguuggaaauugaugcaaaaugugucggguguccaucauguuuugaaagcuacuccugcuacuuucaaauagugacaaauauagacacugugugcucagucgaagggccaugcacacuauuucauaaucgaauuauuauaucagcuaacaaacagucauaugggcuuaaaaugaguugccaaacaaagccuaaccaaaaugaagaguucauuaucuguaacaggaaauacagugucuuauucacaacaauugauaaaaaugacaaaauagaagugaacacaggggaccagaccucauauauuuaugaaaaggacagcagauguaagacuugguugugcaggguuagagaugaggggaucaguguccuauuugaaccauugaaagcauucuuuggaaguuauuuuagcauaauauuuuauguugucguuggaauuauuguccuuuucuugauuauauacauauuuuugccaauguucuucaaauuaaaagauguuuugaaaagaaaugaauauuuguaucuucaggaacugaaacauaaauga

SEQ ID NO: 4163 - RNA, 4305 nt, Artificial Sequence
  derived and/or modified CDS sequence (wt) from CVV(W728-67)__KX100137.1__GP
augcuauuccugcucauacuagccuuuuuaggauucucaacaagcaacccuauugcaacuagguguuuccaugggggccaauuaauagcagagucaaagucugcuacaucuauaucagaauucugccucaaggaugaugucucaauguugaaaucugaagugguauacauaaagaaugauacuggacuauuuggucauaauaaaguuuuuagaagcuggacaauaaaagauuggaaacucugcaacccuauaccuacugcagggggaacaauaaauguaauugagguuaacaaagaucuuaguuuaaugacaaagacauacauauguaguagagauugcacuauaaccauagauaaagaggaagcucagauuaucuuccaaacagauaagcuaaaucauuuugaagugucuggcacuacauuaaguucaggaugguuuaaaagcaaggcgucugucacccuagauagaaccugugagcauguuaagguuacuuguggaaagaaaucucugcaauuccaugcauguuuuaaacaccacaugucauguguuagauucuuccacaauaccauauuaccuggcaauaugauaaccucaaugugccagaauauagaauuaauaauuaucuuagggcuaacauuagccauauucauauuaaugguuaugcuuacaaaaacuuauauauguuauuuacugaugccaauuuucaugccgauagcuuaucuuuaugguugggccuacaauaagagcugcaaaaagugcaacuguugugguuuagcauaccauccauuuacuaauugugggucacauuguguuuguggccugaaauuugaggcaucagauagaaugagaauccauagagaaucuggcuugugucaaggguacaagaguuuacgaauugccagacuuuuguguaaaucuaaagggucaucuuuaguuauaucuggauuacuguccauguuaaucuuaagcuucguaacgccuauagaggggacuauaacuagcuacccagagagcagaaaauauacacuggaagagauaacagauguuguugaaggacugguaucugagcagaauauaaaggaguacauuguuuucuauaccucauuguuuggaaguuuaauacuauuauuagcauuuauaaugucuauaacuuuaagcaaaauaacaagcauauuagcaaaaagaaauguuauuuauugcgaagaaugcucaauguaucauucaaaaagaggcauaaaguacaauggugacuucacaaacaaaugcggcuuuugcacaugcaaugaacaagaggauacagaaggauuaguaauacauaaaguuaguaagagaugcacauauaaauaccagcuaaagugggcuaaagugcugaugaucacacuagucuugcuucuaauagcgcaaaacacuauucuaauuguugcagcugaaacagauugcuggacgaaaaaaagccuagauauagacuguauaggaccaaugcuagauauaggcucuugcacaaauaagaauaccagaagcuaugaugcagaagcacagaaauuggugagccagucuaaaauaagucaacuagaugcagaccaagcaucguuguuaggcaacucuauagauagugcuauuaaggcaaucagagcccagaaaacuuacccuacaaugcauuuguuggaaacaauauucuuaaugaaaaauugcgauuauuacacgaguuucaaccauaacaguggcuauucacaagccaaauggcgauugauugcaaaaacaggacacuuugacauaugcuccagacauagcacccaccauuucugccgauguauaaaugauggaaccaaaugucagaauggugauugggauuucgcuggugaaaugaaugaaacuuacaauagcaaaaaugauuuuuauucacaugaucugaauuuguuuuacacaauuuuugaaaaugcauucccaggaacaacugaauccuuauuuuaucaauugauccaaaagaaaaauacuacaggggccuccaaaaucuuggggaaguuaauaacuaaauaugguaauaauaacauggucguuggagucuggaaauuuggacaguacuuacuuacauuaccauauauaaauaauacugaauugagccagaauaggagacuaacaauccuggcaacacaagaacuauuaaguaggucgcacucuggcaggcaggagucuauguccaaugcaauucagggcaguauuacaaaagaaugccauaaugcaaaagguguugggugcauaaguccucgguuugguauuccaauugguaaccuuacagcauguggugacucaccuaauuauaagauauauaagacuccagaaaaauuguauaaaucaaauaauaaaggggaaguuugguguucaaaugauguucacugccugaaugauuuugagccugcagaugaagaaguugucaauaaaauuaagaaacucacuugcuucuuaacagacgucucaguugaaguagacaucuuuucaguggcugcauccacauguaagauggcagacaaaggcgucuguacaguaaauggugcuaaauggaauauaaucaagugugauaguggauuauacuauuuuacagaccauagagaaggccaagacacaggcaaugacuuuggugaguauuguauaucucacaguugcaauacugagcgauucccuaucaacccagacacauuaaaagauuguacuugggaguuccauuccagaaagucuaaauauauuucaaccaucaguuuggaaucauuggaagaauucaggagggcaauggcagagaaguuaucacacacccugacaauuuacaauuuuaaaccaacagcuaaccuuccucauauuaggccaaccuacaaauucauuacagccaauggugucgaaaacucugacgguauugaaucagcauacaucuugucuagcaucccugcauuagguggaauuaguguugguuauaauguucaaaccaaagacaacuucccauuauuggauauaauuguauuuauuaaaagcgcagucaucaggacaacauacaaucauauuuaugauaccgggccuacuauagguauaaacacacaacaugaugagcacuguacggggccgugcccagcuguggugccacauaaagagaauuggaugacauuuucucaggaaagaacaagcagauggggaugugaagaauuugguugcuuggccaucaacacaggguguguuuuugguucuugccaagauauaauacauccagaaacuaaaguauaccgcaaagcaguagaagaggaaguugucuuaacggugugcaucaauuuuccaggcaauaauuacugcacugaaauaaaugccauugagccuaagauaacagaugagauagaacuccaguucaaaacagucgauacaaaaaccuuacccaaccuucuugcagugcagaaucacaagcuuuacaguggccagauaaacgauuugggcucuuuuucacaagguuguggaaauguccaaaaaacaaaucacucaauccuaggcauggguacagucaaauuugauuaugucugucacggcgcuaguaggaaagaugugauagucaggaggugcuacaacaauaauuuugauucaugcaaauuacugaaagaagaaacaucauuaauauuugcagauaaucaugagacucuagagguagcacacacaaagcaucugauaggugaauuacaguuuaagauaauguuaggagauauaagauacaaaucauuugcugaaucaccugaguuggaaauugaugcaaaaugugucggguguccaucauguuuugaaagcuacuccugcaacuuucaaauagugacaaauauagacacugugugcucagucgaagggccaugcacacuauuucauaaucgaauuauuauaucagcuaacaaacagucauaugggcuuaaaaugaguugccaaacaaagccuaaccaaaaugaagaguucauuaucuguaacaggaaauacagugucuuauucacaacaauugauaaaaaugacaaaauagaagugaacacaggggaccagaccucauauauuuaugaaaaggacagcagauguaagacuugguugugcaggguuagagaugaggggaucaguguccuauuugaaccauugaaagcauucuuuggaaguuauuuuagcauaauauuuuauguugucguuggaauuauuguccuuuucuugauuauauacauauuuuugccaauguucuucaaauuaaaagauguuuugaaaagaaaugaauauuuguaucuucaggaacugaaacauaaauga

SEQ ID NO: 4164 - RNA, 4305 nt, Artificial Sequence
  derived and/or modified CDS sequence (wt) from CVV(WI-03BS7669)__KX100152.1__GP
augcuauuccugcucauacuagccuuuuuaggguucucaacaagcaacccuauugcaacuagguguuuccaugggggccaauuaauagcagagucaaagucugcuacaucuauaucagaauucugccucaaggaugaugucucaauguuaaaaucugaagugguauacauaaagaaugauacuggauuguuuggucauaauaaaguuuuccgaagcuggacaauaaaagauuggaaacucugcaauccuauaccuacugcaggaggaacaauaaaugugauugagguuaacaaagaucuuagucuaaugacaaaaacauacauauguaguagagauugcacuauaaccauagauaaagaggaagcucagaucaucuuccaaacagauaagcuaaaucauuuugaagugucuggcacuacauuaaguucaggaugguuuaaaagcaaggcgucugucaccuuggauagaaccugugagcauguuaaaguuacuugugggaagaaaucucugcaauuccaugcauguuuuaaacaccacaugucauguguuagguucuuccacaauaccauauuaccuggcaauaugauaaccucgaugugucagaauauagaauuaauaaucaucuuagggcuaacauuagccauauucauauuaaugguuauucuuacaaaaacuuauauauguuauuuacugaugccaauuuucaugccgauagcuuaucuuuaugguugggccuacaauaaaagcugcaaaaagugcaacuguugugguuuagcauaccauccauuuacuaauugugggucacauuguguuuguggccugaaauuugaggcaucagauaggaugagaauccauagagaaucuggcuugugucaaggguacaagaguuuacgaauugccagacuuuuguguaaaucuaaagggucaucuuuaguuauaucuggauuauugucuauguuaaucuuaagcuuuguaacgccuauagaggggacuauaacuagcuacccagagagcagaaaauauacacuagaagagauaacagauguuguugaaggacugguaucugagcagaauauaaaggaguacauuguuuucuauaccucauuguuugggaguuuaauacuauuauuagcauuuauaaugucuauaacuuuaagcaaaauaacaagcauauuagcaaaaagaaauguuauuuauugcgaagaaugcucaauguaucauucaaaaagaggcauaaaguacaauggugacuucacaaacaaaugcggcuuuugcacaugcaaugaacaagaggauacggaaggauuaguaauacauaaaguuaguaagaggugcacauauaaauaccagcuaaagugggcuaaagugcugaugaucacacuagucuugcuucuaauagcgcaaaacacuauucuaauuguugcagcugaaacagauugcuggauaaaaaaaagccuagauauagacuguauaggaccaaugcuagauauaggcucuugcacgaauaagaauaccagaagcuacgauacagaagcacagaaauuggugagccaaucuaaaauaagucaacuagaugcagaccaaguaucguuguuaggcaacucuauagauagugcuauuaaggcaaucagagcccagaaaacuuacucuacaaugcacuuguuggaaacaauauucuuaaugaaaaauugcgauuauuauacgaguuucaaccauaacaguggcuauucacaagccaaauggcgguugauugcaaaaacaggacauuuugacauaugcuccagacauagcacccaccauuucugccgauguauaaaugauggaaccaaaugccagaacggugauugggauuucgcuggugaaaugaaugaaacuuacaauagcaaaaaugauuuuuauucacaugaccugaauuuguuuuauacaauuuuugaaaaugcauucccaggaacaacugaauccuuauuuuaucaauugauccaaaagaaaaauacuacaggggccuccaaggucuuggggaaguuaauaacuaaauaugguaauaacaacauguuuguuggagucuggaaauuuggacaguacuuacuuacauuaccauauauaaauaauacugaauugagccagaauaggaggcuaacaauccugacaacacaagaacuauuaaguagaucacacucuggcaggcaggagucuauguccaaugcaauucagggcaguauuacaaaagaaugccauaaugcaaaggguguugggugcauaaguccucgguuugguauuccaauugguaaccuuacagcauguggugacucaccuaauuauaagauauauaagacuccagaaaaauuguauaaaucaaauaauaaaggggaaguuugguguucaaaugauguucacugcuugaaugauuuugagccugcagaugaagaaguugucaauaaaauuaagaaacucacuugcuucuuaacagaugucucaguugaaguagacaucuuuucaguggcugcauccacauguaaaauggcagacaaaggcgucuguacaguaaauggugcuaaauggaauauaaucaagugugauaguggguuauacuauuuuacagaccauagagaaggccaagacacaggcaaugacuuuggugaguauuguauaucucacaguugcaauacugagcgauucccuaucaacccagacauauuaaaagauuguacuugggaauuccauuccagaaagucuaaauauauuucaaccaucaguuuagaaucauuggaagaauucaggagggcaauggcagagaagcuaucacacacccuaacaauuuacaauuuuaaaccaacagcuaaccuuccucauauuaggccaacuuacaaauucauuacagccaauggugucgaaaacucugacgguauugaaucagcauacaucuugucuaguaucccugcauuagguggaauuaguguugguuauaauguucaaaccaaagacaacuucccauuguuggauauaauuguauuuauuaaaagcgcagucaucaggacaacauacaaucauauuuaugauaccgggccuacuauagguauaaacacacaacaugaugagcacuguacagggccgugcccagcuguggugccacauaaagaaaacuggaugacauuuucucaagagagaacaaguagauggggaugugaagaauuugguuguuuggccaucaacacaggguguguuuuugguucuugccaggauauaauacauccagaaacuaaaguauaccgcaaagcaguagaagaggaaguugucuuaacggugugcaucaauuuuccaggcaacaauuacugcacugaaauaaaugccauugagccuaagauaacagaugagauagagcuccaguucaaaacagucgauacaaaaaccuuacccaaccuucuugcagugcagaaucacaagcuuuacaguggccagauaaacgauuugggcucuuuuucacaagguuguggaaauguucaaaaaacaaaucacucaauccuaggcauggguacagucaaauuugauuaugucugucacggagcuaguaggaaagaugugauagucaggaggugcuacaacaauaauuuugauucaugcaaauuacugaaagaagaaacaucauuaauauuugcagauaaucaugagacucuagagguagcacacacaaagcauuuaauaggugaauuacaguuuaagauaauguuaggagauauaagauacaaaucauuugcugaaucaccugaguuggaaauugaugcaaagugugucggguguccaucauguuuugaaagcuacuccugcaacuuucaaauagugacaaauauagacacugugugcucagucgaagggccaugcacacuauuucauaaucgaauuauuauaucagcuaacaaacagucauaugggcuuaaaaugaguugccaaacaaagccuaaccaaaaugaggaguucauuaucuguaaccggaaauacagugucuuauucacaacaauugauaaaaaugacaaaauagaagugaacacaggggaccagaccucauauauuuaugaaaaagacagcagauguaagacuugguuaugcaggguuagagaugaggggaucaguguccuauuugaaccguugaaagcauucuuuggaaguuauuuuagcauaauauuuuauguugucguuggaauuauuguccuuuucuugauuauauacauauuuuuaccaauguucuucaaauuaaaagauguucugaaaagaaaugaauauuuguaucuucaggaacugaaacauaaauga

SEQ ID NO: 4165 - RNA, 4317 nt, Artificial Sequence
  derived and/or modified CDS sequence (wt) from CHLV(CHLV-Mex07)__JN808310.1__GP
auggaaccuucaauaaaguuguuccuaauacuugcaauugcugcagcugcuguccacagccuaccugcauccagauguuuuagcgaaggcaucguuauaaaggaaaaacaagacucuaaagcagucagugaguuuuguuugaaggaugauguaucaaugauaaaaucucauguuguauauucuaaaaaugaaucuggaauauuugcaaacagccaaauuuuaaggaaauggauaauaaaagacuggaaacucugcagcccccuaccaacagccggaggccagauaaauguuauugaaauuaaucaugauuuaacauuaucaacaaaaaccuaugugugcacuacagauuguaccauaggcauugacaaggaaaaugcacagauaacauuucaaaccaacaaauuaaauuauuuugaggucucuggaaccacaauuagcucaggaugguucaaaaguaagacaagugugucacuugaccaaacaugugagcaucuaaagguuucaugcgggaaaaaaucuaugcaauuccaugcaugcuuuaagcaacauaugucaugcauuagauaucuacauaggacagcauugccagguuauauggcugcuucaauuugcaguaauauagaguuaauuauuaugaccacauuaacacuggcaauauucauccuacuguguauuauaaccaaaacuuacauuuguuaucuacuuaugccacuauucaugccuauugcuuacauauaugguugguuauauaacaagaguugcaaaaagugcaacuguuguggguuaucuuaucacccauuuacuaauugcggcucuuauugugucugcggggcuaaauucgaaacaucagauagaaugcggauacauagagaaucuggcuuaugccaagguuacaaaagccuuagaguugcccggaaauuauguaaauccaaaggcucaucacuagugauaucaaucacccucucuguauucauauucucauuuauuacaccaauagggggugcuauuauaaaugauaaauuaucagaagaaaaguacagcauaaaucaaaugauggaugcuaucguagaccuugaaaacuucucucauaauguuucaggcacacaacaaguuauuucaguaauauucuuauuaauauccuguuuguuuuuguuauuaacauaccaccucaauaaaauuauacagcacuuagcuagguuuggcuuauuauuuugugaagaauguuccauguaucacucaaaaaaagauauaaaauauaauggggauuucacaaacaaauguggcuucuguacauguggucaaccagaagacccagaaggcuuaaaccuucauauacugucacaaaacugcacauauaagcagcaauuuaaaugggugaaaauaauuauuaguauauuacuaucucuaauaauuauagaaaauaguaugauacuggcagcagcagagacagauugcuucucugaaaagcaaauuucagaauucugccuaggaccauugcugucaauuucaagcugugaagauaagaauucuaggacauuuaaaggugaagcacaaaaacuaguagcacugaagaaaauaacuuccgaugaagcaauguugauugaaucaaugggugccaacguggagggugcauuggaaaugauacaagcucaaaaguccccggacucuauguauacuauggaguauguguuccuaaauacauauugugauuauuacucucuuuuugagcacaacagcgguuauucacaaguaaaauggcguuauauccuuaagacacaucaauuugaugcaugugcaaggcauucuaacagccacuuuuguagauguaugagugaugggaugcauugucccagcucggauugggauauagcagaugaacuagauaacacauauauaacaaaaccaaauuucuuuaagcaugauuacaaucuauuauuagauguaauaacugcagcauuuccaggaacaggugcuguuuuuguaauugaugcuuguaagaaagcaaaugcuacagcaaucaagacuuucucuaauaauauuauagcuagauuuccauauaacaacuuacuaaaaggaguaaugaaauuccugcaguauauaaguaagcauccaucuuuuaaaaaguaucaaccagauacacggcacuaugaccuaaucccaguagcacccacugcaagagguaggucucuaggaaggucaaauaguuacaauaaugcacagauugguuccccaacaaaagauugccaaaugcugaaagaaguugguugccuaagcccaaaauuuggucugccucuagaaaguauuauaucuugugguucaucaccuaacuacaaacuauauaaaaaaccccaaaaauauuacaaaucaaacaacaaagaaaacacuuggugcagcaaagauguacauugccuccaugacuuugaaccaauaacagaggauguuuuagaaaaaguaaaagucaugacauguugggagauagaaccaggaacuauugaagacaucuucaccauugcaucagagaccugcaaaaucaaugaucguggcguaugugaagugaaugcagcaaaauggaagauugugaagugugagacaggucucuacuauuacacugaccauagagagggugaugauacugggucagauuuagggcacuacugccugacgcauaagugugcagggggaagauauccuaucaauccugaaauuuuacaaaacuguguuugggaauuucauucgcagaagucgcaguauaucaaucaaguugaucuugagcaaauagaagaauacaaaaaggcccuaacagagaagcuaacucauacuuuaaaucauuauaauuuuuuaccuacuaagaaucucccacauaucagcccuaauuauaaauauguaacccugaauggccaagaaaccucugauggcauagaaaacucuuacauagugucagagauaccugcaauugcagguacaucaauuggccucaaaguacaaacaaaaacuaaugacgacauauuugaccugauuauauauguaaagagagcugauauuauugcaagcuauaaucauauuuaugacacagggccaacuauuggccacaauguagaacaugaggaguuaugcacaggccaauguccucaacauauaccagcuaaagccaauuggcucacauuuucucaggaaagaacaaguagaugggggugugaagaauuuggcugcuuggcuauaaacacaggcuguguguauggcuccugccaggauauuauaaaaccaguggcaaaaguuuacaggaaauccacagaagaaaaaguugaacuugaguuguguauaguauuaccagauaagaauuuuuguacuacucuaaaugcauuagagccuaagauuacagaagagauagagcuacaauucaaaacuauagaucaaaugagccuuccuaauauaguucuacugagagaccauaagcuauuuaagggccaaauuaaugauuuagggaccuuugggcaaaacuguggcaauguucaaaaaacuaaccaaaguaucuugggagccgguacaguuagauuugauuaccuaugccauagugcauccagaaaagauauaaucauacggaggugcuacaauaauaacuaugauucauguaaucauuuacaacuugcagaaucuuuaauuuuucuggacaaucaugaaacacuagaggucaggaaaccaaaccauauuuuaggaacccugucaaugaaauuaaugcuaggcgauuuucaauauaaaacauuugcuaaggacauagagcuugauuuuacugguagauguguuggguguaucgguuguuuugaaggguuugucugcgagaugcauauuacgacaacuguagaagcaaccuguaaucuagaggcuucaugccaauucuuucauaaccaacugcauauuaaaccagauguacugaaguacuauacaaagaugacaugccaaacugaugaguauauaccaucaaagaucaaaauaugcaauaaagaauacaaaaucacuguuggaaaaguccaaaaaaaugauaaaauugaaauagauaauagugaucagaccaguuauauaaaagaaaaagaugagagguguaaaacuuggcucugccgaguuagggaugaagggauaucaguaaucuuugagccauugcuaaauauauucggcaacuauggaaggauugcaguugcagucauuagugcaauauuggcauugaucauacuaguauacaucuuaaugccaauauguaugagaauaagagauauacucaagacuaaugagagggaguuucuaauugaaucaaaauacaaguag

SEQ ID NO: 4166 - RNA, 4305 nt, Artificial Sequence
  derived and/or modified CDS sequence (wt) from FSV(86MSP18)__KX100131.1__GP
augcuauccuugcucauacuagcccuuuuagggcucucgacaagcaacccuauugcaacuagauguuuccaugggggucaauuaauagcagagucaaagucugcuacaucuauaucagaauucugccucaaggaugaugucucaauguuaaaaucugaaguaauauacacaaagaaugacacuggauuauuuggucauaauaaagucuuuagaagcuggacaauaaaagauuggaagcucugcaacccuauaccuacugcaggaggaacaauaaauguaauugaggucaauaaagaucuuagucuaaugacaaagacauacauauguaguagagauuguacuauaaccauagauaaagaggaggcucagauuauuuuccagacagauaagcuaaaucauuuugaaguauccggcacuacauuaaguucaggaugguuuaaaagcaaggcaucuguuacccuggauagaaccugugagcauguuaaaguuacuuguggaaagaaaucucuacaauuccaugcaugcuuuaaacaccacaugucguguguuagguucuuccacaauaccauauuaccuggcaauaugauaaccucaaugugccagaauauagaauuaauaauuauuuuaggauuaacauuagccauauucauauuaaugguuaugauuacaaagacuuauauauguuaucuacugaugccaauuuucaugccgauagcuuaucuuuaugguugggccuacaacaagagcugcaaaaagugcaacuguuguggucuagcauaccauccauuuacuaauugugggucacauugcguuugcggcuugaaauuugaggcaucagauaggaugaggauccauagagagucuggcuugugucaaggguacaagagcuuacgaauugccagacuuuuauguaaaucuaaagggucaucucuaguuauaucuggauuguugucuauguuaaucuuaagcuucguuacaccuauagaggggacuauaacuaauuacccggacagcaggaaauacacauuggaagagauaacagauguuguugaaggauugauaucugagcagaauauaaaggaguacauuguuuucuacaccucauuguuuggaaguuuaauacuguuauuagcauuuauaaugucuauaacuuugagcaaaauaacaagcauacuagcaagaagaaaugucauuuacugcgaagaaugcucaauguaucauucaaaaagaggcauaaaguauaacggugacuucacaaauaaauguggcuuuugcacauguaaugaacaggaggaugcggaaggaguggugauacacaaaguuaguaagagaugcacauauaaauaccaacuaaagugggcuaaagugcugaugaucacacuggucuugcuucuaauagcacaaaauacuauucuaauuguugcagcugaaacagauugcugggcaaaaaaaagccuagauauaaacuguauaggaccaaugcuaaauauaggcucuugcacaaauaaaaauaccagaagcuaugauacagaagcacagaaauuagugagccagucuaaaguaagucaauuagaugcagaccaagcaucacuauuaggcaguucuauagauagugcuauuaaggcaaucagagcccagaaaaccuauccugcgaugcacuuauuggaaacaauauucuuaaugaaaaauugugauuauuacacgaguuucaaccauaacaguggcuauucacaagcaaaauggcgauugauugcaaaaacaggacacuucgauauaugcuccagacauagcacccaccauuuuugccgauguauaaaugacggaaccaaaugccagaauggugauugggauuuugcuggugaaaugaaugaaacuuauaauagcaaaaacgauuuuuauuugcaugaucugaauuuguuuuauacaaucuuugaaaaugcauucccaggaacaacugaaucuuuauuuuaccaauuaauccaaaagagaaauacuauaggggccuccaaagucuuagggaaguuaauaacuaaauauggugauaauaacauguuuguuggagucuggaaauuuggacaguauuugcuuacauuaccauacauaaauaacacugaauugagccagaauaggaggcagacaaucuuggcagcacaggaacuaucaaguagaucacacccuggcaggcaggagucuauguccagugcaauucagggcagcguuacaaaagaaugccauaaugcaaaagauguugggugcauaagcccucgguuugguauuccaauugguaaccuuacagcauguggugacucacccaauuauaagauauauaagacuccagaaaaguuguauaaaucaaauaauaaaggggaaguuugguguucgaaugauguucacugccugaaugacuuugaaccugcagaugaagaaguugucaacaaaguuaaaaaacucacuuguuucuuaacagaugucucgguuaaaacagacaucuuuucaguggcugcauccacauguaagauggcagauaaaggcguuuguacagugaaugaugcuaaauggaauauaaucaaaugugauaguggauuguacuacuucacagaccauagagaaggccaggacacaggcaacgauuuuggcgaguauuguauaucucacaguugcaauacugagcgauucccuaucaauccagacauauuaaaagauugcaccugggaauuccacuccagaaagucuaaauauauuucaacuaucaguuuagaaucauuggaagaauucaggagggcaaugacagaaaagcuaucacacaccuuaacaauuuacaauuuuaaaccgacagcuaaucuuccucauauuagaccaaccuacaaauucauuacagcaaauggugucgaaaauucugacggcauugaaucagcauacaucuugucuaguaucccugcauuagguggaauuagcguuggcuauaauguccaaaccaaagacaauuucccauuguuggauauaauuguguucguuaaaagugcagucaucaggacaacauacaaucauauuuaugauacuggaccuacuauagguauaaacacacaacaugaugagcacuguacagggccaugcccagcuguggugccacacaaagaaaacuggauaacauuuucucaggaaagaacaaguaggugggggugugaagaauuugguugcuuggccaucaacacuggguguguuuuugguucuugccaagauauaauacauccagaaaccaaaguauaucguaaagcaguagaagaggaaguugucuuaacagugugcauuaauuuuccaggcaauaauuacugcacugaaauaaaugccauugagccaaaaauaacagaugagauagagcuccaguucaaaacagucgauacaaaaaccuuaccuaaucuucuugcagugcagaaccacaagcuuuacaguggccagauaaacgauuugggaucuuuuucacaagguuguggaaauguccaaaaaacaaaucauucaauccuaggcauggguacugcuaaauuugauuaugucugccauggcgcuaguaggaaagauguaauagucaggaggugcuacaacaauaauuuugauucaugcaaauuacuaaaagaagaaacaucacugguauuugcagauaaucaugagacucuggagguagcacacacgaagcaucugauaggugaauuacaguuuaagauaauguuaggagauauaagauacaaaucauuugcugaaucgccugaguuggagauugaugcaaaaugugucggauguccaucguguuuugaaagcuacuccugcaauuuucaaauagugacaaauauagacacugugugcucaguugaagggccauguacacuauuucauaaucggaucauuauaucagccagcaagcaaucauauggacuuaaaaugaguugccaaacaaagccuagccaaaaugaagaguucauuaucugcaacaggaaauacaguguuuuauuuacaacaauugauaaaaaugacaaaauugaagugaauacaggggaccagacuucauauauuuaugaaaaggacagcagauguaagacuugguuauguaagguuagagaugaagggaucaguguccuauuugaaccauugaaagcauucuuuggaaguuacuuuagcauaauauuuuauguugucguuggaauuauuguccuuuuuuugguuauauacauauuucugccaauguuuuucaaauuaaaagauguuuugaaaaaaaaugaauauuuguaucuucaggaacugaaacacagauaa

SEQ ID NO: 4167 - RNA, 4314 nt, Artificial Sequence
  derived and/or modified CDS sequence (wt) from GERV__M21951.1__GP
auggcuaucucaacaucacuguugauuguugcccuucuaaucaaguuguguuuggucaacacugcuccaccaaucucaaaaugcuuccaagaugggauucugauagcagaacuaaagagcucaucuggaauaucagaauuuuguauaaaggaugauauaucuauccugaaaucagaaaucacuuacucaaaaaaugacacaggcauauucaugcauaguaagguauuuagacauuggacuguagcagacuggaaacaaugcaaccauacuucugcuggugguagcacuaaugugcuagaaguugauaaaaauuuaaauuuaguugcgaaaaacuauaugugcacaaggccaugugucauaacaauugauaaggagaaugcucaacuuuuguuccagacagagcaauugaaucaauuugaaguaacaggcacaacuauaagcacuggcugguuuaaaucaaaaacaucggucucacuagacaacacaugugaacauauaaagguaacuuguggaaaaaagagccuacaauuucaugcaugcuucaaacaacauaugucuuguguucgcuucuugcauaggaguguuuuaccuggguacauggcaaguuccauaugucaaaauauagagcucauaauuauuauuauuuuaacgcuggcaauauuuauauucaugugcauuauuacaagaacauauauuuguuacuugaugcuccccuuauuugcccccauugcauaucuauacgguuggcuguacaacaggagcugcaaaaaaugcauauguugugggcuugcuuaucacccauucacaaauuguggcucauauugugucugcgguucuagguuugaaacaucugauagaaugcgacuacauagggaaucgggguugugucaaggauucaaaucacucagagucgccagaucacuaugcaaaucuaagggcucuucucuuguuauuucuauacugacagcuauguuaauauugucauuuauaacaccacucgaagcaaugaccacgaacuacccugaugauaaaaaauuuacacuuaaagaaguaaaugauauuguccuuggcagagauauggagcaagaguuaaaaucuucgauauugauuuuaauguccauauguggaauagggauuauacugauauucuucggcuuaacuguacucuuggagauuguacuagagcuaauugcaaagaggagcacaauauuuuguaaagaaugcaacuuaauacacgacaagaaaucaaugacauacaggggcgauuuuacuaauaaaugcgguuuuugcccauguggagaauuagaggacccagagggguuagugauucacacuacaaggaaaucauguacauauuauaucaagauaaggaaucuuaaacuaauaaugcuaaucuucucaauuguaauuuugaugcaaaaugcaacuaugcuuguaguugcuggugagaacugcuggacaaauacagagauuaaagcugacuguguugggccuuugauagggccaucagcaugcacaaacaaaggcucaaaaacauacaagacagucgcacaagaauuagugacugcaagcaaaauuacacaacuagaugcugauaaauaugucuugcuaggagauacuauagaaagugcccuggaugcuauaacaagccaaaaacauuacucggcaaugcaccuauuagagacaauguucuugaugaagcauugugauuacuacaaaguguaugaacacaauaguggcuacucacaaacaaaguggagacuaauugcaauagcaaauaguuucgauauauguacuaauacaccaacaccaaacuuuuguaaaugcuugucagauuccaguugcucaacaacuacgcuaaacuuugccacaucaaugaaugccacauauacgagcaagguagaauucuuuaaccaugacuucacacuuuuccuggacauuuuugaggcugcauucccagguagugcuacugcauuccuuuuuaaaaagauuaaagaaaagaacccauaccaggcauuugaaaugauggggaaaaucgcuaauaaauauccaaacaauaagcuauugguuguuauucuaaaauauggucaauauaugguuggccugagccaugcaucuacauaucaauugaaacaagaauggguugccaaaucacugagcuuaacuagagcacagagaacuggccuaaaaauguccauggcuaacgcugaaccagguccugccacuaaagaauguucagaugcaaagacaauugcuugcuugaccccaaaguuccaaguagaagucaauaaucucaugagcuguggugcaucaccaaauuucaaaauuuauguuaaaacaggugaauuguacaaggcucaugauaggaauucuguaugguguuuaaaugauaugcauugucuaaccccuuacacaccagcaaaugcagaaauaauuacgaccaugaaaaaaauggacuguuggcaggacaacccgaaacaaccuacagaugaauaugcuaucccuaagaggagcugccagaugaaagacaggggcuuaugcaacucaggugcagacaaauggaagauaauaaaaugugacaaucauaaacucuucuauacagaugcacuagagagacgugauccagcuagcauaguggguuccaaucacugcuucucagaaaaaugccaaauagagagguacccaaucaacccaacuagcuuaacaaacugcgagugguuguacagggcuguuaggcccgaauacauuaaaaaacucucuuugcaaacuauugaggaauauaaaaaagcuauugcagauaaacuaacacauacacugcaacuauaccauuuugccccauuauuagagaaccugccacacauaaaaccaacguauaaguauaucacagcacaaggaacauauacagcagaugguauagagggugcuaguaucacaacuucgauaccugccuugagcggcacuaguguaggauucaaaauaaaugcuaaggauggaacugaccuucuagacauuguuguuuacauaaaggcuucaguugucaaaaguauuuacaaccauauauaugacacagguccaacaaucaauauaaauucaaaacaugaugagcuaugcacuggucaaugcccaaaaaagauaccugcugacccaaauuggcuuacauuuucucaggagagaacuagcagauggggcugcgaggaauuuggcugccuggcuauaaauacuggauguguuuaugggucaugucaggaugugauuaggacagaaacaaaaguauacaggaaagcaaaugaggaaacugucaugcuaacagugugcauaacuuauccuggccacacauuuuguacugauguaaaugcccaugaaccaaaaauaacagaugaauuagaauuacaguucaagacaauugauaucaagaguuuaccgaaccuaguagcagucacuaaucauaaauuguauacuggacaaauuaacgauuuagguacauuuggacaaauguguggcaauguacaaaagaccaacacaagccacacuggugcaggaacaccaaaguuugacuacacuuguuauagugcaagcagaaaagauaucauaaucaggagauguuauaauaauaauuaugacucauguaggcuuuuaaaucaagagagugaucucuuauucgacgacaaucaugaaacuuugguuguauauaauaacaagaggcugaauggagaauuagcucucaaguuauugcuuggagauauucaauacaaacuuuauacagaaaacauggagcuagaguuggaagcuaaguguguugguuguguagggugcuuugagaguuaucaaugcaauuugcagauaacaucaagccuagacgaaacugcgcuauaucuggucccugugagccacuuucaugauaggauucaaauuaaaacuacaaagaaagauuacgcuaugaaaauaucgugcacuagagacccaggagauaaagcaucauucagagugugugggaagaguuaugacuuuaauuuucauacaguaccaaagaaugacaaaauagaaguuaauguuggggaugagacaucauauaucaaagaaaaagacaauaggugugggagaugguuauguagaguucgagaugagggauugaguguuauauuugaaccauuaaacaauuucuuugggaauuaccucaauauguuuuuauauauauugggugguaucauacuacuauuucuggcccucuauauacugaugcccaugugugcuagauugagggaugagcuaaagagaaaugaaaggcuacaucagauggaaaugaagaagagauaa

SEQ ID NO: 4168 - RNA, 4260 nt, Artificial Sequence
  derived and/or modified CDS sequence (wt) from IACOV(BeAn314206)__JN572066.1__GP
augaggguuauugcauuguuucacuuagugaugguuauuacagccaauccaguauuucacagaugcuuccaaggggggcaauuaauuuuggagaaaaaaucacaugugucuaugucugaauuuugccugaaagaugaugucucaaugguuaaaucaguuguagaauaugaaaagacaaacaauucuauaguagggacaaauaaaguuuauagacaauggguuguuucagacuggaagcuuugccacccuauuaaagcagaaggugggggaaucaauauaauagaaguagaaaaggauuuaacuaucaaaucuaauacauauauauguacaacagacuguacaauaacuguugauaaagaaaaugcacaaauaauauuucaaacaucaaaauuaaaucauuuugaaguuacaggaacuacauuaaguacuggaugguuuaagacaaaagcagcagugacauuagaucaaacaugugaacauauaaggguuucuugugguaaaaaaucuauacaauuucaugcauguuuuagacaacauaugacaugugugagauucuuacacagaagccuucuaccaggaucuauggccaauucuaucugccaaaauguagaauuaauaauaauaauuguguuaacauuauuaaucuuuauuguuuuaaauauaauagcaaagacuuacauuugcuaucuaauguugccaauauuuaugccuauugcuuauauauauggcuggauauauaaucguagcuguaaaaaauguguuaauuguggguuagcauaucauccauuuaguaauuguggaucacauuguguaugcggagcuauauuucaaacaucugauaggaugcguaugcauagagaaaguggcuuauguucugguuucaaaucucuacguguugcaagaguuuuauguaaauccaaaucaucuucauugguuauugccauauuaagcucacuauuaaucuuaucauuuguaaccccaauagaaggauuggauuuagaagaaaagaaauauagcuuaucugaucugccagauauuuacacaaaagaauugaacacauuaucagaaaaaauugcuauaaauuuuuauauaucaaucacaaauauguuaauaacaauaauucuuuuaauuguagcauuuuguucacacuguauuacaaauaagauaguaaaauauaaagccuuuuuauguacagaaugugauauguaucauacauauaaaaauauuagguacaauggugauuucugcaauaaaugugggagcugcacauguggaacaauggaggacccgaauuacacaacuaugcauaagguaagugaucuuugccuagcagaaccuaagagaauuauucaaaaaaagcuaaugauuaucuuaaucauauuuguaauuauugaaaauggagccuguuuagcaucugcagaagaaaaauguuucaaagaacaugauuacaauauugaauguauuggaccucugauaacaaugagaccauguacaaaaaagacaauccaagaaguugcuagaacauuggugacugacaaacaaauagcucaagaagacacagagaaaauagaauuauuaccagauucaauuguacaagcuuggaauaugauagauaaucaguuaaauuaugaucagauguuucugauggaauaugccuuucuaaagagagaaugcucuuucuuugaggaauuugagcauaauaguggaguaaaucaaauuauguggagaacaauagcaaaaacuggacauuuugacauuugugcaaucagaucuagucaaagauuuugcaaauguaugucagagucaguuuacuguaaagaugcaaauugggauauagcuaaugaaaugaaugauacauauuccuuuaagccauuauucuaccgacaugauguaaaauuauauaguaagauauuuaaggcagcauuucaaggaacaacacugaaaacuuaugaaaaauucuugaaugccaaaaacaaaacagaauuaauaaauaugcugaaaaaguuagggaaaagguuuccuuauaacaacuuacuuaugggguuuuuaaaauuuggugaacugcuauuugauuuaacucuguuugaugcauugccuaaggauaaaacaucuagaacuucaucaaccacagcaaaacgagaguaugaaaaccugcaagaugcaaaagucggagagccaacuagugaauguaaagauaugaaauuauuacaaugcauaagcccaagauaucagguaucaguagggaguguuauuaaauguggagauacagagaaaaagauauaugacuuccauacuccaguuuacaaacuugcaacugaugaaacaaagugguguagauuugacaaacauugcuugcaugaauggguaccuauugacaaugcaagauuagaaauguuaaagaaguuaaauugcugguacacagauccaacagaaaugguugauauauauaccacaucuagaaagucuugcagaaugauaaauaaggguacaugcaacauaaaaaaugcaccaaugacaguaaugcaaugugaugaugaucuuauuuuuuauacagaucacaggucaagugcugauacccaaggagauauaggagaauauugucuaucacaaaauugugauguaagcagauauccuauaaauguaauggauggaaugaccugcacaugggaauauaauacaguuaagccuaaauaccuaucaaaaacagaacuaaaaacucuugaagaauauaaacgaacauugcaagacaagcuaagccauaauuuagaagucuaucauuuucauaugacugcaaauuucccucacauaaaaccuguguauaaguauauaacugcaggugguguugaaacaagugauggaauagaaggagcauuuauauuaguugaccuaccugcuuuaucuggaacaucugucgggcucacaguauuaucuaaagaugauguaccauugauggauguuauaauauauauaaaaucugcagugauaaaagccacauauaaucauauauaugauacaggaccuacaauuggaauaaauguuaaacacgaagaauugugcacaggaccuugcccucaaaacauaccucaucaagagcagugguuaacauuuucacaggaaaggacuagccgaugggggugugaagaauuugggugcuuggcaguuggagaaggauguguguauggaucuugucaagacauuauaaagaaagaaacucgaguauauaaaaaagugagugaagaaauaaaugaaaucacauuuugcauaauauuucagacaaauacauauugucagacaaugaaugcaauagagccucaaauuacaccuucacuagaaguucaacuugaaggauuagacacuaagauauugccaaauauauuagcacugcaaaaucacaagcuuuacucuggucaaauaaaugauuuaggaucguuuggucuugcuugugggaauguucaacaaguaaacaaaacaauauacggugcagggcaaccaaaauuugauuauuugugucauggagcaaagcguaaagacauaauuguucgcaagugcuauaacaauaacuuuggcucuugcaaauugcuaacaauugaagauaauuuaauaguggaagauaauuauaauacaauaaauguuauaaauacaaaacauuuaauugguacaguuaaaucuaaacuuaauuuaggagacauaagauauaaauuauucaauaaaaaaccugaguucgagcuagaagcacauuguguagguugugugggauguuuugcaaauuauaauugugaaauaaaaauugaaaguacaauagauaugacaugcccaaucucugggccgugugaguucuuccauaauaacaucuucauacaagcugaacauacaaaguaugccaugaagaugaucuguaagaagcaaccagaucaaacaacagaauuuacuauaugugauaaaaaguaucauuuuaucauugauacaguugaaaaacaugaucaaauugaaauagaugucggggaucagacaaguuauauucuggaaaaagacaacagaugugggacauggauguguaagguuuuagaugaaggacuaaguguaauuuuugagccauugaaauuauuguuaggaaauuacuuccauauggccauaguuauuauaauagguuuaauugcacuagcaguaauuauauauaucuuguugccaauguucaugaaauuaagagacacucuaaaggcaaaugagauugcuuaccaaaaagaaaugaaaauaaaauaa

SEQ ID NO: 4169 - RNA, 4305 nt, Artificial Sequence
  derived and/or modified CDS sequence (wt) from ILEV(KO/2)__AY859372.1__GP
augcuauuucccauaauuuuacugaugauacagcugguaucuucaacaccauugucaacaagguguuuccaugagggaacuuuggucaaggagaagauaucaacuacauccaucucagaauucugucucaaagaugaugucucaaugauuaaaucagagauaacauaccaaaaaaaugauacagggguauauggccauaguaaaauuuauagaaauuggauaguuaaagaauggaaagcaugcaacccagugccuucagcaggaggaaguauuaaugucauagaagugaaugaagauaugaguuuggcaacaaaaaauuauaucugcaccagagauugugugauaacaguugacaaggaagaugcucaaauaguuuuccaaacagauaauuugaaccauuuugaagugucagggacuacauuaaguucuggcugguuuaaaacaaaagcaucuguuacauuagauagaacaugcgaacauauuaaaguuucuuguggcaaaaaaacaguacaauuccaugcgugcuucagaaaucauaugucauguguaagauuuuuccacaauacuauucugccuggauacauggcaacaucaauaugucaaaauauagagcuaauaauuauaauuguauugacuauagcaaucuuuauuauguuaguuaucuugacgaaaacuuauauauguuauuuauuaaugccacucuuuaugccuauugcauacuguuauggcugggcauauaauaaaagcuguaaaaaguguaauugcuguggccuugcauaucacccauuuacuaauugugggucauucuguguaugugguuugaaguuugaagcaucagauagaaugcgaauacauagagaaucuggccuuugccaagguuauaagagucuaagaguagcacgaaggcugugcaaaucaaaaggcucaucuuuuguuauaucuauccuucugucauuguuuauuuuaucauuuguuacaccaauugaagguacaaugacuaauuauccugaggaaaggaaauauacacuagaggaaauagcagauguuauagaagguuucuaccaagaagcuaagauaaaagaauauauuguuuuuuauagcucgauuuuuggcucauuuauuuuaauuuccucaaugcugauauuguauaaacuucaaaacauaacauauuuucugagcaaauucaacgugauguauuguucagaaugcagcauguaucauagcaagaaaaauauaaaauaucugggugauuuuacuaauaaauguggcuucugcacuuguggugaauuggaagaugcugaaggauuaaguauacauaaagugacaaaaagauguacauaugcauaucagaugacauggacuaagauaauacuagcaacauuguuaauucuauuaauuggucaaaacacgcugcugguuguaucugcacaagcagauugcugggagaaaacagaaaucacaauagacuguauaggcccaauauuugcacccaauacauguauuaaacaagaagaaaaaacauaugcaaaagaagcacaaacacuuguugaucagaauaaaauaucacaagcagacgcaaaacaaguugacauguuaggggcaacaauugacgaugccaucaaggcaaucaggucacagaaaacauacacaacaaugcauaugcuggaagccauauuccugaguaaauacugugauuauuacagucuauuugaacauaauaguggauauucucaaggaaaauggagacugauugcaaaaacagagaguuuugacauuuguaguagacacacuacucaucauuuuuguagaugcaugagugaugagacaaaguguaagaauggugauugggacuuugcuggagaaaugaauucaacuuaucacaguaagagcaacuuccuacuacaugacuuaagauuauuuuacaaaauauauagugcagcauuuccaggauuaucagaagcaaugcuuuauaaauuuuuaucagaaaaagauacaacaaacgcaauaaaauuauuggaaaaauuauucacaaaauauagcuacaauaauuuauugguagggauauuaagauuuggaaaauuuuuauuuagcaugucaauuuucaauacuacugaauuggguggugcucaaaaagcaaugauauugagaccuacugaugaacuaagaaccacauauucugguaagcaagaaucuuuaucaaauucaguuguuggcgaacaaacaucggauuguguaaacaugaaaaaaauauccugcauuaguccuagauuuaauauuccuuuaucaaguaugauagcauguggaaaccaaccuaauuaccaaaucuauaaagaaccuucuaaauauuauaaaucuaauaauaagcccaacacuuggugcaauaaagauauacacugcuuaaaugauuuugagucaauugaccaaucagcccuugauagauuaaaaacaaugacaugcuuccuaauagauccuaucacaacugaagauguauauucuauugcuauucauaguuguaaagucaaagauaaaggacaguguacaauaagagacaaaaaauggaauauuauaaaaugugacagugaacuauuguauuauacugaccacagagaaggagaagacacagggaaugaaauuggccauuauugucuaagucauaaauguggaacagacagauacccuauaaauccagaaauuauuaaagauuguaucugggaauucagaucgagaaaaucagaauauauaaauagaguagacuuggagagcuuggaagaauucaaaagagcuuuaucagauaaguugacacacacuuuaaccauuuauaacuuuaaaccaacugcuaauuuaccucauauaaagccaauuuauaaauauauuacugcucugggaguagaaaauucugauggccucgaggcugcauauauauuaacaaguauaccagcauuaggaggaacaaguauugguuauaacauuaugacgaaagacaauuucccgguaauggauguuauaaucuauguuaagagugcuguaauacaaacaacuuacaaucauauauaugauacaggaccgaccauaggaauaaauucaaaacaugaugaaaaaugcacagggucauguccucaaaauauaacacaugaccaaaauugguuaacauuuucacaagaaagggcaagcagaugggguugugaagaauuugggugucuagcaauaaauacagguuguguauuuggcucuugucaagacaugauaagaucagacacaaagguuuauaaaaaggcauuagaagaaacaguaguuuuaacuguuugcauaaacuacccugguaacacauuuugcacugaggucaauucuguagagacaaaaaugacagaugauguugaauuacaauuuaaaacaguugauacuaagacuuuaccuaaccuccuugcaguuacuaaucauaaauuauacaguggccaaauaaaugacuuagggucauucagucaaaugugugggaauguucagaagaccaauucaacuguaaugggugcugguacagugaaauuugauuacauaugucauggugcaaguaggaaagacauaauuauaagaagguguuauaugaauaauuacgcaucauguucuuuauuaaaggaagaaaaagauuugaucuuugcagauaaucaugaaacaauaacaguaucuaauucaaaacaucuugugggagaauugcaaauuaaauugauguuaggugauauucgguauaaacuauuugcagagagaccagaguuagagguggaugcaaaauguguaggauguccuucauguuuugagaguuauuccuguaauuuccaaauagucacaaauauagauacuguaugcacccuugaaggcccuugcacuauuuuccauaacagaauuauuaucaguucuacaaagcaaucuuaugguauuaagaugaguugccccacaaaaccaaaucacauagaaaaauucaaaaucugcaaucaugaauaugauauucuauucgauacaguggcaaaaaaugauaaaauagagauugauacaggagaucaaacauuauucgugagggagaaagacaccagguguaagacuugguuauguagaguaaaagaugaagguauaaguguuaucuuugagccuuuaagagcuuucuuuggaaguuacuucaguauuauuuuuuauauuauucuugcugcaauauuaauauuuguggguguuuauauauuuuuaccaauguuuaugagauuaagagauguucuuaaaaggaaugaacauuuauauuugcaagagauaaaacauaaauaa

SEQ ID NO: 4170 - RNA, 4305 nt, Artificial Sequence
  derived and/or modified CDS sequence (wt) from ILEV(R5964)__KF234074.1__GP
augcuauuucccauaauuuuacugaugauacagcugguaucuucaacaccauugucaacaagguguuuccaugagggaacuuuggucaaggagaagauaucaacuacauccaucucagaauucugucucaaagaugaugucucaaugauuaaaucagagauaacauaccaaaaaaaugauacagggguauauggccauaguaaaauuuauagaaauuggauaguuaaagaauggaaagcaugcaacccagugccuucagcaggaggaaguauuaaugucauagaagugaaugaagauaugaguuuggcaacaaaaaauuauaucugcaccagagauugugugauaacaguugacaaggaagaugcucaaauaauuuuccaaacagauaauuugaaccauuuugaagugucagggacuacauuaaguucuggcugguuuaaaacaaaagcaucuguuacauuagauagaacaugcgaacauauuaaaguuucuuguggcaaaaaaacaguacaauuccaugcgugcuucagaaaucauaugucauguguaagauuuuuccacaauacuauucugccuggauacauggcaacaucaauaugucaaaauauagagcuaauaauuauaauuguauugacuauagcaaucuuuauuauguuaguuaucuugacgaaaacuuauauauguuauuuauuaaugccacucuuuaugccuauugcauacuguuauggcugggcauauaauaaaagcuguaaaaaguguaauugcuguggccuugcauaucacccauuuacuaauugugggucauucuguguaugugguuugaaguuugaagcaucagauagaaugcgaauacauagagaaucuggccuuugccaagguuauaagagucuaagaguagcacgaaggcugugcaaaucaaaaggcucaucuuuuguuauaucuauccuucugucauuguuuauuuuaucauuuguuacaccaauugaagguacaaugacuaauuauccugaggaaaggaaauauacacuagaggaaauagcagauguuauagaagguuucuaccaagaagcuaagauaaaagaauauauuguuuuuuauagcucgauuuuuggcucauuuauuuuaauuuccucaaugcugauauuguauaaacuucaaaacauaacauauuuucugagcaaauucaacgugauguauuguucagaaugcagcauguaucauagcaagaaaaauauaaaauaucugggugauuuuacuaauaaauguggcuucugcacuuguggugaauuggaagaugcugaaggauuaaguauacauaaagugacaaaaagauguacauaugcauaucagaugacauggacuaagauaauacuagcaacauuguuaauucuauuaauuggucaaaacacgcugcugguuguaucugcacaagcagauugcugggagaaaacagaaaucacaauagacuguauaggcccaauauuugcacccaauacauguauuaaacaagaagaaaaaacauaugcaaaagaagcacaaacacuuguugaucagaauaaaauaucacaagcagacgcagaacaaguugacauguuaggggcaacaauugacgaugccaucaaggcaaucaggucacagaaaacauacacaacaaugcauaugcuggaagccauauuccugaguaaauacugugauuauuacagucuauuugaacauaauaguggauauucucaaggaaaauggagacugauugcaaaaacagagaguuuugacauuuguaguagacacacuacucaucauuuuuguagaugcaugagugaugagacaaaguguaagaauggugauugggacuuugcuggagaaaugaauucaacuuaucacaguaagagcaacuuccuacuacaugacuuaagauuauuuuacaaaauauauagugcagcauuuccaggauuaucagaagcaaugcuuuauaaauuuuuaucagaaaaagauacaacaaacgcaauaaaauuauuggaaaaauuauucacaaaauauagcuacaauaauuuauugguagggauauuaagauuuggaaaauuuuuauuuagcaugucaauuuucaauacuacugaauuggguggugcucaaaaagcaaugauauugagaccuacugaugaacuaagaaccacauauucugguaagcaagaaucuuuaucaaauucaguuguuggcgaacaaacaucggauuguguaaacaugaaaaaaauauccugcauuaguccuagauuuaauauuccuuuaucaaguaugauagcauguggaaaccaaccuaauuaccaaaucuauaaagaaccuucuaaauauuauaaaucuaauaauaagcccaacacuuggugcaauaaagauauacacugcuuaaaugauuuugagucaauugaccaaucagcccuugauagauuaaaaacaaugacaugcuuccuaauagauccuaucacaacugaagauguauauucuauugcuauucauaguuguaaagucaaagauaaaggacaguguacaauaagagacaaaaaauggaauauuauaaaaugugacagugaacuauuguauuauacugaccacagagaaggagaagacacagggaaugaaauuggccauuauugucuaagucauaaauguggaacagacagauacccuauaaauccagaaauuauuaaagauuguaucugggaauucagaucgagaaaaucagaauauauaaauagaguagacuuggagagcuuggaagaauucaaaagagcuuuaucagauaaguugacacacacuuuaaccauuuauaacuuuaaaccaacugcuaauuuaccucauauaaagccaauuuauaaauauauuacugcucugggaguagaaaauucugauggccucgaggcugcauauauauuaacaaguauaccagcauuaggaggaacaaguauugguuauaacauuaugacgaaagacaauuucccgguaauggauguuauaaucuauguuaagagugcuguaauacaaacaacuuacaaucauauauaugauacaggaccgaccauaggaauaaauucaaaacaugaugaaaaaugcacagggucauguccucaaaauauaacacaugaccaaaauugguuaacauuuucacaagaaaggacaagcagaugggguugugaagaauuugggugucuagcaauaaauacagguuguguauuuggcucuugucaagacaugauaagaucagacacaaagguuuauaaaaaggcauuagaagaaacaguaguuuuaacuguuugcauaaacuacccugguaacacauuuugcacugaggucaauucuguagagacaaaaaugacagaugauguugaauuacaauuuaaaacaguugauacuaagacuuuaccuaaccuccuugcaguuacuaaucauaaauuauacaguggccaaauaaaugacuuagggucauucagucaaaugugugggaauguucagaagaccaauucaacuguaaugggugcugguacagugaaauuugauuacauaugucauggugcaaguaggaaagacauaauuauaagaagguguuauaugaauaauuacgcaucauguucuuuauuaaaggaagaaaaagauuugaucuuugcagauaaucaugaaacaauaacaguaucuaauucaaaacaucuugugggagaauugcaaauuaaauugauguuaggugauauucgguauaaacuauuugcagagagaccagaguuagagguggaugcaaaauguguaggauguccuucauguuuugagaguuauuccuguaauuuccaaauagucacaaauauagauacuguaugcacccuugaaggcccuugcacuauuuuccauaacagaauuauuaucaguucuacaaagcaaucuuaugguauuaagaugaguugccccacaaaaccaaaucacauagaaaaauucaaaaucugcaaucaugaauaugauauucuauucgauacaguggcaaaaaaugauaaaauagagauugauacaggagaucaaacauuauucgugagggagaaagacaccagguguaagacuugguuauguagaguaaaagaugaagguauaaguguuaucuuugagccuuuaagagcuuucuuuggaaguuacuucaguauuauuuuuuauauuauucuugcugcaauauuaauauuuguggguguuuauauauuuuuaccaauguuuaugagauuaagagauguucuuaaaaggaaugaacauuuauauuugcaagagauaaaacauaaauaa

SEQ ID NO: 4171 - RNA, 4305 nt, Artificial Sequence
  derived and/or modified CDS sequence (wt) from MAGV__AY286443.1__GP
auggaguuacuuauaauuaucuugcuguuagggagcgcagccaguagcccuauauccacuagauguuuucauggagggcaacuuauugcagaaucaaaaucugcaaccucuauaucagaguucugcuuaaaggaugauguuucaaugaucaaaucagaagucacuuauauaaaaaaugauacagguauauauggccacaauaaaguguucaggaguuggaccauaaaagauuggaaauugugcaacccuaucccaacagcaggaggcaguaucaauguaauugaaguaaauucagaccugagcuuagcaacaagggccuauguuuguagcagagauuguacuauaaccauugauaaagaagaugcccagauaauauuccaaacugauaaauuaaaccauuuugaagucucuggaacaaccuugaguucagguugguuuaagacuaaggccucagucacucuggacagaacaugugaacauauuaaagucacuugugggaagaaaucucuacaguuucacgccuguuuuaaacaccacaugucaugcauaagauucuuccaucacacuauacuaccuggaacaauggugucauccaugugccaaaauauugaauuaauaauaauaauuggacucaccuuagucauauuuauacuuaugguuaucuuaaccaaaacauacauaugcuaccuguuaaugccaguauuuaugccaguugcauacauauauggcugggcauauaauaagagcugcaagaaauguaauugcuguggcuuagcuuaucauccauuuacaaacuguggcucccauugugucugugggcucaaauucgaagcuucagauagaaugcgacuacauagggagucaggauugugccaaggcuacaaaagucucaggauagcgaggaugcuauguaaaucuaagggcucaucccuuguuaucucaggauuacuuucgaugcuauuauugagcuuuauaacaccuauagaaggcacguuaaccaacuacccaaaugaaaaacaauacacacuggaagagauugcagauguuguugaagggauaauaacagagcagcaucuuaaagaauauguggucuuuuauaccucauuauuuggggggcuaauauuauuauuaacucuuauacugucuauaacaauaaacaagguaacagaucuucucgcaagcacuaauguuauuuauugugaagaauguucaauguaucauucaaaaaaaggaauaaaguauaauggagauuucacuaauaaauguggauuuugcaccugcagugagcaagaagauguagagggaguuauuauacauaaaguaagcaggaaaugcacauauaaauaucaacuuaaauggguaagaguaauaaugauuauacuagcuuugcuuuugacaauucagaacacagucuuaauuguugcugcugaaguagauugcuggacaaaaaaaucuauagaaauugauugcauuggcccuuuacuuaauauaggcucaugcacugauaaaucaaguaggacauaugaaacagaaguuaacaaauuaguaagacaaucuaagguuacacaugcugaugcugaacaaauaucuaucuugggaagcacuuuagauaaugcaauuaaagccguaaggucacaaaagacauaugagacuaugcauuuccuagagacuguauucuuaaugaaaaauugugacuauuauaacagcuuugagcauaacagugguuauucacaaacaaaauggaggcuuauagcuaaaacaagccacuuugauaucuguucacggcauagcacccaucacuuuugcagguguguaaaugaagggacaaaaugccagaauggagauugggacuuugcuggagagaugaacgacaccuacaauagcaagaaugauuucuaccuccaugauuuagaucuuuucuauacacuccuugaaaaugcauuccccggcacaacagaaucuuuauucuaccagcuccuucagaagaaaaacacaacuggugcaucgaaauuauuaggaaaauuaauaacaaaauauggaaauaacaacauguuuguugagauauggaaauuuggucaguaucuucucaagcugccauacauaaaugauacagaauugaguacugauaggaaaucaacuauaauaaaaucacaacagguguugagcaggucucaaacagggaggcaagaauccuuaucuagugcaacuccaggcacugcaacaaaggaguguucaaaugcaaaagauauagguugcauuagcccaagguuuggcauuccuauaggaaaccucacugcauguggugauucuccaaauuauaaaguauauaaaaccccagagaaaaucuauaagucaaauaauagaggagaaguuugguguucagaugauguccacugcuuaacagacuuugaaccugcagaagaggagguggucaauagaauaaaacaaaugacuuguuucuuaacagauguaacaacaaaaacugauguauuuucuguugcuauaucaacgugcaaaaugguugauaaggguguauguacagucaaugaugcuaaauggaacauccucaaguguaauaguggguuauauuauuucacugaucacagaggugggcaagacacagguaaugauuuuggagaauacuguaucucucacaguugcaacacugaaagauuccccaucaauccagauguccugaaggacugcaucugggaauaccacuccaggaaauccaaauauaucucuacaguaaguuuagaaucauuagaugaauuuagaagagcuaugucagauaagcuaucacacaccuugaugauuuauaauuuuaaaccuacagccaaucucccccauauaaagccaacuuauaaauuuauaaccgcuaaugguauagagaauucagaugggauagauucagcauacauauuaucuagcauaccagccuuggguggaaugagcguuggcuauaacauucagacaaaagauaauuucccauuauuagauauuauaguuuucaucaagagugcuauuauuaaaacaaccuacaaucauauauaugacacagguccgacaauagggauaaauacucaacaugaugaacacugcacuggaccaugcccuacauuaauaccccauaaagagaacugguuaacauucucccaagaaaggacaagcaggugggguugugaagaauuuggcugccuggcaauuaauacuggguguguuuuuggcucaugccaggacauuauucaucccgaggcuaaaguauacaggaaagcuaucgaggaggaaguagucuuaacugucuguauaacauucccagggaauacauacugcacagagauaaaugcaauagagccaaaaauaacagaugaaauagaacuacaguuuaagacaguagauacuaaaacauuaccaaauuugcuaaugguucagaaucauaaauuauauagugggcagauuaaugaucuugguuccuuuucccagggauguggcaaugugcaaaagacuaaucagucuguaauuggagcuggaacugcaaaauuugauuaugucugucauggagcuaguaggaaagacguuauaguaaggcgcuguuacaacaauaauuaugaauccugcaagcuauuaaaagaggaaaccucucuuauauuugcagauaaucaugaaacauuagaaguagcgaauacaaagcaucuaauaggagaacugcaauucaaaauuauguugggagacauuagauacaagucauuugcugaaucaccagaauuagaaguagaugcaaaauguguaggcuguccuucauguuuugaaagcuauucuugcaauuuccagauuguuacaaauauugauacuguuuguucuguugaugggccuuguacacucuuccauaacagacugauaauaagugcaacaaagcaaucuuaugguuuuaaaaugaguuguccaaggaagccugaaccaacagaagaauuccagauauguaaccguaaguacaauguccuuuuuacuacaauugauaaaaaugauaaaauugaaaucaacacaggagaccagacuucuuauaucuaugaaaaagacaacagauguaagacauggcuuuguagaguuagggaugagggaaucaguguuauuuuugagccuuuaaaggcauuuuuuggcaguuacuuuagcaucauauuuuauguuguuguagguauaauuguauuauucuugacuauuuauauuuucuuacccauguucuucaaguuaagagauauauuaaaaagaaaugaguaucuguaccuacaggaauugaagcacaaauaa

SEQ ID NO: 4172 - RNA, 4305 nt, Artificial Sequence
  derived and/or modified CDS sequence (wt) from MAGV(ts8)__AY286444.1__GP
auggaguuacuuauaauuaucuugcuguuagggagcgcagccaguagcccuauauccacuagauguuuucauggagggcaacuuauugcagaaucaaaaucugcaaccucuauaucagaguucugcuuaaaggaugauguuucaaugaucaaaucagaagucacuuauauaaaaaaugauacagguauauauggccacaauaaaguguucaggaguuggaccauaaaagauuggaaauugugcaacccuaucccaacagcaggaggcaguaucaauguaauugaaguaaauucagaccugagcuuagcaacaagggccuauguuuguagcagagauuguacuauaaccauugauaaagaagaugcccagauaauauuccaaacugauaaauuaaaccauuuugaagucucuggaacaaccuugaguucagguugguuuaagacuaaggccucagucacucuggacagaacaugugaacauauuaaagucacuugugggaagaaaucucuacaguuucacgccuguuuuaaacaccacaugucaugcauaagauucuuccaucacacuauacuaccuggaacaauggugucauccaugugccaaaauauugaauuaauaauaauaauuggacucaccuuagucauauuuauacuuaugguuaucuuaaccaaaacauacauaugcuaccuguuaaugccaguauuuaugccaguugcauacauauauggcugggcauauaauaagagcugcaagaaauguaauugcuguggcuuagcuuaucauccauuuacaaacuguggcucccauugugucugugggcucaaauucgaagcuucagauagaaugcgacuacauagggagucaggauugugccaaggcuacaaaagucucaggauagcgaggaugcuauguaaaucuaagggcucaucccuuguuaucucaggauuacuuucgaugcuauuauugagcuuuauaacaccuauagaaggcacguuaaccaacuacccaaaugaaaaacaauacacacuggaagagauugcagauguuguugaagggauaauaacagagcagcaucuuaaagaauauguggucuuuuauaccucauuauuuggggggcuaauauuauuauuaacucuuauacugucuauaacaauaaacaagguaacagaucuucucgcaagcacuaauguuauuuauugugaagaauguucaauguaucauucaaaaaaaggaauaaaguauaauggagauuucacuaauaaauguggauuuugcaccugcagugagcaagaagauguagagggaguuauuauacauaaaguaagcaggaaaugcacauauaaauaucaacuuaaauggguaagaguaauaaugauuauacuagcuuugcuuuugacaauucagaacacagucuuaauuguugcugcugaaguagauugcuggacaaaaaaaucuauagaaauugauugcauuggcccuuuacuuaauauaggcucaugcacugauaaaucaaguaggacauaugaaacagaaguuaacaaauuaguaagacaaucuaagguuacacaugcugaugcugaacaaauaucuaucuugggaagcacuuuagauaaugcaauuaaagccguaaggucacaaaagacauaugagacuaugcauuuccuagagacuguauucuuaaugaaaaauugugacuauuauaacagcuuugagcauaacagugguuauucacaaacaaaauggaggcuuauagcuaaaacaagccacuuugauaucuguucacggcauagcacccaucacuuuugcagguguguaaaugaagggacaaaaugccagaauggagauugggacuuugcuggagagaugaacgacaccuacaauagcaagaaugauuucuaccuccaugauuuagaucuuuucuauacacuccuugaaaaugcauuccccggcacaacagaaucuuuauucuaccagcuccuucagaagaaaaacacaacuggugcaucgaaauuauuaggaaaauuaauaacaaaauauggaaauaacaacauguuuguugagauauggaaauuuggucaguaucuucucaagcugccauacauaaaugauacagaauugaguacugauaggaaaucaacuauaauaaaaucacaacagguguugagcaggucucaaacagggaggcaagaauccuuaucuagugcaacuccaggcacugcaacaaaggaguguucaaaugcaaaagauauagguugcauuagcccaagguuuggcauuccuauaggaaaccucacugcauguggugauucuccaaauuauaaaguauauaaaaccccagagaaaaucuauaagucaaauaauagaggagaaguuugguguucagaugauguccacugcuuaacagacuuugaaccugcagaagaggagguggucaauagaauaaaacaaaugacuuguuucuuaacagauguaacaacaaaaacugauguauuuucuguugcuauaucaacgugcaaaaugguugauaaggguguauguacagucaaugaugcuaaauggaacauccucaaguguaauaguggguuauauuauuucacugaucacagagaugggcaagacacagguaaugauuuuggagaauacuguaucucucacaguugcaacacugaaagauuccccaucaauccagauguccugaaggacugcaucugggaauaccacuccaggaaauccaaauauaucucuacaguaaguuuagaaucauuagaugaauuuagaagagcuaugucagauaagcuaucacacaccuugaugauuuauaauuuuaaaccuacagccaaucucccccauauaaagccaacuuauaaauuuauaaccgcuaaugguauagagaauucagaugggauagauucagcauacauauuaucuagcauaccagccuuggguggaaugagcguuggcuauaacauucagacaaaagauaauuucccauuauuagauauuauaguuuucaucaagagugcuauuauuaaaacaaccuacaaucauauauaugacacagguccgacaauagggauaaauacucaacaugaugaacacugcacuggaccaugcccuacauuaauacuccauaaagagaacugguuaacauucucccaagaaaggacaagcaggugggguugugaagaauuuggcugccuggcaauuaauacuggguguguuuuuggcucaugccaggacauuauucaucccgaggcuaaaguauacaggaaagcuaucgaggaggaaguagucuuaacugucuguauaacauucccagggaauacauacugcacagagauaaaugcaauagagccaaaaauaacagaugaaauagaacuacaguuuaagacaguagauacuaaaacauuaccaaauuugcuaaugguucagaaucauaaauuauauagugggcagauugaugaucuugguuccuuuucccagggauguggcaaugugcaaaagacuaaucagucuguaauuggagcuggaacugcaaaauuugauuaugucugucauggagcuaguaggaaagacguuauaguaaggcgcuguuacaacaauaauuaugaauccugcaagcuauuaaaagaggaaaccucucuuauauuugcagauaaucaugaaacauuagaaguagcgaauacaaagcaucuaauaggagaacugcaauucaaaauuauguugggagacauuagauacaagucauuugcugaaucaccagaauuagaaguagaugcaaaauguguaggcuguccuucauguuuugaaagcuauucuugcaauuuccagauuguuacaaauauugauacuguuuguucuguugaugggccuuguacacucuuccauaacagacugauaauaagugcaacaaagcaaucuuaugguuuuaaaaugaguuguccaaggaagccugaaccaacagaagaauuccagauauguaaccguaaguacaauguccuuuuuacuacaauugauaaaaaugauaaaauugaaaucaacacaggagaccagacuucuuauaucuaugaaaaagacaacagauguaagacauggcuuuguagaguuagggaugagggaaucaguguuauuuuugagccuuuaaaggcauuuuuuggcaguuacuuuagcaucauauuuuauguuguuguagguauaauuguauuauucuugacuauuuauauuuucuuacccauguucuucaaguuaagagauauauuaaaaagaaaugaguaucuguaccuacaggaauugaagcacaaauaa

SEQ ID NO: 4173 - RNA, 4311 nt, Artificial Sequence
  derived and/or modified CDS sequence (wt) from MAGV(AG83-1746)__KX100113.1__GP
augaagaugauucuucuaauaauaauacuaugugugaaccuugcugcugccaauccaguagcaacaagauguuuccauggaggucaauuaauagcagagacaagaucugcaacaucgauuucagaauucuguuuaaaggaugacguuucuaugauaaaaucggagauaaccuauacaaaaaaugauacuggcaucuucggccauagcaaaauauacaagaguugguuaauaaaagauuggaagcuuugcaauccaguaccaacugcagguggaaguauaaauguuauagaagugaacucugauuugaguuuaacuacaaaggcauauguuuguagcagagauuguacuauaacaauagacaaagaggaggcucagauuauauuccaaacagacaagcucaaccauuuugagguaucuggcacaacccugaguucagguugguucaaaacaaaagcuucuguaacauuggauagaacuugugagcauauaaaaguaacuuguggcaaaaaaacauugcaguuccaugccuguuuuagacaccacaugucguguguaagauuuuuccacaacacaauauuacccgguacuauggucaauucaaugugucaaaauauagaacuaauuauaauauuaggcuuaacauuaaucauauuuacauuaaugguuauacugacaaagaccuauaucuguuauauucuaaugccauuauuuaugccuauugcauaugcuuauggaugggcauacaauaaaagcugcaaaaaaugcaauugcuguggucuagcauaccacccauuuacuaauugcggaucccauugugucuguggcuuaaaguuugaagcuucagauaggaugaggauacauagagaaucuggccucugccaaggcuauaaaagcuuaaggauagcacgauuauuauguaaauccaaaggcucaucauuaauaauuucuacccuacuaucuaugcuacuucuaaguuuuauuacaccaauugagggaacaaugacaaauuacccagaaacaaggcaauacucucuugaagagauugcugauguuguugaggggcuuuuaucagaacaaaauauuaaagaauauguuguuuucuauacaucauuauucgggagcuuaauauuacuauuggcauucauuuuaucaaucacucugacaaaaguaacuaaugcucuagccaaaacaaauguaauuuacugugaagaaugcucaauguaccaugcaaaaaaaggcauaaaguacaauggugauuucacaaacaaaugcggauuuugcacuugugaugaacaagaagaugaagaaggcauaauaauacauaaaguaaguaagaaaugcacauauagauaucaacuacagugggcuaagaucauuaugauaauauuaguuauguuguugaugaugcaaaauacaauacucauuguugcugccgaaacagacugcuggacuaagaauucacuagaguuagauuguaucgggccucuacucaccaucagugauugcucaaacaaagagaguaaaaauuaugaagaagaagcagcaaaacuuguuagccaauccaaaauaacacaggcagaugcagaacaggucacaauauuaggcaauacaauagauacagcacucaaagcaaucagaucacaaaaaacauaucaaacuaugcacuuauuggaaucaguguuuuugaugaagaauugugauuauuauagcaguuuugaacacaauaguggauauucucaggcaaaauggagauuaauugcaaagacaagucacuuugacauauguucuagacauagcaugcaccauuuuugcagaugugucgcagauggcaccaaaugccagaauggcaauugggauuuugcuggagagaugaauaauacauacaguacuaaaaaugacuuuuaccuucaugauuugaauuuauuuuucaccuuacaugagacagccuuuccagguacaacugaaucuuuauuuuaucagcugauugcaaaaaagaacacuacaggugcuucuaagcugcuugggaaauuaauuacaaaauaugguaacaacaaguuguucguugggauauggaaauuuggccaauauuuauugacuuuaccauauguaaauacaacagaguuauccaagacuaggaaagagacaauauugaaaccacaucagauuuugacaagaucucagggaggaagaccagaaucuaugucuagugcugaggugggucaaacagcuaaagaaugugcuaaugcaaagaauguugguuguauuaguccuagguuuggggucccuauugguaaucuaacugcuugcggaaauagcccuaauuauaaaauauauaaaacaccuaacaagaucuauaagucaaacaacaggggugaggugugguguucagaagauguucauugccuggccgauuuugaaccugcugacacagaaguagucaacaaaguuaagaagaugacaugcuucuugucugaugugaacacuagagcagauaucuucucuauugcaauuucugcaugcagaaugguugauaaaggaguguguacuguuaauggugcaaaauggaauauauugaagugugagaguggucuuuauuauuuuacugaucauagggaaggacaagacacuggaaaugauuuuggagaauacugcaucucucauaguugcaauacagagagguacccaaucaacccagacauauuaaaagaguguauaugggaguaucacucuaggaaaucaaaauacaucucaacuaucaacuuagaaucccuagaggaauuuaaaagggcaauguccgauaaauuaucucacacuuugaugguuuauaacuuuaaaccgacugcaaacuuaccacacauaaaaccaaguuauaaguuuauuacugcaaaugguauugaaaacucagauggcuuagaaucagcauauauacuuucaaguauuccagcuauaggaggaaugaguauagguuauaauauccaaacaaaagacaauuuccccuuacuagauuuaauagucuuuguuaaaagugcagugauaaaaacaacauauaaccauauuuaugauacugguccuacaauaggaauuaauacaaaccaugaugaacacugcacagggcccugcccuacaauaauaccacauaaagagaauuggcuaacauucucacaagaaagaacaagcaggugggguugugaggaauuuggaugucuagcaaucaauacuggguguguauuuggaucaugucaagauguaauacauccugagacaaagaucuaucggaaagcuguugaagaggaaguuguucuaacuguuuguauaaauuuuccaggcaauacauucuguacagaaauaaaugcaauugagccuaaaauuacagaugagauagaacuucaguuuaaaacuguugauacaaaaacauuaccaaauuugcuagcaguucagaaucauaaguuauauaguggucagauaaaugauuuaggaucauuuucccaaggauguggaaauguucaaaaaacaaaucagucaauacuuggugcugggacaguaaaguuugauuaugugugccauggugcaagcaggaaagauauaauaguucguagauguuacacuaacaauuaugauucaugcaaacuacucaaagaagagagaucccugauauuugcugauaaccaugaaacuuuagaaguugcaaacacuaggcauuugauuggagaauugcaauucaagauuauguuaggagauauucgauauaaggccuuugcagaaaagccugagcuggaaauugaugcaaaauguguuggaugcccaucauguuucgaaagcuauucauguaguuuccaaauagugacuagcauagauacagucugcucuguugagggaccuuguaccuuguuucauaauagaauuauuaucacagcugcaaaacaaucauauggagucaaaaugaguugcaagacaaagccaggaccaguugaagaauuuagaauauguaaucggaauuauagaguaaguuuugcuacuauugauaaaaaugauaaaauugagauaaacacaggggaucaaacuucuuacauaguugagaaagauagcagauguaaaacaugguuaugcagagucagagaugaagggaucaguguuaucuuugagccucuaaaagcauucuuugguaguuacuuuaguguagccuucuauauuaucauaggaauugcugcuuuauuccucauaauauauauuuuccuacccauguuuuucaaacuuagagauguuuugaaaaagaaugaguauuuauauuugcaagaauuaaaacauaaguaa

SEQ ID NO: 4174 - RNA, 4305 nt, Artificial Sequence
  derived and/or modified CDS sequence (wt) from MAGV(BeAr 7272)__KX100104.1__GP
auggaguuacuuauaauuaucuugcuguuagggagcgcagccaguagcccuauauccacuagauguuuucauggagggcaacuuauugcagaaucaaaaucugcaaccucuauaucagaguucugcuuaaaggaugauguuucaaugaucaaaucagaagucacuuauauaaaaaaugauacagguauauauggccacaauaaaguguucaggaguuggaccauaaaagauuggaaauugugcaacccuaucccaacagcaggaggcaguaucaauguaauugaaguaaauucagaccugagcuuagcaacaagggccuauguuuguagcagagauuguacuauaaccauugauaaagaagaugcccagauaauauuccaaacugauaaauuaaaccauuuugaagucucuggaacaaccuugaguucagguugguuuaagacuaaggccucagucacucuggacagaacaugugaacauauuaaagucacuugugggaagaaaucucuacaguuucacgccuguuuuaaacaccacaugucaugcauaagauucuuccaucacacuauacuaccuggaacaauggugucauccaugugccaaaauauugaauuaauaauaauaauuggacucaccuuagucauauuuauacuuaugguuaucuuaaccaaaacauacauaugcuaccuguuaaugccaguauuuaugccaguugcauacauauauggcugggcauauaauaagagcugcaagaaauguaauugcuguggcuuagcuuaucauccauuuacaaacuguggcucccauugugucugugggcucaaauucgaagcuucagauagaaugcgacuacauagggagucaggauugugccaaggcuacaaaagucucaggauagcgaggaugcuauguaaaucuaagggcucaucccuuguuaucucaggauuacuuucgaugcuauuauugagcuuuauaacaccuauagaaggcacguuaaccaacuacccaaaugaaaaacaauacacacuggaagagauugcagauguuguugaagggauaauaacagagcagcaucuuaaagaauauguggucuuuuauaccucauuauuuggggggcuaauauuauuauuaacucuuauacugucuauaacaauaaacaagguaacagaucuucucgcaagcacuaauguuauuuauugugaagaauguucaauguaucauucaaaaaaaggaauaaaguauaauggagauuucacuaauaaauguggauuuugcaccugcagugagcaagaagauguagagggaguuauuauacauaaaguaagcaggaaaugcacauauaaauaucaacuuaaauggguaagaguaauaaugauuauacuagcuuugcuuuugacaauucagaacacagucuuaauuguugcugcugaaguagauugcuggacaaaaaaaucuauagaaauugauugcauuggcccuuuacuuaauauaggcucaugcacugauaaaucaaguaggacauaugaaacagaaguuaacaaauuaguaagacaaucuaagguuacacaugcugaugcugaacaaauaucuaucuugggaagcacuuuagauaaugcaauuaaagccguaaggucacaaaagacauaugagacuaugcauuuccuagagacuguauucuuaaugaaaaauugugacuauuauaacagcuuugagcauaacagugguuauucacaaacaaaauggaggcuuauagcuaaaacaagccacuuugauaucuguucacggcauagcacccaucacuuuugcagguguguaaaugaagggacaaaaugccagaauggagauugggacuuugcuggagagaugaacgacaccuacaauagcaagaaugauuucuaccuccaugauuuagaucuuuucuauacacuccuugaaaaugcauuccccggcacaacagaaucuuuauucuaccagcuccuucagaagaaaaacacaacuggugcaucgaaauuauuaggaaaauuaauaacaaaauauggaaauaacaacauguuuguugagauauggaaauuuggucaguaucuucucaagcugccauacauaaaugauacagaauugaguacugauaggaaaucaacuauaauaaaaucacaacagguguugagcaggucucaaacagggaggcaagaauccuuaucuagugcaacuccaggcacugcaacaaaggaguguucaaaugcaaaagauauagguugcauuagcccaagguuuggcauuccuauaggaaaccucacugcauguggugauucuccaaauuauaaaguauauaaaaccccagagaaaaucuauaagucaaauaauagaggagaaguuugguguucagaugauguccacugcuuaacagacuuugaaccugcagaagaggagguggucaauagaauaaaacaaaugacuuguuucuuaacagauguaacaacaaaaacugauguauuuucuguugcuauaucaacgugcaaaaugguugauaaggguguauguacagucaaugaugcuaaauggaacauccucaaguguaauaguggguuauauuauuucacugaucacagagaugggcaagacacagguaaugauuuuggagaauacuguaucucucacaguugcaacacugaaagauuccccaucaauccagauguccugaaggacugcaucugggaauaccacuccaggaaauccaaauauaucucuacaguaaguuuagaaucauuagaugaauuuagaagagcuaugucagauaagcuaucacacaccuugaugauuuauaauuuuaaaccuacagccaaucucccccauauaaagccaacuuauaaauuuauaaccgcuaaugguauagagaauucagaugggauagauucagcauacauauuaucuagcauaccagccuuggguggaaugagcguuggcuauaacauucagacaaaagauaauuucccauuauuagauauuauaguuuucaucaagagugcuauuauuaaaacaaccuacaaucauauauaugacacagguccgacaauagggauaaauacucaacaugaugaacacugcacuggaccaugcccuacauuaauaccccauaaagagaacugguuaacauucucccaagaaaggacaagcaggugggguugugaagaauuuggcugccuggcaauuaauacuggguguguuuuuggcucaugccaggacauuauucaucccgaggcuaaaguauacaggaaagcuaucgaggaggaaguagucuuaacugucuguauaacauucccagggaauacauacugcacagagauaaaugcaauagagccaaaaauaacagaugaaauagaacuacaguuuaagacaguagauacuaaaacauuaccaaauuugcuaaugguucagaaucauaaauuauauagugggcagauuaaugaucuugguuccuuuucccagggauguggcaaugugcaaaagacuaaucagucuguaauuggagcuggaacugcaaaauuugauuaugucugucauggagcuaguaggaaagacguuauaguaaggcgcuguuacaacaauaauuaugaauccugcaagcuauuaaaagaggaaaccucucuuauauuugcagauaaucaugaaacauuagaaguagcgaauacaaagcaucuaauaggagaacugcaauucaaaauuauguugggagacauuagauacaagucauuugcugaaucaccagaauuagaaguagaugcaaaauguguaggcuguccuucauguuuugaaagcuauucuugcaauuuccagauuguuacaaauauugauacuguuuguucuguugaugggccuuguacacucuuccauaacagacugauaauaagugcaacaaagcaaucuuaugguuuuaaaaugaguuguccaaggaagccugaaccaacagaagaauuccagauauguaaccguaaguacaauguccuuuuuacuacaauugauaaaaaugauaaaauugaaaucaacacaggagaccagacuucuuauaucuaugaaaaagacaacagauguaagacauggcuuuguagaguuagggaugagggaaucaguguuauuuuugagccuuuaaaggcauuuuuuggcaguuacuuuagcaucauauuuuauguuguuguagguauaauuguauuauucuugacuauuuauauuuucuuacccauguucuucaaguuaagagauauauuaaaaagaaaugaguaucuguaccuacaggaauugaagcacaaauaa

SEQ ID NO: 4175 - RNA, 4311 nt, Artificial Sequence
  derived and/or modified CDS sequence (wt) from MAGV(CbaAr 426)__KX100110.1__GP
augaagaugauucuucuaauaauaauacuaugugugaaccuugcugcugccaauccaguagcaacaagauguuuccauggaggucaauuaauagcagagacaagaucugcaacaucgauuucagaguucuguuuaaaggaugacguuucuaugauaaaaucggagauaaccuauacaaaaaaugauacuggcaucuucggccauagcaaaauauacaagaguugguuaauaaaagauuggaagcuuugcaacccaguaccaacugcagguggaaguauaaauguuauagaagugaacucugauuugaguuuaacuacaaaggcauauguuuguagcagagauuguacuauaacaauagacaaagaggaggcucagauuauauuccaaacagacaaacucaaccauuuugagguaucuggcacaacccugaguucagguugguucaaaacaaaagcuucuguaacauuggauagaacuugugagcauauaaaaguaacuuguggcaaaaaaacauugcaguuucaugcuuguuuuagacaccacaugucauguguaagauuuuuccacaacacaauauuacccgguacuauggucaauucaaugugucaaaauauagaacuaauuauaauauuaggcuuaacauuaaucauauuuacauuaaugguuauacugacaaagaccuauaucuguuauauucuaaugccacuauuuaugccuauugcauaugcuuaugggugggcauacaacaaaaguugcaaaaaaugcaauugcuguggucuagcauaucacccauuuacuaauugcggaucccauugugucuguggcuuaaaguuugaagcuucagauaggaugaggauacacagagagucuggccucugccaaggcuauaaaagcuuaagaauagcacgauuauuauguaaauccaaaggcucauccuuaauaauuuccacccuacuaucuaugcuacuucuaaguuuuaucacaccaauugagggaacaaugacaaauuacccagaaacaaggcaauacucucuugaagagauugcugauguuguugaggggcuuuuaucagagcaaaauauuaaagaauauguuguuuucuauacaucauuauucgggagcuuaauauuacuauuggcauucauuuuaucaaucacucugacaaaaguaacuaaugcucuagccagaacaaauguaauuuacugugaagaaugcucaauguaccaugcaaagaaaggcauaaaguauaauggugauuucacaaacaaauguggauuuugcacuugugaugaacaggaagaugaagagggcauaauaauacauaaaguaaguaaaaaaugcacauauagauaucaacuacagugggcuaagaucauuaugauaauauuaguuauguuguugaugaugcaaaauacaauacuuauuguugcugccgaaacagacuguuggacuaagaauucacuagaguuagauuguauugggccucuacucaccaucagugauugcucaaacaaagagaguaaaaauuaugaagaagaagcagcaaaacuuguuagucaauccaaaauaacacaggcagaugcagaacagguuacaauauuaggcaacacaauagauacagcacucaaagcaaucagaucacaaaaaacauaucaaacuaugcauuuauuggaaucaguguuuuugaugaagaauugugauuauuauagcaguuuugaacacaauaguggauacucucaggcaaaauggagauuaauugcaaagacaagucacuuugacauauguucuagacauagcaugcaccauuucugcagaugugucgcagauggcaccaaaugccaaaacggugauugggauuuugcuggagagaugaauaauacauacaguacuaaaaaugacuuuuaccuucaugacuugaauuuauuuuucaccuuacaugagacagccuuuccagguacaacugaauccuuauuuuaucagcugauugcaaaaaagaacacuacaggugcuucuaagcugcuugggaaauuaauuacaaaauaugguaacagcaagcuguucguugggauauggaaauucggccaauauuuauugacuuuaccauauguaaauacaacagaguuauccaagacuaggagagagacaauauugaaaacacaucagaucuugacaagaucucagggaggaagaucagaaucuaugucuagugcugaggugggucaaauagcuaaagaaugugcuaaugcaaagaauguugguugcauuaguccuagguuugggaucccuauugguaaucuaacugcuugcggaaauagcccuaauuauaaaauauauaaaacaccuaacaagaucuauaagucaaacaacagaggugaggugugguguucagaagauguucauugccuggccgauuuugaaccugcugacacagaaguagucaacaaaguuaagaagaugacaugcuucuugucugaugugaacacuagagcagauauuuucucuauugcaauuucugcaugcagaaugguugauaaaggaguguguacuguuaauggugcaaaauggaauauauugaagugugagaguggucuuuauuauuuuacugaucauagggaaggacaagacacuggaaaugauuuuggagaauauugcaucucucauaguugcaauacagagagguacccaaucaacccagacauauuaaaagaguguauaugggaauaucacucuaggaaaucaaaauauaucucaacuaucaacuuagaaucccuagaggaauuuaaaagggcaauguccgauaaauuaucucacacuuugaugguuuauaacuuuaaaccgacugcaaacuuaccacacauaaaaccaaguuauaaguuuauuacugcaaaugguauugaaaacucagauggcuuagaaucagcauauauacuuucaaguauuccagcuauaggaggaaugaguauagguuauaauauccaaacaaaagacaauuuccccuuacuagauuuaauagucuuuguuaaaagugcagugauaaaaacaacauacaaccauauuuaugauacuggucccacaauaggaauuaauacaaaucaugaugaacacugcacagggcccuguccuacgauaauaccacauaaagagaauuggcuaacauucucacaagaaagaacaaguaggugggguugugaggaauuuggaugucuagcaaucaauacuggguguguauuuggaucaugucaagauguaauacaucccgagacaaagaucuaucggaaagcuguugaagaggagguuguucuaacuguuuguauaaauuuuccaggcaauacauucuguacagagauaaaugcaauugagccuaaaauuacagaugagauagaacuucaguuuaaaaccguugauacaaaaacauuaccaaauuugcuagcaguucagaaucauaaguuauauaguggucagauaaaugauuuagggucauuuucccaaggaugugggaauguucaaaaaacaaaucagucaauacuuggugcugggacaguaaaguuugauuaugugugccauggugcaagcaggaaagauauaauaguucguagaugcuacaccaacaauuaugauucaugcaaacuacucaaagaagagagaucccugauauuugcugauaaccaugaaacuuuagaaguugcaaacacuaggcauuugauuggagaauugcaauucaagauuauguuaggagauauucgauauaaggccuuugcagaaaagccugagcuggaaauugaugcaaaauguguuggaugcccaucauguuucgaaagcuauucauguaauuuccaaauagugacuagcauagauacagucugcucuguugagggaccuuguaccuuguuucauaauagaauuauuaucacagcugcaaaacaaucauauggaguuaaaaugaguugcaagacaaagccaggaccaguugaagaauucacaauauguaaucggaauuauagaguaaguuuugcuacuauugauaaaaaugauaaaauugagauaaacacaggggaucaaacuucuuacauaguugagaaagauagcagauguaaaacaugguuaugcagagucagagaugaagggaucagugucaucuuugagccucuaaaagcauucuuugguaguuacuuuaguauagccuucuauauuaucauaggaauugcugcuuuauuccucauaauauauauuuuccuacccauguuuuucaaacuuagagauguuuugaaaaagaaugaguauuuauauuugcaagaauuaaaacauaaguaa

SEQ ID NO: 4176 - RNA, 4305 nt, Artificial Sequence
  derived and/or modified CDS sequence (wt) from MAGV(CoAr 3363)__KX100107.1__GP
auguuauccuugcucauacuagcuuuuuuagggcucucgacaagcaacccuauugcaacuagguguuuccaugggggccaauuaauagcagaaucaaagucugcuacaucuauaucagaauucugccucaaggaugaugucucaauguuaaaaucugagguaguauacacaaagaaugauacuggauuauuuggucauaauaaaguuuuuagaagcuggacaauaaaagauuggaaacucugcaacccuauaccuacugcaggaggaacaauaaauguaauugaggucaauaaagaucuuagucuaaugacaaagacauacauauguaguagagauugcacuauaacuauagauaaagaggaagcucagauuaucuuucaaacagauaaguuaaaucauuuugaaguaucuggcacuacauuaaguucaggaugguuuaaaagcaaggcgucuguuacccuggauagaaccugcgagcauguuaagguuacuuguggaaagaagucucugcaauuccaugcaugcuuuaaacaccacaugucaugugucagguucuuccacaauaccauauuaccuggcaacaugauaaccucaaugugccagaauauagaauuaauaauuaucuuagggcuaacauuagccauauuuauauuaaugguuaugcuuacaaagacuuauauauguuauuuauugaugccaauuuucaugccgauagcuuaucuuuaugguugggccuacaacaagagcugcaaaaaguguaacuguuguggucuagcauaccauccauuuacuaauugugggucacauuguguuuguggcuugaaauuugaggcaucagauaggaugaggauccauagagaaucuggcuugugucaaggguacaagaguuuacgaauugcuagacuuuuguguaaaucuaaagggucaucucuaguuauaucuggguuguugucuauguugauccuaagcuucguaacgccuauagaagggacuauaacuagcuacccagaaaguaggaaauauacacuagaagagauaacagauguuguugaaggauuggugucugaacagaauauaaaggaguacauuguuuucuacaccucauuguuuggaaguuuaauacuauuauuagcauuuauaaugucuauaacuuugagcaaaauaacaagcauacuagcaagaagaaauguuauuuauugcgaagaaugcucaauguaucauucaaaaagaggcauaaaguauaacggugauuucacaaacaaaugcggcuuuugcacaugcaaugaacaggaggaugcagaaggauuagugauacauaaaguuaguaagagaugcacauauaaaugccaacuaaagugggcuaaagugcugaugaucacacuggucuuacuucuaauagcacaaaacacuauucuaauuguugcagcuaaaacagauugcuggacaaaaaaaagccuagauauagacuguauaggaccaaugcuagauauaggcucuugcacaaauaagaacaccagaagcuaugauacagaagcacagaaauuggugacccagucuaaaguaagucaacuagaugcagaccaagcaucgcuguugggcagcucuauagauagugcuauuaaggcaaucagaacccagaaaacuuauccuacgaugcacuuguuggaaacaauauucuuaaugaaaaauugugauuauuacacgaguuucaaccauaacagugguuauucacaagcuagauggcgauugauugcaaaaacaggacacuucgacauauguuccagacauagcacccaccauuuuugccgauguauaagugaugggaccaaaugucagaauggugauugggauuuugcuggugaaaugaaugaaccuuacaauagcaaaaaugauuuuuauuugcaugaucugaauuuguuuuacacaaucuuugaaaaugcauucccagggacaacugaauccuuauuuuaccaguugauccaaaagagggauacuacaggggccuccaaagucuuggggaaguuaauaacuaaauaugguaauaauaacauguucguuggagucuggaaauuuggacaauacuugcuuacauuaccauauauaaauaauacugaauugagccagaauaggaagcaaacaauccuggcaacacaagaaccauuaaguaggucacacccuggcaggcaggagucuaugucuagugcaauucagggcaguguuacaaaagaaugccauaaugcaaaagauguugggugcauaagcccucgguuugguaucccaauuggcaaccuuacagcauguggugacucaccuaauuauaagauauauaagacuccagaaaaguuguauaaaucaaauaauaaaggggaaguuugguguucgaaugauguccacugccugaaugauuuugagccugcagaugaagaaguugucaauaaaguuaaaaaacucacuugcuucuuaacagauguuuuaguuaaaacagacaucuuuucaguggcugcauccacauguaagauggcagauaaaggcaucuguacagugaaugaugcuaaauggaauauaaucaagugugauaguggauuauauuauuuuacagaccauagagaaggccaggacacaggcaaugacuuuggugaguauuguauaucucacaguugcaauacugagcgauucccuaucaacccagauauauuaaaagauugcacuugggaguuccauuccagaaagucuaaauauauuucaaccauuaguuuagaaucauuggaagaauucaggagggcaauggcagaaaagcuaucacacacccuaacaauuuacaauuuuaaaccaacagcuaaucuuccucauauuaggccaaccuauaaauucauuacagcaaaugguguugaaaacucugacgguauugaaucagcauacaucuugucuagcaucccugcauuaaguggaauuagcguugguuauaauguccagaccaaagacaacuucccauuguuggauauaauuguguucauuaaaagugcagucaucaggacaacauacaaucauauuuaugauacugggccuacuauagguauaaacacacaacaugaugagcacuguacagggccaugcccagcuguggugccacauaaggaaaacuggauaacauuuucucaagaaagaacaaguagaugggggugugaagaauuugguugccuggccaucaacacaggguguguuuuugguucuugccaagauauaauacauccagaaaccaaaguauaccguaaagcaguagaagaggaaguugucuuaacaguaugcauuaauuucccaggcaauaauuacugcacugaaauaaaugccauugagccaaaaauaacggaugagauagagcuccaguucaaaacagucgauacaaaaaccuuacccaaucuucuugcagugcagaaccauaagcuuuauaguggccagauaaacgauuuaggcucuuuuucacaagguuguggaaauguccaaaaaacaaaucacucuauccuagguauggguacagccaaauuugauuauguuugucauggcgcuaguaggaaagaugugauagucagaaggugcuacaacaauaauuuugauucaugcaaauuacuaaaagaagaaacaucauugauauuugcagauaaucaugagacucuggagguagcacacacaaaacaucugauaggugaauuacaguuuaagauaauguuaggagauauaagauacaaaucauuugcugaaucgccugaguuggaaauugaugcaaaaugugucggguguccaucauguuuugaaagcuacuccugcaacuuucaaauagugacaaauauagacacuguaugcucagucgaagggccaugcacacuauuucauaaucggauuauuauaucagccaacaagcagucauauggacuuaaaaugagcugccaaacaaagccuaaucagaaugaagaguucauuaucugcaacaggaaauacagcguccuauuuacaacaauugauaaaaaugacaaaauagaagugaauacaggggaccagacuucauauauuuaugaaaaagacagcagauguaaaacuugguuaugcagggucagagaugaggggaucagcguccuauuugaaccauuaaaagcauuuuuuggaaguuacuuuagcauaauauuuuauguugucauuggaauuauuguccuuuucuugauuguauauaucuuucugccaauguucuucaaacuaaaagauguucugaaaaaaaaugaguacuuguaucuucaggagcugaagcauaaauga

SEQ ID NO: 4177 - RNA, 4305 nt, Artificial Sequence
  derived and/or modified CDS sequence (wt) from MAGV(OBS 6657)__KX100116.1__GP
auggaguuacuuauaauuaucuugcuguuagggagugcagcuaguagcccuguauccacuagguguuuucauggagggcaacuuaucgcagaaucaaagucugcaaccucuauaucagaauucuguuuaaaggaugauguuucaaugaucaaaucagagguuacuuauacaaagaaugauacagguauauauggucauaauaaaguguuccggaguuggacuaucaaagauuggaaauugugcaacccuaucccaacagcaggaggcaguaucaauguaauugaagugaauucagaccugagccuagcaacaaaggccuauguuuguaguagagacugcacuauaacuaucgacaaagaggaugcccagauaauauuucaaacugauaaacugaaccauuuugaggucucugggacaacuuuaaguucagguugguuuaagacuaaagccucagucacucuggacaggacgugcgaacacauuaaagucaccugugggaaaaaaucucuacaauuucaugcauguuuuaaacaucacaugucaugcauaagguucuuccaucauacuauacuaccugggacaaugguaucaucuaugugccaaaauauugaauuaauaauaauaauuggacucaccuuagucuuguuuauacuuaugguuauauuaacuaaaacauacauaugcuaucuauugaugccaauauuuaugccaauugcauacauauauggcugggcauacaauaagaguuguaaaaaauguaauuguuguggcuuagcuuaccauccauuuacaaacuguggaucucauugugucugugggcucaaauuugaagcuucagauagaaugagaauacauagagagucagggcugugccaaggcuauaaaagucuuaggauagcaagaaugcuauguaaaucuaagggcucaucccuuguuaucucaggacuacucucaaugcuuuuauuaagcuuuauaacaccuauagaaggcacauuaacuaacuacccaaaugaaagacaauacacacuggaagagauugcagauguuguugagggaauacuaacagaacaacaucucaaagaauauguggucuuuuauaccucauuauuuggggggcuaauauuauuauuaacucuuauacugucuauaacaauaaacaaaguaacagaucuucuugcaagcacuaaugucauuuacugcgaagaauguucaauguaccauucaaagaaaggaauaaaguauaauggagauuucacuaacaaauguggcuuuugcacuugcagugaacaagaagacauagaggggguuguuauacauaaagugaguaggaaaugcacauauaaauaccaacuuaaguggguaagaguaauaaugauuauauuggcucuacuuuuaacacuccagaacacaguuuuaauuguugcugcugaaguagauugcuggacaaaaaaaucuauagaaauugauugcauaggcccuuuacucaauauuggcacaugcacugacaagucaaguaggacauaugaaacagagguuaacaaauuaguaagacaaucuaaaguuacacaggcugaugcugaacaaguaucuauucugggaagcacucuagacagugccaucaaagccauaaggucacaaaaaacauaugaaaccaugcauuuucuagagacuguguucuugaugaaaaauugugacuauuauagcagcuuugagcacaauagcgguuauucacaaacaaaauggaggcuuauagcaaaaacaagccacuuugauaucugcucacggcauagugcccaccauuuuugcagauguguaaaugaagggacaaaaugccaaaauggagauugggauuuugcuagagaaaugaaugacacuuacaauaguaagaaugauuucuaucuccaugauuuggaucuuuuuuauacgcucuuugaaaaugcauucccugguacuacagaaucuuuauucuaccagcuucuucagaagaaaaacacaacuggugcaucaaaacuauuagggaaguuaauaacaaaauaugguaauaauaacuuguuuguugggauauggaaauuuggucaguaccuucuuaagcugccauacauaaaugauacagaauuaaguaccgauaggaaaucaacuauaaugaaaucacaacagauguuaagcaggucucaaacagggaggcaagaaucccugucuagugcaaccccaggcacugcaacaaaggagugcucaaaugcaaaagacauagguuguauuagcccaagguuuggcauuccuauaggaaaccuuacugcauguggugauucuccaaauuauaaaauauacaagacaccagagaaaaucuauaaaucaaauaauaaaggagaaguuugguguucagaugauguucacugcuuagcagacuuugaaccugcagaagaagagguagucaauagaauaaaacagaugacuuguuuuuuaacagauguaacaacaaagacugauguauuuucuguugcuauaucaacaugcaaaauggcugauaaggguguguguacagucaaugaugcuaaauggaacauccucaaguguaauaguggauuauauuauuucacugaccacagagaugggcaagauacagguaaugauuuuggagaauacuguaucucucauaguugcaacacugaaagguuccccaucaacccagaugucuugaaagauuguauuugggaauaccacuccagaaaauccaaguauaucucuacaauaagucuagaaucauuagaugaguuuagaagggcuaugucagauaagcuaucacacaccuuaaugauuuacaauuuuaaaccuacagccaaucucccccauauaaagccaacuuacaaauuuauaacugccaaugguauagagaacucagaugggauagacuccgcauauauauuaucuagcauaccggcucugggugggaugagugucggcuauaauguucagacaaaagacaauuucccauuauuagauauuauaguauucauuaaaagugcuauuauuaaaacaaccuacaaucauauauaugacacagguccaacaauagggauaaacacccaacaugaugagcauugcacuggaccaugcccuacauugauaccucauaaagaaaacuggcuaacauucucucaggaaaggacaaguagaugggguugugaagaauuuggcugcuuggcgauuaacacugggugugucuuuggcucaugccaggacauuauucauccugaagccaaaguuuacaggaaagcuauugaggaggaggugguuuuaacugucuguauaacauucccagggaauacauacugcacagagauaaaugcaauagagccuaagauaacagaugaaauagaauuacaguucaaaacaguagauacuaaaacauugccaaacuugcuaaugguucagaaucauaaauuauauaguggucagauuaaugaucuugguuccuuuucccagggauguggcaaugugcaaaaaacuaaucagucuguaauuggaacuggaacugcaaaauuugacuaugucugucauggagcuaguaggaaagauguuauaguaaggcgcuguuacaacaacaauuaugaaucuugcaagcuauugaaagaggaaagcucucucauauuugcagauaaccaugaaacauuagaaguagcaaauacaaagcaucugauaggagaauuacaauucaaaauuaugcuaggagacauuagauauaaaucauuugcugaaucaccagaauuagaaguagaugcaaaauguguaggcuguccuucaugcuuugaaagcuauucuugcaauuuccagauuguuacaaauauugauacuguuuguucuguugaugguccuuguacgcuuuuccauaacagacuaauuauaagugcugcaaagcaaucuuaugguuugaaaaugaguuguucaaggaggccugagcaaacagaagaauuccagauauguaaucguaaguacaguguccuuuucacuacaauugauaaaaacgauaagauugaaauuaacacaggagaccagacuucuuauaucuaugaaaaggacaacagauguaagacauggcuuuguagaguuagagaugaggguauuaguguuauuuuugagccuuuaaaggcauuuuuuggcaguuacuuuagcaucauauucuaugugauuguaggcauuauuguauuauucuugauuauuuauauuuucuugcccauguucuucaaguuaagagauauauuaaaaagaaaugaauaucuguaccuacaggaauuaaagcacaaauaa

SEQ ID NO: 4178 - RNA, 4302 nt, Artificial Sequence
  derived and/or modified CDS sequence (wt) from NORV(0234)__EU004188.1__GP
augauuugguuuauccugcuauuagcaauugcgccaucauuugguaccccuauugcaacuagaugcuuucaugggggccaacuuauugcagaggcaaaaucacaaacaucuauuucagaauuuugcuugaaagaugauguuucaaugauaaaaucggaagucacuuacacaaaaaaugacacaggcauuuuugggcauaguaagguuuauagaagcuggacuaucaaagauuggaaacuauguaauccagugccaacaguuggagguaguauaaaugucauagaagugacagcagaccuaagucugucaacaaaagcauauguaugcagucgggauuguacaaucacaauagauaaggaaggagcucagauuguauuccagacagacaagcuuaaucauuuugaaguaucuggaacaaccuuaaguucagggugguuuaaaaccaaagcuucagucacauuagaucggaccugcgaacauaucaaagugaccuguggaaagaaaacucuccaauuucaugcuugcuuuaaacaucauaugucaugcauucgcuuuuuccauaacacuaucuuaccuggaucaauggucgccucaaugugccagaacauagaauugauuauuauuuuaggacuaacauugauaauuuuuauauuaauggccauacuaaccaaaacauauauauguuaccuuuuaaugccuauuuuuaugccaauugcauaugcauaugguugggcauauaauaaaaguuguaagaagugccacugcuguggcuuggcauaccaccccuuuaccaauuguggaucacauuguguuuguggucuaaaauuugaggccucagacagaaugaggauacaucgagagucuggauuaugucaaggauacaaaagcuugagaguggccagauuguuaugcaaaucaaaagguucuuccuuaguuauaucaauacuacuuucuaugcucauucuaagcuuuguaacaccaauagagggaacacugaccaauuacccagagucaaggcgauacacauuagaggaaauugcagauguuguugaggguauaauagcagaacaagaucuaaaggaguauauuguauuuuauacuucauuauuugggaguuuaauucuauuauuagcauucauauuaucuguuacauuaacaaaaguucuagauuuacuggcuaaaacaaauguaaucuacugugaagaaugcuccauguaucauccaagaaaaggaauaaaauacaauggggauuuuacaaauaaguguggguuuuguacuugugaugaacaagaagauguagaagguguaauuauacauaaagugaguaaaaaguguacuuaccgguaucaaguuaagugggcaaagauaaucaugauuauuguaguuauacuauuaauggcacaaaauacuauuuuaauuguugcugcagaaacagauugcuggacaaaaaaaucauuagaacuggauuguauuggcccacuauuaaauauaggauccugcucaggcaaggaagcuaggacuuaugaaacagaaguaaaaaaacuugucagucagucuaaaguaacacauauagaugcugaacacauuuccauucugggagcaacuauagauagugccauaaaaucuauaagagcacagaaaacauaugcaaccaugcaucuauuagagacugucuuucugaugaaaaauugugauuauuacacaguuuuugagcauaauagugguuauucacaagcaaaauggagguugauagcuaagacaaaucauuuugauaucuguucuagacauagugcacaucauuuuuguagaugcauuaaugaugagacaaagugucaaaauggcaauugggacuuugcaggugaaaugaauaacacauauaguacuaagaaggacuucuaccgacaugaccuagaucuuuuuuacacaauauuugaaaaugcuuucccaggaucuacugaaucucucuuuuaucauuuauuacaaacaaagaauacuacaggagccucaagaauauuagaaaaauuaucaaccaaauuuggcaacaacaacauguuuguuggaaucuggaaguuuggacaauaucugcuaacauugccauaugugaaugagacagaauugagcccuucuaggcaaucaacuauauuaaccaauagcaauucucucaguagaucaacaggcaggcaggaaucauuaucuagugcuaucccaggaccaaacacaaaggaaugcucuaaugcaagagacgucggguguauaagcccgcgauuugguauucccauaggaaauuugacagcauguggcgaaucaccuaguuauaaaauauacaaaacuccagaaaaauuauauaaaucuaacaauaaaggugagauaugguguucugaugauguucauuguuuaaagaauuuugagccagcuacugaagagauaguaaauagaauuaaacaaaugacauguuucuuaacagaugucucaacaaaaacagauauauucucuauagccacaucaacaugcagaaugguagacaaaggugucugcacugucaaugaugcaaaauggaauauacuuaaaugugauagugggcucuuuuauuuuacugaucaaagggaaggccaagauacaggcaaugauuuuggagaauauuguauuucucauaguuguaacacagaacgauuccccauaaauccugauauucuaaaagacugcacuugggaauaucauucacgaaaaucuaaauauauaucuacuauuagucuagaaucacuagaugaauuuaggagagccaugucagauaagcuaucucauacauuaaugauuuauaauuucaaaccuacagcuaaccucccccacauaaagccaacauacaaauuuauaacagcuaauggaauugaaaacucugauggguuggacucagcuuauauuguaucuaguauuccagcauuaggugguaugaguguuggcuacaauguccaaacaaaagauaauuucccauugcuugacaucauaguuuuuauaaagagugcaguuauuagaacaaccuauaaucauauauaugacacagggccuacuauugggauaaauacacaacaugacgagcauugcacaggggcuugcccaacacaaauaccacauaaagacaauuggcucacuuucucccaggagaggacuaguaggugggguugugaagaauuuggcugccuagcuauuaauacuggauguguuuuuggaucuugccaagauauuauacauccugaaaccaagguauauaggaaggcaauggaagaagagguaauauugacaguaugugucacguucccaggcaauacuuauuguacugaaauaaaugcaauagaacccaagauuacagaugagauagaacuacaguucaaaacuguagauacuaaaacauuaccuaauauauuggcuguucagaaccacaaauuauacaguggucaaaucaaugaucugggaucuuuuucgcaaggcuguggcaaugugcaaaagacaaaccaauccauacuuggaacuggaacagcaaaauuugacuauguuugucauggagccagucgcaaagauauuauagucagacguugcuauaacaauaaucaugacucuugcaaguuauuaaaagaagaaaccucauugaucuuugcagauaaucaugaaacauuaguggucgcuaauacaaagcauuuaauaggagaacuccaauucaaaauaaugcuuggugauaucagauacaaaucuuuugcagaguccccagaacuugaaauugaugcaaaguguguaggauguccaucauguuuugaaaguuauuccuguaauuuccagauuauuacaaauauugacacuguguguucuguaaguggcccaugcacauuauuccauaacagauuaauuauaacugcaacaaaacagucauaugggauuaaaaugaguuguccaacaaaaccugaaggcacagaaacauucgaaauauguaacaaacaauauaaaauauuuuuuacaacaauagauaagaaugacaaaauagagauaaacacaggagaucaaacuucauacaucuaugagaaggacaauagguguaaaaccugguuauguagaguacgggacgaaggaauuagcgugcucuuugaaccauuaagagcauucuuugggaguuacuuuaguauaauauuuuaugcugucguaggaauuauuaucuuauuuuuagcaguauauauauuccuaccuaugaucuucaaacuuagggacaugcucaagaagaaugaauaccuauacuuacaggagucgaaacauaaauga

SEQ ID NO: 4179 - RNA, 4305 nt, Artificial Sequence
  derived and/or modified CDS sequence (wt) from PLAV(75V3066)__KX100122.1__GP
augcuauuccugcucauacuagccuuuuuaggguucucaacaagcaacccuauugcaacuagguguuuccaugggggccaauuaauagcagagucaaagucugcuacaucuauaucagaauucugccucaaggaugaugucucaauguuaaaaucugaagugguauacauaaagaaugauacuggauuauuuggccauaauaaaguuuuuagaagcuggacaauaaaagauuggaaacucugcaacccuauaccuacugcaggaggaacaauaaauguaauugagguuaacaaagaucuuagucuaaugacaaagacauacauauguaguagagauugcacuauaaccauagauaaagaggaagcucaaauuaucuuccaaacagauaagcuaaaucauuuugaagugucuggcacuacauuaaguucaggaugguuuaaaagcaaggcgucugucacccuggauagaaccugugagcauguuaagguuacuuguggaaagaaaucucugcaauuccaugcauguuuuaaacaccacaugucauguguuagguucuuccacaauaccauauuaccuggcaauaugauaaccucaaugugccagaauauagaauuaauaauuaucuuagggcuaacacuagccauauucauauuaaugguuaugcuuacaaaaacuuauauauguuauuuacugaugccaauuuucaugccgauagcuuaucuuuaugguugggccuacaauaagagcugcaaaaagugcaacuguugugguuuagcauaucauccauuuacuaauugugggucacauuguguuuguggccugaaauuugaggcaucagauaggaugagaauccauagagaaucuggcuugugucaaggguacaagaguuuacgaauugccagacuuuuguguaaaucuaaagggucaucuuuaguuauaucuggauuauuguccauguuaaucuuaagcuuuguaacgccuauagaggggacuauaacuagcuacccagagagcagaaaauauacacuggaagagauaacagauguuguugaaggacugguaucugagcagaauauaaaggaguacauuguuuucuauaccucauuguuuggaaguuuaauacuauuauuagcauuuauaaugucuauaacuuuaagcaaaauaacaagcauauuagcaaaaagaaauguuauuuauugugaagaaugcucaauguaucauucaaaaagaggcauaaaauacaauggugacuucacaaacaaaugcggcuuuugcacaugcaaugagcaagaggauacagaaggauuaguaauacauaaaguuaguaagagaugcacauauaaguaccagcuaaagugggcuaaagugcugaugaucacacuagucuugcuucuaauagcgcaaaacacuauucuaauuguugcagcugaaacagauugcuggacaaaaaaaagccuagacauagacuguauaggaccaaugcuagauauaggcucuugcacaaauaagaauaccagaagcuaugaugcagaagcacagaaauugguaagccagucuaaaauaagucaacuagaugcagaccaaguaucguuguuaggcaacucuauagauagugcuauuaaggcaaucagagcccagaaaacuuacccuacaaugcauuuguuggaaacaauauucuuaaugaaaaauugcgauuauuacacgaauuucaaccauaacaguggcuauucacaagccaaauggcgauugauugcaaaaacagggcacuuugacauaugcuccagacauagcacccaccauuucugccgauguauaaaugauggaaccaaaugucagaauggugauugggauuucgcuggugaaaugaaugaaacuuacaauagcaaaaaugauuuuuauucacaugaucugaauuuguuuuacacaauuuuugaaaaugcauucccaggaacaacugaauccuuauuuuaucaauugauccaaaagaaaaauacuacaggggccuccaaagucuuggggaaguuaauaacuaaauaugguaauaauaacauguuuguuggagucuggaaauuuggacaguacuuacuuacauuaccauauauaaauaauacugaauugagccagaauaggagacuaacaauccuggcaacacaagaaauauuaaguaggucgcacucuggcaggcaggagucuauguccaaugcaauucagggcaguauuacaaaagaaugccauaaugcaaaagguguugggugcauaaguccucgguuugguauuccaauugguaaccuuacagcauguggugacucaccuaauuauaagauauauaagacuccagaaaaauuguauaaaucaaauaauaaaggggaaguuugguguucaaaugauguucacugccugaaugauuuugagccugcagaugaagaaguuaucaauaaaauuaagaaacucacuugcuucuuaacagacgucucaguugaaguagacaucuuuucaguggcugcauccacauguaagauggcagacaaaggugucuguacaguaaauggugcuaaauggaauauaaucaagugugauaguggauuauacuauuuuacagaccauagagaaggccaagacacaggcaaugacuuuggugaguauuguauaucucacaguugcaauacugagcgauucccuaucaacccagacacauuaaaagauuguacuugggaguuccauuccagaaaaucuaaauauauuucaaccaucaguuuagaaucauuggaagaauucaggagggcaauggcagagaaguuaucacacacccuaacaauuuacaauuuuaaaccaacagcuaaccuuccucauauuaggccaaccuacaaauucauuacagccaauggugucgaaaacucugacgguauugaaucagcauacaucuugucuagcaucccugcauuagguggaauuaguguugguuauaauguucaaaccaaagacaacuucccauuguuggauauaauuguauuuauuaagagcgcaguuaucaggacaacauacaaucauauuuaugauaccgggccuacuauagguauaaacacacaacaugaugagcacuguacagggccgugcccagcuguggugccacauaaagagaacuggaugacauuuucucaggaaagaacaaguagauggggaugugaagaauuugguugcuuggccaucaacacaggguguguuuucgguucuugccaagauauaauacauccagaaacuaaaguauaccgcaaagcaguagaagaggaaguugucuuaacggugugcaucaauuuuccaggcaauaguuacugcacugaaauaaaugccauugagccuaagauaacagaugagauagagcuccaguucaaaacagucgauacaaaaaccuuacccaaccuucucgcagugcagaaucacaagcuuuacaguggccagauaaacgauuugggcucuuuuucacaagguuguggaaauguccaaaaaacaaaucacucaauccuaggcauggguacagucaaauuugauuaugucugucacggcgcuaguaggaaagaugugacagucaggaggugcuacaacaauaauuuugauucaugcaaauuacugaaagaagaaacaucauuaauauuugcagauaaucaugagacucuagagguagcacacacaaagcaucugauaggugaauuacaguuuaagauaaugcuaggagauauaagauacaaaucauuugcugaaucaccugaguuggaaauugaugcaaaaugugucggguguccaucauguuuugaaagcuacuccugcaacuuucaaauagugacaaauauagacacugugugcucagucgaagggccaugcacacuauuucauaaucgaauuauuauaucagcuaacaaacagucuuaugggcuuaaaaugaguugccaaacaaagccuaaccaaaaugaagaguucauuaucuguaacaggaaauacagugucuuauucacaacaauugauaaaaaugacaaaauagaagugaacacaggggaccagaccucauauauuuaugaaaaggacagcagauguaagacuugguugugcaggguuagagaugaggggaucaguguccuauuugaaccauugaaagcauucuuuggaaguuauuuuagcauaauauuuuauguugucguuggaauuauuguccuuuucuugauuguauacauauuuuugccaauguucuucaaauuaaaagauguuuugaaaagaaaugaauauuuguaucuucaggaacugaaacauaaauaa

SEQ ID NO: 4180 - RNA, 4305 nt, Artificial Sequence
  derived and/or modified CDS sequence (wt) from PLAV(75V5758)__KX100128.1__GP
auggagcuacuuauaauuaucuuguuguuagggagugcagcuaguagcccuguguccacuagguguuuccauggagggcaacuuauugcagaaucaagaucugcaaccucuauaucagaauuuugcuuaaaggaugauguuucaaugaucaaaucagaagucacuuauacaaaaaaugauacagguauauauggccauaauaaaguguucagaagcuggaccaucaaagauuggaaauuaugcaauccuauuccaacugcaggaggcaguaucaauguaauugaggugaauucagaccugagcuuagcaacgaaggcuuaugucugcaguagggacuguacuauaacuauugacaaggaagaugcccagauaauauuccaaacugauaaacugaaccauuuugaaguaucuggaacaacucugaguucagguugguuuaagacuaaagccucagucacccuagacaggacaugcgaacauauuaaggucaccugugggaaaaaaucucuacaguuucaugccuguuuuaagcaccacaugucgugcauaagguucuuucaucauacuauauugccuggaacaaugguaucaucuaugugccaaaauauugaauuaauaauaauaauuggacuuacccuagcuauauuuauacucaugguuaucuuaacuaaaacauacauauguuaucucuugaugccaguauuuaugccaauugcauacauauacggcugggcauacaauaagaguuguaaaaaauguaauuguuguggcuuagcuuaucauccauuuacaaacuguggaucucacugugucugugggcucaaauuugaagcuucagauagaaugagaauacauagggagucagggcuaugccagggcuauaaaagucucaggauagcaagaaugcuaugcaaauccaaggggucaucucuuguuaucucaggauuacuuucgaugcuauuauuaagcuuuauaacaccuauagaaggcacauuaaccaacuacccaaaugagaaacaguacacacuggaagaaauugcagauguuguagaagggauaaugacagagcaacaucuuaaagaauauguggucuuuuauaccucauuauuuggggggcuaauauuauuauuaacucuaauacuaucuauaacaauaaacaaaguaacagaucuccuugcgagcacuaauguuauuuacugcgaagaauguucgauguaucauucaaaaaaaggaauaaaauauaauggggauuucaccaauaaauguggcuuuugcaccugcagugagcaagaagauguagagggaguugucauacauaaaguaagcaggaaaugcacauauaaauaucagcucaaguggguaaggguaauaaugauuauacuagcucugcuuuuaacaauccagaacacagucuuaauuguugcugcagaaguagauuguuggacaaagaaaucuauagaaauugauugcauuggcccuuuacucaauauaggcucauguacugacaagucaggcaaaacauaugagacagaaguuaacaaauuaguaagacaaucuaaagucacacaggcugaugcugaacaaauaucuguuuuggggaacacucuagauagugccauuaaagcuauaaggucacaaaaaacauaugagaccaugcacuuucuagagacuguguucuugaugaaaaauugugacuauuacagcagcuuugagcauaauaguggcuauucacaaacaaaauggaggcucauagcuaaaacaagccacuuugauauuugcucgcggcauagugcccaucauuuuuguagauguguaaaugaagggacaaaaugccaaaauggagauugggauuuugcuggagagaugaauaacacuuacaauaguaagaaugauuuuuaucuccaugauuuagaccuuuucuauacacucuuugaaaaugcauucccuggcacaacugaaucucuguucuaccagcuucuucagaagaaaaacacaaccggugcaucgaaacugcuagggaaauuaauaacaaaauauggcaauaacaacauguuuguuggaauauggaaauuuggucaauaucuucuuaagcugccauauauaaaugauacagaauugagugccgacaggaaaucaacuauaaugaaaucacaacagguguugaguagaucccaaacagggaggcaagaaucccugucuagugcaacuccaggcacugcaacaaaggaguguucaaaugcaaaagauauagguugcauuagcccaagauuuggcauuccuauaggaaaccuuacugcauguggugauucuccaaauuauaaaauauacaagaccccagagaaaaucuauaaaucaaauaacaaaggggaaguuugguguucagaugauguucacugcuuggcagauuuugaaccugcagaagaggagguuguuaauagaauaaaacagaugacuuguuuuuugacagaugugacaacaaagacugauguauuuucuauugcuguuucaacaugcaaaaugguugauaagggugugugcacagucaaugaugcuaaauggaacauccucaaguguaauaguggguuauauuauuucacugaccacagagaugggcaagacacagguaaugauuuuggagaauacuguauuucccacagcuguaauacugaaagauuccccaucaauccagaugucuugaaggauuguaucugggaauaccacuccaggaaauccaaauauaucucuacaauaagccuagaaucauuagaugaguuuagaagggcuaugucagauaagcuaucacauaccuuaaugauuuauaauuuuaagccuacagccaaucucccccacauaaagccagcuuauaaauuuauaacugcuaaugguauagagaauucagauggaauagauucagcauauauauuaucuaguauaccagcucugggugggaugagugucggauauaauguucagacaaaagauaacuucccauuauuagauaucauaguuuucaucaagagugcuauuauuaaaacaaccuacaaucauauauaugacacagguccgacaauaggaauaaauacccaacaugaugaacauugcacugggccaugcccuacauuaauaccucauaaggagaacuggcuaacauuuucucaagaaaggacaaguagaugggguugcgaagaauuugguugcuuggcaauuaacacugggugugucuuuggcucaugccaggauauuauucauccugaagcuaaaguuuacaggaaagcuauagaggaggagguaguuuuaacugucugcauaacauucccagggaauacauacuguacagaaauaaaugcaauagagcccaaaauaacagaugaaauagaauuacaguuuaaaacaguagauacuaaaacauuaccaaauuugcuaaugguucauaaucauaaauuauauaguggccagauuaaugaucuugguucuuuuucccaggggugcggcaaugugcaaaagacuaaucagucuguaaucggggccgggacuguaaaauuugauuauguuugucauggagccaguaggaaagauguuauagugagacgcuguuacaacaauaauuaugagucuuguaagcuguugaaagaagaaaccucccuuauauuugcagacaaccaugaaacguuagaaguagcaaauacaaagcaucugauaggagaauuacaguuuaaaauuauguugggagacauuagauacaagucauuugcugaaucaccagaauuagaaguagaugcaaaaugugugggcugcccuucaugcuuugaaagcuauucuugcaauuuccagauuguuacaaauauugauacuguuuguucuguuaaugggccuuguacacuuuuccauaacagauuaauuauaagugcuacaaagcaaucuuauggucugaaaaugaguuguucaaggaagccugaaccaacagaagaauuccagauauguaaucguaaguauaguguccuuuucacuacaauugacaaaaaugauaaaauugaaaucaauacaggagaccaaacuucuuauaucuaugaaaaggauaacagauguaagacauggcuuugcagaguuagagaugagggaaucaguguuauuuuugaaccuuuaaaggcauuuuucgguaguuacuuuagcaucauauuuuaugugauuguagguauaauuguauuauucuuaauuguuuauauuuuuuugcccauguucuuuaaguuaagagauauauuaaaaagaaaugaauaucuauaccugcaagaauuaaagcacaaauag

SEQ ID NO: 4181 - RNA, 4317 nt, Artificial Sequence
  derived and/or modified CDS sequence (wt) from POTV(89-3380)__EU004189.1__GP
auggaaccuccaaugaaguuguuccuaauacuugcaacugcuguagcugcugucuacagccuaccugcauccagauguuuuagugauggaaucauuauaaaggaaaaacaagacucuaaagcagucagugaauuuuguuugaaggaugaugucucaaugauaaaaucucauguuguauauucuaaaaaugaaucuggaauauuugcaaacagccaaauuuuaaggaaauggauaauaaaagacuggaaacucugcagcccucuaccaacagcuggaggccagauaaaugucauugaaauuaaucaugauuuaacauuaucaacaaaaaccuaugugugcacuacagauuguacaauaggcauugacaaggaaaaugcacagauaacauuucagaccaacaaauuaaauuauuuugaggucucuggaaccacaauuagcucaggaugguucaaaaguaagacaagugugucacuugaccaaacaugugagcaucuaaagguuucaugcggaaaaaaauccaugcaauuccaugcaugcuuuaagcaacauaugucaugcauuagauaucuacauaagacagcacugccagguuauauggcugcuucaauuugcaguaauauagaguuaauuauuaugaccacauuaacacuggcaauauucauccuacuguguauuauaaccaaaacuuacauuuguuaucuacuuaugccacuauucaugccuauugcuuauauauaugguugguuguauaacaagaguugcaaaaagugcaacuguuguggauuauccuaucacccauucacuaauuguggcucuuauuguguuugcggagcuaaguucgagacaucagauagaaugcggauacauagagaaucuggcuuaugccaagguuauaaaagccucagaguugcccggaaauuauguaaauccaaaggcucaucauuagugauaucaguuacccucucuguauuuauauucucauuuauuacaccaauaggggguguuauuauaaaugauaaacuaucagaagaaaaguacagcauaaaucaaaugauggaugcuauaguagaucuugaaaacuucucucauaauguuucaggcacacaacaaguuauuucaguaauauucuuauuaauauccuguuuguuuuugcuguuaacauaccgccucaauaaaaucauacagcacuuagcuaggucuggcuuauuauuuugugaggaauguuccauguaucacucaaaaaaagauauaaaauauaauggggauuucacaaacaaauguggcuucuguacauguggucaaccagaagacccagaaggcuuaaaccuucauauacugucacaaaacuguacauauaagcagcaauuuaaauggguaaaaauaauuauuaguauacuacuaucucuaauaaucauagagaguaguaugauacuggcagcagcagagacagauugcuucucugaaaagcaaauuucagaauucugccuaggaccauugcugucuauuucaagcugugaagauaagaauucuagaacauuuaaaggugaagcacaaaaauuaguagcacugaagaaaauaacuucugaugaagcaauguugauugaaucaaugggugccaaaguggaagaugcauugaaaaugauacaagcucaaaaauccccggacucuauguauacuauggaguauguguuccuaaauacauauugugauuauuacucucuuuuugagcacaacagugguuauucacagauaaaauggcguuauauccuuaagacacaucaauuugaugcaugugcaaggcauucuaacaaccacuuuuguagauguaugagugaugggaugcauugccccagcuuggauugggauauagcagaugaacuaaauaacacauauauaacaaagccaaauuucuuuaagcaugauuauaaucuauuauuagauguaauaaccgcagcauuuccaggaacaggugcuguuuuuguaauugaugcuuguaagaaagcaaaugcuacagcaaucaagacuuucuccaauaauauuauagcuagauuuccauauaacaacuuacuaaaaggaguaaugaaauuccugcaguauauaaguaagcauccaucuuucaaaaaguaucaaccagauacacggcauuaugaccuaaucccaguagcacccacugcaagagguagaucucuaggaaggucaaauaguuacagugaugcacaaguuggucccccaacaaaagauugccaaaagcugaaagaaguugguugccuaagcccaaaauuuggucugccacuagaaaguaucauaucuugcgguucaucaccuaacuacaaacuauauaaaaaaccccaaaaauauuacaaaucaaacaacaaagaaaacacuuggugcagcaaagauguacauugccuccaugauuuugaaccaauaacagaggauguuuuagaaaaaguaaaagucaugacauguugggagauagaaccaggaacuauugaagacaucuuuaccauugcaucagagaccugcaaaaucaaugaucguggcguaugugaagugaaugcagcaaaauggaagauugugaagugugagacaggucucuacuauuacacugaccauagagagggugaugauacugggucagauuuagggcacuacugccugacacauaagugugcagggggaagauauccuaucaauccugaaauuuuacaaaacuguauuugggaguuucauucgcagaagucacaguauaucaaucaaguggaucuugagcaaauagaagaauauaagaaggccuuaacagagaagcuaacucauacuuugaaucauuauaauuuuuuaccuacuaaaaaucucccacauaucagcccuaauuacaaauaugugacccuaaauggccaagaaaccucugaugguauagaaaauucuuacauagugucagagauaccagcaauugcagguacaucaauuggccucaaaguacaaacaaaaaauaaugguaacauauuugaccugauuauauauguaaagagagcugauauuauugcaaguuauaaucauauauacgacacagggccaacuauuggccacaauguagagcaugaagaguuaugcacaggccaauguccucaacauauaccagcuaaagccaauuggcucacauuuucucaggaaagaacaaguagaugggggugugaagaauuuggcugccuggcuauaaacacaggcuguguguacggcuccugccaggauauuauaaaaccaguggcaaaaguuuacaggaaaucuacagaagaaaaaguugaacuugaguuguguauaguauugccagauaggaauuuuuguacuacucuaaaugcauuagagccuaagauuacagaggaaauagagcuacaauucaaaacuauagaucaagugagccuuccuaauauaguucugcugagagaccauaagcuauuuaagggccaaauuaaugauuuagggaccuucgggcaaaacuguggcaauguucaaaaaacuaaccaaaguaucuugggagcugguacaguuagauuugauuaccuaugucauagugcauccagaaaagauaucaucauacggaggugcuauaauaauaacuaugauucauguaaucauuugcaacuugcagaaucuuuaauuuuucuggauaaucaugaaacacuagaggucaggaaaccaaaccauauuuuaggaacuuugucaaugaaauuaaugcuaggcgauuuucaauacaaaacauuugcuaaggacauagaacuugauuuuacugguagauguguuggguguaucgguuguuuugaaggguuugucugcgagaugcauauuacaacaacuguagaagcaaccuguaaucuagaggcgucaugccaauucuuucauaaccaacugcauauuaaaccagauguacugaaauacuauacaaagaugacaugccaaacugaugaguauauaccaucaaagaucaaaauaugcaauaaagaauacaaaaucacuauugggaaaguccgaaaaaaugauaaaauugaaauagacaauagugaucagaccaguuauauaaaagaaaaagaugagagguguaaaacuuggcucugccgaguuagggaugaagggauaucagugaucuuugagccauuacuaaauauauuuggcaacuauggaagaauugcaguugcagucauuagugcaauauuggcauugauuguacuaguauacaucuuaaugccaauauguaugaaaauaagggauauacucaagacuaaugagaaggaguuccuaauugaaucaaaauacaaauag

SEQ ID NO: 4182 - RNA, 4311 nt, Artificial Sequence
  derived and/or modified CDS sequence (wt) from TENV(TSV-FE3-66FB)__FJ943508.1__GP
auggagauauuuuucauugcuuuauuggcaauugccaauucaguuaauuccacaccacuggcaacacgaugcuuucaugguggucaauuaauugcagaaucaaagucugcaacaucacucucagaauuuugucuuaaagacgacguuucuaugauaaagucagagaucuacuaugugaagaaugaaaccggaauauucagucauaauaaaguucucaggaguuggacaauuaaggauuggaaauucugcaacccagugccuacagcaggugguaguauaaaugucauagaaguuaacucagacaugagucuagcaacaaaaacauaugucuguagcagagauuguacuauaacaauagauagagaagaagcucagauuauauuccaaacagagaaguuaaaccauuuugagguaucugggaccacccuaagcucaggcugguuuaaaucaaaggcaucugugacauuagacagaacaugugagcaucuuaaaguuacaugugggaagaaaucucuccaauuucaugcuuguuuuaaacaccacauguccugcauccgguucuuccauaauacuaugcuaccugggaggauaguuaacucuaugugucaaaacauagaauuaaucauaauacuuggcuuaacaauaguuauauuuaucuuaauggugauacuaacuaagacauauaucugcuauauuuuaaugccucuauucaugccaauagcuuacauauauggcugggcauauaacaagaguugcaaaaaaugcaauugcuguggguuagcauaccauccuuuuacaaauuguggcucucacuguguguguggucuaaaauuugaagccucagacagaaugcgcauacauagagaaucaggauuaugucaagguuauaaaagcuugagaauagcaagauuacuguguaaaucaaaaggcucaucguugguuauuucuaucuugcuaucuaugcugcuguuaaguuuugugacaccuauagaaggggcucuaacaaacuacccucagucaaaacuauacucucuugaagagauugcagauguuguugagggcuugaucacagaacacaauguuaaagaauauauuguuuucuacaccucauuauuuggaggauuaaucuuguuacuugcauucaucuuaucuaucaugcuaacaaaagugaccaguaugcuugcuagaacaaaugucauuuacugugaagaauguucaauguaucacucaaaaacagggauaaaguauaauggugauuucacaaauaaaugugguuuuugcacaugugaugaacaagaagaugcggaagguauaaucauacauaagguaagcaagaagugcacuuauaaauaucaacuaaaaugggcuaggaucauuaugauaauauugauugucuuauuaacaacacaaaauacaauucuuauaguugcugcagaaguagauugcugggaaagagcaacacuuagucaggaaugcauugguccauugcaaaagauagaagauugccaaaauaaagaagaaaagaccuacaugucugaagccaacaaacuuguuagccagucaaaaauaacacaagcagaugcugaucaggugucuguacuaggggauacaauagauagcgcaaucaaagcuauaagaucgcaaaagacauaucagacuaugcaucugcuagagacaguauucuugaugaagaacugugauuauuacagcacuuuugaacauaauagcgguuacucucaggcaaaauggagacuaauggcaaagacaaaucauuuugacauaugcucuagacacagcaaccaccauuuuuguagaugugugacugaagguacaaaaugucaaaauggugauugggacuuugcaggugaaaugaauucuacauauaauacaaaaagugauuuuuaccaacaugauuugaaccucuucuucucacuauacgaaucagccuucccugguacugcagaaucauuauucuaucaacuaauaucagaaaaaaacacaacaggggcaucccaauugcuuggacaaauuauuaaaaaguuugcaaauaacaauaugcuuauaggagucuggaaauuuggacaguaccucuuaacauugccuuaugucaacaccacaaaacuaagcaaaucuagagaagaaaccauauugacaaaucaucaacguuuagucaggaguuacacuggcagacagcagucaauggccaaugcugaaguuggugaaucaaccaagaauugccucaaugcuaagaauguuggcuguauuagcccuagauuuggagucccuauugguaaccugacuguauguggggaaucuacaaauuauaaggucuacaaaacaccagccaaaauauauaaaucaaauaauaggccuaagacuuggugcucagaagaugugcacuguuuaucuaauuuugagccugcaagugcagagguagucaacaaaauaaagcgaaugacaugcuuuuugacagaugucacaacaaauguagaugucuucucaauagcuauaucaacuugcaaaauggcugauaaaggugugugcacugugaaugaugcuagauggaguauucugaagugugacaguggccugcucuauuuuacugaucauagagagggccaagauacaggaaaugauuuuggagaguauuguaucucacauaacugcaacacagagcgauaucccaucaauccagauaucaucaaggacugcauaugggaauaucauucaaggaagucaaaguauauaucagcaauuaacuuagagucauuagaggaauucagaagagcuaugucagaaaagcuaucucauacccuaguaauuuauaauuucaaacccacagcaaauuuaccacauauuaaaccuaguuacaaaucuaucacaguuaaugggauagaaaauucagauggcauagagucagcauauaucuuaucuaauaucccagcuauagguggcaugagugucgguuauaauguacugacuaaggauggcuucccacuauuagauauaauaauauucaucaaaagugcaguuaucaaaacaacuuauaaucauauuuaugauacaggaccaacaauaggaaucaauacuuuacacgacgaaaagugcacagggccaugcccaucuauaauaccacauaaagaaaacugguuaacauuuucacaagaaaggacaagcagaugggguugugaagaauuugguugcuuggcuauaaauacagguugugucuuugguucaugccaggauauuauucggccagaaaccaaaauuuacagaaaagcuguagaagaggaaguuauauugaaugcaugcauaaauuucccaggcaauacauacuguacugaaauaaaugcaauugagccaaaaauuacugacgagauugagcugcaauucaaaacuguagauacuaagacauuaccaaacuuauuagcaguacaaaaucacaaacuauauaguggucagauuaaugauauagggacauucucacagggauguggaaaugugcaaaaaacuaaucaaacuaugcuuggcacuggcacaguaagguuugauuauguuugucauggagcuagcaggaaagauauuauaguuagaagaugcuauaacaauaauuaugaaucuuguaaauugcugaaagaagaaaaaucucuaauauuugcugacaaccaugagacauuagaaguugcaaauacaagacaucugcuaggugaauuacaguuuaagauaauguuaggugauaucagauacaaggcauuugcugaaaaaccugaacuggaaauagaugccaaguguguuggauguccaucauguuuugaaaguuauucuugcaacuuccaaauuguaagcaauguggauacuguuuguuacauagaaggaccauguacacuuuuccacaauagaauuaucauaaaaacaaugaagcaagcauaugggauuaaaaugagcugcaaaacaaagccagccccuagugaagaauucaaaauaugcggacguacuuauaauguugcuuuuaauacaguggaaaaaaaugauaagauugaaauaaauacuggugaucaaacgucauauauaagugaaaaggacgauagguguaaaacaugguugugccguguucgagaugaaggcauaagugucaucuuugaaccauuaaaaaaucuauuuggaaauuacuuuaacauugcauucuauauaauaauaggucuaauugcguuauuuuuaacaauuuauaucuucuuaccaauguucuucaaauuaagagauguuuugaaaagaaaugaguauuuauacuugcaggaguugaaacacaaauaa

SEQ ID NO: 4183 - RNA, 4311 nt, Artificial Sequence
  derived and/or modified CDS sequence (wt) from TENV(TSV-FL06)__FJ943506.1__GP
auggagauauuuuucauugcuuuauuggcaauugccaguucaguuaauuccacaccacuagcaacacgaugcuuucaugguggucaauuaauugcagaaucaaagucugcaacaucacucucagaauuuugucuuaaagaugacguuucuaugauaaagucagagaucuacuaugugaagaaugaaaccggaauauucaguuauaauaaaguucucaggaguuggacaauuaaggauuggaaauucugcaacccagugccuacagcaggugguaguauaaaugucauagaaguuaacucagacaugagucuagcaacaaaaacauaugucuguagcagggauuguacuauaacaauagauagggaagaagcucagauuauauuccaaacagaaaaauuaaaccauuuugagguaucugggaccacucuaagcucaggcugguuuaaaucaaaggcaucugugacauuagacagaacaugugaacaucuuaaaguuacaugugggaagaaaucucuccaauuucaugcuugcuuuaaacaccacauguccugcauccgguucuuccauaauacuaugcuaccugggaggauaguuaacucuaugugucaaaacauagaauuaaucauaauacuuggcuuaacaauaguuaucuuuaucuuaauggugauacuaacuaagacauauaucugcuauauuuuaaugccucuauucaugccaguagcuuacauauauggcugggcauauaacaagaguuguaaaaaaugcaauugcuguggguuagcauaucauccuuuuacaaauuguggcucucacuguguauguggucuaaaauuugaagccucagacagaaugcgcauacauagagaaucaggauuaugucaagguuauaaaagcuugagaauagcaagauuacuguguaaaucaaaaggcucaucguugguuauuucuaucuugcuaucuauguugcuguuaaguuuugugacaccuauagaaggggcuuuaacaaauuacccucagucaaaacuguacucucuugaagagauugcagauguuguugagggccugaucacagaacacaauguuaaagaauauauuguuuuuuacaccucauuguuuggaggauuaaucuuguuacuugcauucaucuuaucuaucaugcuaacaaaagugaccaguaugcuugcuagaacaaaugucauuuacugugaagaauguucaauguaucacucaaaaacagggauaaaguauaauggugauuucacaaauaaaugugguuuuugcacaugugaugaacaagaagaugcagaagguauaaucauacauaagguaagcaagaagugcacuuauaaauaucaacuaaaaugggcuaggaucauuaugauaauauugauugucuuauuaacaacacaaaauacaauucuuauaguugcugcagaaguagauugcugggaaagagcaacacuuagucaugaaugcauugguccauugcaaaagauagaagauugccaaaauaaagaagaaaagaccuacaugucugaagccaacaaacuuguuagccagucaaaaauaacacaagcagaugcugaucaggucucuguacuaggagauacaauagauagcgcaaucaaagcuauaagaucgcaaaagacauaucagacuaugcaucugcuagagacaguauucuugaugaaaaacugugauuauuacagcacuuuugaacauaauagcgguuacucucaggcaaaauggagacuaauggcaaagacaaaucauuuugauauaugcucuagacacagcaaccaccauuuuuguagaugugugacugaagguacaaaaugucaaaauggugauugggacuuugcaggugaaaugaauucuacauacaauacgaaaagugauuuuuaucaacaugauuugaaccucuucuucucacuauacgaaucagccuucccugguacugcagaaucauuauucuaccaacuaauaucagaaaaaaacacaacaggggcaucccaauugcuuggacaaaucauuaaaaaguuugcaaacaauaauaugcuuauaggagucuggaaauuuggacaguaccucuuaacauugccuuaugucaacaccacaaaacuaagcaaaucuagagaagaaaccacauugacaaaucaccaacguuuagucaggaguuacacuggcagacagcagucaauggcuaaugcugagguuggugaaucaaccaagaauugccucaaugcuaagaauguuggcuguauuagcccuagauuuggagucccuauugguaaccugacuguauguggagaaucuacaaauuauaaggucuacaaaacaccagccaaaauauauaaaucaaauaauaggccuaagacuuggugcucagaagauguacacuguuuaucuaauuuugagccugcaagugcagagguagucaacaaaauaaagcgaaugacaugcuuuuugacagaugucacaacaaauguagaugucuucucaauagcuauaucaacuugcaaaauggcugacaaaggugugugcacugugaaugaugcuagauggaguauucugaagugugacaguggccugcucuauuuuacugaccacagagagggccaagauacaggaaaugauuuuggagaguauuguaucucacauaacugcaacacagagcgauaucccaucaauccagauaucaucaaggacugcauaugggaauauuauucaaggaagucaaaguauauaucagcaauuaacuuagagucauuagaggaauucagaagagcuaugucagaaaagcuaucucauacccuaguaauuuacaauuucaaacccacagcaaauuuaccacauauuaaaccuaguuacaaaucuaucacaguuaacgggauagaaaauucagacggcauagagucagcauauaucuuaucuaauaucccagcuauagguggcaugagugucgguuauaauguacugacuaaggauggcuucccacuauuagacauaauaauauucaucaaaagugcaguuaucaaaacaacuuauaaucauauuuaugauacaggaccaacaauaggaaucaauacuuuacacgacgaaaagugcacaggaccaugcccauccauaauaccacauaaagaaaacugguuaacauuuucacaagaaaggacaagcagaugggguugugaagaauuugguugcuuggcuauaaauacagguugugucuuugguucaugccaggauauuauucggccagaaaccaaaauuuacagaaaagcuguagaagaggaaguuauauugaaugcaugcauaaauuucccaggcaauacauacuguacugaaauaaaugcauuugagccaaaaaucacugacgagauugagcugcaauucaaaacuguagauacuaagacauuaccaaacuuauuagcaguacaaaaucacaaacuauauaguggucagauuaaugauauagggacauucucacagggauguggaaaugugcaaaaaacuaaucaaacuaugcuuggcacuggcacaguaagguuugauuauguaugucacggagcuagcaggaaagauauuauaguuagaagaugcuauaauaauaauuaugaaucuuguaaauugcugaaagaagaaaaaucucuaauauuugcugacaaucaugagacauuagaaguugcaaauacgagacauuugcuaggugaauuacaauuuaggauaauguuaggugauaucagauacaaggcauuugcugaaaaaccugaacuggaaauagaugccaaguguguuggauguccaucauguuuugaaaguuauucuugcaacuuccaaauuguaagcaauguggauacuguuuguuacauagaaggaccaugcacacuuuuccacaauagaguuaucauaaaaacaaugaagcaagcauaugggauuaaaaugagcugcaaaacaaagccugccccuagugaagaauucaaaauaugcggacguacuuauaauguugcuuuuaauacaguggaaaaaaaugauaagauugaaauaaauacuggugaucaaacgucauauauaagugaaaaggaugauaggugcaaaacaugguugugccguguucgagaugaaggcauaagugucaucuuugaaccauuaaaaaaucuauuuggaaauuacuuuaacauugcauucuauauaauaauaggucuaauugcauuauuuuuaacaauuuauaucuucuuaccaauguucuucaaauuaagagauguuuugaaaagaaaugaguauuuauacuugcaagaguugaaacacaaauaa

SEQ ID NO: 4184 - RNA, 4305 nt, Artificial Sequence
  derived and/or modified CDS sequence (wt) from TLAV(61D240)__KX100119.1__GP
augcuauucuugcucauacuagccuuuuuaggguucucaacgagcaacccuauugcaacuagguguuuccaugggggccaauuaauagcagagucaaagucugcuacaucuauaucagaauucugccucaaggaugaugucucaauguuaaaaucugaagugguauauacaaagaaugauacugggcuauuuggucauaauaaaguuuuuagaagcuggacaauaaaagauuggaaacucugcaauccuauaccuacugcaggaggaacaauaaauguaauugaggucaauaaagaucuuagucuaaugacaaagacauacauauguaguagagauugcacuauaaccauagauaaagaggaagcucagauuaucuuccaaacagauaagcuaaaucauuuugaagugucugguaccacauuaaauucaggaugguucaaaagcaaggcgucugucacccuggauagaaccugcgagcauguuaagguuacuuguggaaaaaaaucucugcaauuccaugcaugcuuuaagcaccacaugucauguguuagguucuuccacaauaccauauuaccuggcaauaugauaaccucaaugugccagaauauagaauuaauaauuaucuuagggcuaacauuagccauauuuauauuaaugguuaugcuuacaaagacuuauauauguuacuuauugaugccaauuuucaugccaauagcuuaucuuuaugguugggccuauaacaaaagcugcaaaaaguguaacugcuguggucuagcauaccauccauuuacuaauuguggcucacacuguguuuguggcuugaaauuugaggcaucagauaggaugaggauccauagagaaucuggcuugugucaaggguacaagaguuuacgaauugccaggcuuuuguguaaaucuaaagggucaucucuaguuauaucuggauuauuguccauguuaaucuuaagcuuuguaacgccuauagagggaacuauaacuagcuacccagaaagcaggaaauauacacuggaagagauaacagauguuguugaaggauugguaucugagcagaauauaaaggaguacauuguuuucuacaccucauuguuuggaaguuuaauacuauuacuagcauuuauaaugucuauaacuuuaagcaaaauaacaagcauacuagcaagaagaaauguuauuuauugcgaagaaugcucaauguaucauucaaaaagaggcauaaaguauaacggugacuucacaaacaaaugcggcuuuugcacaugcaaugaacaggaggaugcagaaggguuaguaauacauaaaguuaguaagagaugcacauauaaauaucaacuaaagugggcuaaagugcugaugguuacacuggucuugcuucuaauagcgcaaaacacuauucuaauuguugcagcuggaacagauugcuggacaaaaaaaagccuagauauagacuguauaggaccaauguuagacauaggcucuugcacaaauaagaauaccagaaacuaugauacagaagcacagaaauuggugagccagucuaaaguaagucaacuagaugcagaccaggcaucguuguuaggcaacucuauagauagugcuauuaaagcaauaagagcccagaaaacuuauccuacaaugcacuuguuggaaacaauauucuuaaugaaaaauugcgauuauuacacaaguuuuaaccauaacaguggcuauucacaagcuaaauggcgauuaauugcaaaaacagggcacuuugauauauguucuagacauagcacccaccauuuuugccgauguauaaaugaugggaccaaaugucagaauggugauugggauuuugcuggugaaaugaaugaaacuuacaauagcaaaaaugauuuuuauucacaugaucugaacuuguuuuacacaauuuuugaaaaugcauucccagggacuacugaauccuuauuuuaccaguugauccaaaagaaaaauacuacaggggccuccaaaaucuugggaaaguuaauaaccaaguaugguaauaagaacauguucguuggagucuggaaauuuggacaguacuuacuuacauuaccauauauaaauaauacugaauugagccagaacaggagacaaacaaucuuggcaacacaagaaucauuaaguagaucgcacucuggcaggcaggagucuauguccagugcaauucagggcaguguuacaaaagaaugccauaaugcaaaagauguugggugcauaagcccucgguuuggcauuccaauugguaaccucacagcauguggcgacucaccuaauuauaagauauauaagacuccagaaaaguuguauaaaucaaauaauaaaggggaaguuugguguucgaaugauguucacugccugaaugauuuugagccugcagaugaagaaguugucaauaaaguuaaaaaacucacuuguuucuuaacagacgucucaguuaaaacagacaucuuuucaguagcugcauccacauguaagauggcagauaaaggcguuuguacagugaaugaugcuaaauggaauauaaucaagugugauaguggauuauacuauuuuacagaccauagggaaggucaggacacaggcaaugauuuuggugaguauuguauaucucacaguugcaauaccgagcgauucccuaucaacccagacauauuaaaagauugcacuugggaguuccauuccagaaagucuaaauauauuucaaccaucaguuuagaaucauuggaagaauucaggagggcaaugacagagaaguuaucacacacccuaacaauuuacaauuuuaaaccaacagcuaaccuuccucauauuaggccaacuuacaaauucaucacagcaaauggugucgaaaacucugacgguauugaaucagcauauaucuugucuaguaucccugcauuagguggaauuaguguugguuauaauguucaaaccaaagacaauuucccauuauuggauauaauuguauuuauuaaaagugcagucaucaggacaacauacaaccauauuuaugauacugggccuacuauagguauaaacacacaacaugaugagcacugcacagggccaugcccagcuguggugccacauaaagaaaacuggauaacauuuucucaggaaagaacaaguagaugggggugugaagaguuugguugcuuggccaucaacacaggguguguuuuugguucuugccaagauauaauacauccagaaaccaaaguauaccguaaagcaguagaagaagaaguuaucuuaacggugugcauuaauuucccagguaauaauuacugcacagagauaaacgccauugagccuaagauaacagaugagauagagcuccaguucaaaacagucgauacaaaaaccuugcccaaccuucuugcagugcaaaaucacaaacuuuacaguggccagauaaacgauuugggcucuuuuucacaagguuguggaaauguccaaaaaacaaaucacucaauccuaggcauggguacagccaaauuugauuaugucugucauggugcuaguagaaaagaugugauagucaggaggugcuauaauaauaauuuugauucaugcaaauuacugaaagaagaaacaucauugauauuugcagauaaucaugagacucuggagguagcacacacaaagcaucugauaggugaauuacaguuuaaaauaauguuaggagauauaagauacaaaucauuugcugaaucaccugagcuggaaauugaugcaaaauguguuggguguccaucauguuuugaaaguuacuccugcaacuuccaaauagugacaaauauagacaccguaugcucagucgaagggccaugcacacuauuucauaaccgaauuauuauaucagcuaacaagcagucauauggacucaaaaugaguugccaaacaaagccuaaccaaaaugaagaguucauuaucugcaacaggaaauauaguguccuauucacaacaauugauaaaaaugacaaaauagaagugaauacaggggaccagacuucauauauuuaugaaaaggacagcagauguaagacuugguugugcaggguuagagaugaggggaucaguguccuauuugaaccauuaaaagcauucuuuggaaguuacuuuagcauaauauuuuauguugucguuggaauuauuguccuuuucuugauuauauacauauuuuugccaauguucuucaaacuaaaagauguuuugaaaagaaaugaauauuuguaucuucaggaacugaaacauaaauga

SEQ ID NO: 4185 - RNA, 4305 nt, Artificial Sequence
  derived and/or modified CDS sequence (wt) from NRIV(9800535)__AY593725.1__GP
auguugcuacuucuugucuuauuaauccccugcuauguaucagccucuccuguaguaacaagaugcuuccauggagggcaauugauagcagagaagaaaucccaaacagcuguaucagaauuuugccugaaagaugaugucucuacuauuaagucagaaauaacauaugagaagaacaacacugguuuauuugcccauagcaaaguuuuacgaaauuggaucauaaaagauuggaaaaauugcaacccuguucccacagcagggggcagcauaaauguuauagaagucaauacagaucugagcuugaccacaaaaacauauguguguagcagagacugcacaauuacaguugauaaagaggaugcucagauaauuuuccaaaccgagaaguugaaccauuucgaggucucugggacuacauuaagcucaggcugguuuaaaaccaaagcaucaguaacauuggacaggacuugugaacauauuaaaguaacaugugggaaaaagacucugcaauuccaugcuugcuuuaagcaccacaugucauguauuagauucuuccauggcacuauucuuccuggaacaauggcuacuuccauuugucaaaauauagaacucauaauuauaauaagucugacauugauuaucuuuauccugaugauaauauuaaccaaaaccuauauauguuaucuauugaugccacuauuuaugccgauugcauacuuuuaugguuggucauauaacaaaagcugcaaaaaaugcucaugcuguggucuagcuuaucaccccuuuacaaauugcgggucacauuguguaugcggguuaaaauuugaagcgucagauaggaugagaauacacagagaauccggauuaugucaagguuauaagagucuacguguggcuagauuguugugcaagucaaaagguucaucucucguaaucucaauauuauuaucuauguugauacuaagcuuugucacaccaauagaggggacauuaacuaacuacccagaaucaaggaaguaugaucuggaggaaauugcugauguccuggaaggauuuauuguagaaaaagggauaaaagaauacguaguuuuuuauacuucuauuuuuggggcuuuacucuuacuaauagcauuaguuaucacaauaacacuaaauaagguuacagaguaucucacaaacaucaauguucuauacuguuaugaauguucaauguaucacucgaagaagaauauaaaauauauuggggauuuuacaaauaaauguggcuuuugcacauguggagaguuggaagaucaagaagguuuaaaaauacauaaaguuagcagaaagugcauauauaaauaucaacuaaccuggucuaaaauaaucaugacaauacuagugugucuacugauugcucaaaacaccauccuaauagucgcagcaucggaugauugcuggacaaaaaaaucuuuagagauggaauguauaggcccuuuacagcaaguggauacaugcgacgauaaagcaagcagaucuuauaguggggaggcaagaaagcuagugagagcaucuaaaauaucggaccuggaugcagcacagguggggcuauuaggaucuacgauagaaucagcaauagcaaguauaagaaagcagagaacauauccaaccaugcaucuccuugaaucaguauuccugggaaagcauugugauuacuauaaaacuuucgaacauaauaguggcuacucacaggcaaaguggagguuaacagcuaaaacacaucauuuugauauuugcucaagacauagcacccaucauuucuguagauguaucucagaugggacaaagugucaaaauggggauuuggacuuugcaggugaaaugaacucaacauaccagucaaaaaaggauuuuuuugagcacgacuucaagcuauucugcacucuuguagaaaaugcuuuuccaggcacaacagagucacuuuuuuaugaaauguugucuaagaaaaacacaacugguaucaaacagcuauuagauaaauuaacaagaaaauuugggaauaacaauauguuuguagggauauggaaauuuggacaguaucuaaugucacugccauauauuaaugaaacaucauuaaccccugcucaaauuucuaaaauacuagagguuacagaccagcaccaucggucuauaucuggaaggcaagaaucauuggcuagugcuaccccugggaguaaguccaaggaauguggucaugcaaaaaaggucucuugcauaagucccagguuuaguguuccgauggaaggauuaauggcauguggggacucaccaaauuacaaaauuuauaaaacaccaacaaagcuuuauaaaucaaacaauaagggggaaguguggugcucaggugauguccauuguucucaggagcuaagcccagcaucacaagaaucuguugacaggauaaaacaaauuacuugcuuucugacagaaccugaaguaagugaugacguuuuuucaauugcaauaucuacgugcaaaguucaagauaaggggguauguacaguaaaugaagauagguggaacguaauaaaaugugauagugggcugauauauuauacugaccagagagaugggcaggauacaggcaaugauuucggagaguauuguuugucccauagcugcagaauagagagguuccccauaaacccggcaauaauuagggacuguuuaugggaguaccauucgcggaaauccaaauauaucaccagcuuggacuuagagaaucuagaagaauucaaaagggcuauuucugaaaaauuaucacauacucuuauaguuuauaauuucaaaccaacagcuaaucuuccccauauaaagccgguguacaaauauaucacagugcaagggguagagaauucugauggaguagauucagcauauauagcugcuaguaugccagcuuugagcggaacaaguauaggauauaauauaaugucuagagauaauuucccauuauuugauauaauuauauuuauaaaaagugcuauuauuaaggcaacuuacaaucauauauaugacacaggccccacuauaggaauuaauguaaugcaugaugaacauugcacagggcaauguccaacagauauaccacauaaagaaaauuggauuacauuugcucaagagagaacuagucguuggggaugcgaagaauuugggugccuugcuguaaauacaggcuguguuuuugguucuugucaagauauaauaaggccagaaacaaagguguaucgaaaagcaguugaggagaguguuuuauugacaguauguauaacuuacccaggcaaaacauucugcacagaaauaaaugccauagaaccuaaaaucacagaugaguuagaauuacaguucaaaacaguugauacaaaaacauuacccaauaucuuagcuguccaaaaccauaaguuauauaguggacaaauuaaugauuugggaucauuuucucaaggcuguggcaacauacagagaaccaauucaucuauuauaggcacagguacugcaaaguuugauuauguuugucauggugcuuccaggaaagauaucauuguaaggagauguuacaauaauaacuaugagucaugcaaauuauugaaggaggaacaaucuuuaauguucgcagauaaccaugaaacuauugacguagcuaaugucagacaucuccuuggagaucugcaauuuaaauuaauguugggagaucuaagguauaagucauuugcugaaaacccagauuuagaaauagaggcaaaguguguugggugcccaucauguuuuacuaguuacuccugcagcuucaagauugcuucaaauauugacacuguaugcucaauugaagggccuuguacgacuuuucauaauagauuaaugauuaccucuacaaaacaagauuauggcaucaaaaugagcuguaaaacaaaaccaaaagaaacagaagaguuccagauuugcaagaaaacuuacacaguauuguucacaacaguugagaaaaaugauaaaaucgaaauaagcacaggggaucaaacauccuuuauccaagagagggaugauagaugcaaaacaugguuaugcagaguuagggaugaagggaucaguguuauuuuugaaccaauaagggcuuucuuuggaagcuacuuuaguauagcuuuuuauguagugaucaguauuauuguccuauuucuagcaaucuacaucuucuugccuaugguguucaaacuuagagauguguuaaaaaggaaugaauaucuauacuugcaggaaauaaagcauaaauaa

SEQ ID NO: 4186 - RNA, 4305 nt, Artificial Sequence
  derived and/or modified CDS sequence (wt) from NRIV(GSA/TS7/5170/WT)__KM514677.1__GP
auguuguuacuucuugucuuauuaauccccugcuauguaucagccucuccuguaguaacaagaugcuuccauggagggcaauugauagcagagaagaaaucccaaacagcuguaucagaauuuugccugaaagaugaugucucuacuauuaagucagaaauaacauaugagaggaacaacacugguuuauuugcccauagcaaaguuuuacgaaauuggaucauaaaagacuggaaaaauugcaacccuguucccacagcagggggcagcauaaauguuauagaagucaauacagaucugagcuugaccacaaaaacauauguguguagcagagauugcacaauuacaguugauaaagaggaugcucagauaauuuuccaaaccgagaaguugaaccauuuugaggucucugggacuacauugagcucaggcugguuuaaaaccaaagcaucaguaacauuggacaggacuugugaacauauuaaaguaacaugugggaaaaagacucugcaauuccaugccugcuuuaagcaccacauguccugcauuagauucuuccauggcacuauucuuccuggaacaauggcuacuuccauuugucaaaauauagaacucauaauuauaauaagucugacauugauuaucuuuauccugaugguaauauuaaccaaaaccuauauauguuaucuauugaugccacuauuuaugccgauugcauacuuuuaugguuggucauauaacaagagcuguaaaaaaugcucaugcuguggucuagcuuaucaccccuuuacaaauugcgggucacauuguguauguggguuaaaauuugaagcgucagauaggaugagaauacacagagaauccggauuaugucaaggcuauaagagucuacguguggcuagauuauugugcaagucaaaagguucaucccuuguaaucucaauauuauuaucuauguugauacuaagcuuuguuacaccaauagaggggacauuaacuaacuacccagaaucaaggaaguaugaucuggaagaaauugcugauguccuggaaggauuuauuguagaaaaagggauaaaagaauauguaguuuuuuauacaucuauuuuuggggcuuuacucuuacuaauggcauuaguuaucacaauaacacuaaauaagguuacagaguaucucacaaacaucaauguucuauacugucaugaauguucaauguaucacucgaagaaaaauauaaaauauauuggggauuuuacaaauaaauguggcuuuugcacauguggagaguuggaagaucaagaggguuuaaaaauacauaaaguuagcagaaagugcauauauagauaucaacuaaccuggucuaaaauaaucaugacaauacuagugugucuacugauugcucaaaacaccauccuaauagucgcagcaucagaugauugcuggacaaaaaaaucuuuagagauggaauguauaggcccuuuacagcaaguggauacaugcgacgauaaagcaagcagaucuuauaguggggaggcaaaaaagcuagugagagcaucuaaaauaucagaucuggaugcagcacaggugggguuauuaggaucuacgauagaaucagcaauagcaagcauaagaaagcagagaacauauccaacuaugcaucuccuugaaucgguauuccugggaaagcauugugauuacuauaaaacuuucgaacauaauaguggcuacucacaggcaaaguggaggcuuacagcuaaaacacaucauuuugauauuugcucaagacauaguacucaucauuucuguagauguaucucagaugggacaaagugccaaaauggggauugggauuuugcaagugaaaugaacucaacauaccagucaaaaaaggauuuuuuugagcacgacuucaagcuguucugcacucuuguagaaaaugcuuuuccagguacaacagagucacuuuuuuaugaaauguugucuaagaaaaacacaacugguaucaaaaacuuauuagauaaauuaacaagaaaauuugggaauaacaauauguuuguagggauauggaaauuuggacaguaucuaauaucacugccauauguuaaugaaacaucauuaaccccugcucaaguuucuaaaauacuagagguuacagaccaacaccaucggucuauaucuggaaggcaagagucgcuggcuagugcuaccucugggagcaaguccaaggaauguggucaugcaaaaaaggucuccugcauaaguccuagguuuaguguuccgauggaaggauuaauggcauguggggacucaccaaauuacaaaauuuauaaaacaccagcaaagcuuuauaaaucaaacaauaagggggagguguggugcucaggugauguccauuguucucaggaacuaagcccagcaucacaagaaucuguugacaggauaaaacaaauuacuugcuuucugacagaaccugaaguaagugaugacguuuuuucaauugcaauaucuacaugcaaaguucaagauaaggggguauguacaguaaaugaagauagguggaacguaauaaaaugugauagugggcugauauauuauacugaccagagagaugggcaggauacaggcaaugauuucggagaauauuguuugucccauagcugcagaauagagagguucccaauaaauccgacaauaauuagugauuguuuaugggaguaccauucgcggaaauccaaguauaucaccagcuuggacuuagagaaucuggaagaauucaaaagggcuauuucugagaaauuaucacauacucuuauaguuuauaauuucaaaccaacagcuaaucuuccccauauaaagccgguauacaaauauaucacagugcaagggguggagaauucugauggaguagauucagcauauauaucugcuaguaugccagcuuugagcggaacaagcauaggauauaauauaaugucuagagacaauuucccauuauuugauauaauuauauuuauaaaaagugcuauuauuaaggcaacuuacaaucauauauaugacacaggucccacuauaggaauuaauguaaugcaugaugaacauugcacagggcaauguccaacagauauaccacauaaagaaaauuggauuacauuugcucaagagagaacuagucguuggggaugugaagaauuugggugccuugcugucaauacaggcuguguuuuugguucuugucaagauauaauaaggccagaaacaaagguguaucgaaaagcaguugaggagagugugcuauugacaguauguauaacuuacccaggcaaaacauucugcacagaaauaaaugccauagaaccuaaaaucacagaugaguuagaauuacaguucaaaacaguugacacaaaaacauuacccaauaucuuagcuguccaaaaucauaaguuauauaguggacaaauuaaugauuugggaucauuuucacaaggcuguggcaacauacagaaaaccaauucauccauuauaggcacagguacugcaaaguuugauuauguuugucauggugcuuccaggaaagauaucauuguaaggagauguuacaauaauaacuaugagucauguaaauuauugaaggaggaacaaucuuuaauguucgcagauaaccaugaaacuauugacguagcuaaugucaggcaucuccuuggagaucugcaauuuaaauuaauguugggagaucuaagguacaagucauuugcagaaaacccagauuuggaaauagaggcaaaguguguugggugcccgucauguuuuacuaguuacuccugcagcuucaagauugcuucaaauauugacacuguaugcucaauugaagggccuuguacaacuuuucauaauagauugaugauuaccucuacaaaacaagauuauggcaucaaaaugagcuguaaaacaaaaccaaaagaaacagaagaguuccagauuugcaagaaaacuuacacaguauuauucacaacaguugagaaaaaugauaaaaucgaaauaagcacaggggaucaaacauccuuuauccaagagagggaugauagaugcaaaacaugguuauguagaguuagggaugaagggauuaguguuauuuuugaaccaauaagggcuuucuuuggaagcuacuuuaguauagcuuuuuauguaguagucauuauuauuguccuauuucuagcaaucuacaucuucuugccuaugguguucaaacuuagagauguguuaaaaaggaaugaauaucuauacuugcaggaaauaaagcauaaguaa

SEQ ID NO: 4187 - RNA, 4305 nt, Artificial Sequence
  derived and/or modified CDS sequence (wt) from NRIV(TND/S1/19801/WT)__KM514679.1__GP
auguuguuacuucuugucuuauuaauccccugcuauguaucagccucuccuguaguaacaagaugcuuccauggagggcaauugauagcagagaagaaaucccaaacagcuguaucagaauuuugccugaaagaugaugucucuacuauuaagucagaaauaacauaugagaggaacaacacugguuuauuugcccauagcaaaguuuuacgaaauuggaucauaaaagacuggaaaaauugcaacccuguucccacagcagggggcagcauaaauguuauagaagucaauacagaucugagcuugaccacaaaaacauauguguguagcagagauugcacaauuacaguugauaaagaggaugcucagauaauuuuccaaaccgagaaguugaaccauuuugaggucucugggacuacauugagcucaggcugguuuaaaaccaaagcaucaguaacauuggacaggacuugugaacauauuaaaguaacaugugggaaaaagacucugcaauuccaugccugcuuuaagcaccacauguccugcauuagauucuuccauggcacuauucuuccuggaacaauggcuacuuccauuugucaaaauauagaacucauaauuauaauaagucugacauugauuaucuuuauccugaugguaauauuaaccaaaaccuauauauguuaucuauugaugccacuauuuaugccgauugcauacuuuuaugguuggucauauaacaagagcuguaaaaaaugcucaugcuguggucuagcuuaucaccccuuuacaaauugcgggucacauuguguauguggguuaaaauuugaagcgucagauaggaugagaauacacagagaauccggauuaugucaaggcuauaagagucuacguguggcuagauuauugugcaagucaaaagguucaucccuuguaaucucaauauuauuaucuauguugauacuaagcuuuguuacaccaauagaggggacauuaacuaacuacccagaaucaaggaaguaugaucuggaagaaauugcugauguccuggaaggauuuauuguagaaaaagggauaaaagaauauguaguuuuuuauacaucuauuuuuggggcuuuacucuuacuaauggcauuaguuaucacaauaacacuaaauaagguuacagaguaucucacaaacaucaauguucuauacugucaugaauguucaauguaucacucgaagaaaaauauaaaauauauuggggauuuuacaaauaaauguggcuuuugcacauguggagaguuggaagaucaagaggguuuaaaaauacauaaaguuagcagaaagugcauauauagauaucaacuaaccuggucuaaaauaaucaugacaauacuagugugucuacugauugcucaaaacaccauccuaauagucgcagcaucagaugauugcuggacaaaaaaaucuuuagagauggaauguauaggcccuuuacagcaaguggauacaugcgacgauaaagcaagcagaucuuauaguggggaggcaaaaaagcuagugagagcaucuaaaauaucagaucuggaugcagcacaggugggguuauuaggaucuacgauagaaucagcaauagcaagcauaagaaagcagagaacauauccaacuaugcaucuccuugaaucgguauuccugggaaagcauugugauuacuauaaaacuuucgaacauaauaguggcuacucacaggcaaaguggaggcuuacagcuaaaacacaucauuuugauauuugcucaagacauaguacucaucauuucuguagauguaucucagaugggacaaagugccaaaauggggauugggauuuugcaagugaaaugaacucaacauaccagucaaaaaaggauuuuuuugagcacgacuucaagcuguucugcacucuuguagaaaaugcuuuuccagguacaacagagucacuuuuuuaugaaauguugucuaagaaaaacacaacugguaucaaaaacuuauuagauaaauuaacaagaaaauuugggaauaacaauauguuuguagggauauggaaauuuggacaguaucuaauaucacugccauauguuaaugaaacaucauuaaccccugcucaaguuucuaaaauacuagagguuacagaccaacaccaucggucuauaucuggaaggcaagagucgcuggcuagugcuaccucugggagcaaguccaaggaauguggucaugcaaaaaaggucuccugcauaaguccuagguuuaguguuccgauggaaggauuaauggcauguggggacucaccaaauuacaaaauuuauaaaacaccagcaaagcuuuauaaaucaaacaauaagggggagguguggugcucaggugauguccauuguucucaggaacuaagcccagcaucacaagaaucuguugacaggauaaaacaaauuacuugcuuucugacagaaccugaaguaagugaugacguuuuuucaauugcaauaucuacaugcaaaguucaagauaaggggguauguacaguaaaugaagauagguggaacguaauaaaaugugauagugggcugauauauuauacugaccagagagaugggcaggauacagcgaaugauuucggagaauauuguuugucccauagcugcagaauagagagguucccaauaaauccgacaauaauuagugauuguuuaugggaguaccauucgcggaaauccaaguauaucaccagcuuggacuuagagaaucuggaagaauucaaaagggcuauuucugagaaauuaucacauacucuuauaguuuauaauuucaaaccaacagcuaaucuuccccauauaaagccgguauacaaauauaucacagugcaagggguggagaauucugauggaguagauucagcauauauaucugcuaguaugccagcuuugagcggaacaagcauaggauauaauauaaugucuagagacaauuucccauuauuugauauaauuauauuuauaaaaagugcuauuauuaaggcaacuuacaaucauauauaugacacaggucccacuauaggaauuaauguaaugcaugaugaacauugcacagggcaauguccaacagauauaccacauaaagaaaauuggauuacauuugcucaagagagaacuagucguuggggaugugaagaauuugggugccuugcuguaaauacaggcuguguuuuugguucuugucaagauauaauaaggccagaaacaaagguguaucgaaaagcaguugaggagagugugcuauugacaguauguauaacuuacccaggcaaaacauucugcacagaaauaaaugccauagaaccuaaaaucacagaugaguuagaauuacaguucaaaacaguugacacaaaaacauuacccaauaucuuagcuguccaaaaucauaaguuauauaguggacaaauuaaugauuugggaucauuuucacaaggcuguggcaacauacagaaaaccaauucauccauuauaggcacagguacugcaaaguuugauuauguuugucauggugcuuccaggaaagauaucauuguaaggagauguuacaauaauaacuaugagucauguaaauuauugaaggaggaacaaucuuuaauguucgcagauaaccaugaaacuauugacguagcuaaugucaggcaucuccuuggagaucugcaauuuaaauuaauguugggagaucuaagguacaagucauuugcagaaaacccagauuuggaaauagaggcaaaguguguugggugcccgucauguuuuacuaguuacuccugcagcuucaagauugcuucaaauauugacacuguaugcucaauugaagggccuuguacaacuuuucauaauagauugaugauuaccucuacaaaacaagauuauggcaucaaaaugagcuguaaaacaaaaccaaaagaaacagaagaguuccagauuugcaagaaaacuuacacaguauuauucacaacaguugagaaaaaugauaaaaucgaaauaagcacaggggaucaaacauccuuuauccaagagagggaugauagaugcaaaacaugguuauguagaguuagggaugaagggauuaguguuauuuuugaaccaauaagggcuuucuuuggaagcuacuuuaguauagcuuuuuauguaguagucauuauuauuguccuauuucuagcaaucuacaucuucuugccuaugguguucaaacuuagagauguguuaaaaaggaaugaauaucuauacuugcaggaaauaaagcauaaguaa

SEQ ID NO: 4188 - RNA, 4305 nt, Artificial Sequence
  derived and/or modified CDS sequence (wt) from NRIV(9800521)__JX857326.1__GP
auguugcuacuucuugucuuauuaauccccugcuauguaucagccucuccuguaguaacaagaugcuuccauggagggcaauugauagcagagaagaaaucccaaacagcuguaucagaauuuugccugaaagaugaugucucuacuauuaagucagaaauaacauaugagaagaacaacacugguuuauuugcccauagcaaaguuuuacgaaauuggaucauaaaagacuggaaaaauugcaacccuguucccacagcagggggcagcauaaauguuauagaagucaauacagaucugagcuugaccacaaaaacauauguguguagcagagauugcacaauuacaguugauaaagaggaugcucagauaauuuuccaaaccgagaaguugaaccauuucgaggucucugggacuacauuaagcucaggcugguuuaaaaccaaagcaucaguaacauuggacaggacuugugaacauauuaaaguaacaugugggaaaaagacucugcaauuccaugccugcuuuaagcaccacaugucauguauuagauucuuccauggcacuauucuuccuggaacaauggcuacuuccauuugucaaaauauagaacucauaauuauaauaagucugacauugauuaucuuuauccugaugauaauauuaaccaaaaccuauauauguuaucuauugaugccacuauuuaugccgauugcauacuuuuaugguuggucauauaacaaaagcugcaaaaaaugcucaugcuguggucuagcuuaucaccccuuuacaaauugcgggucacauuguguaugcggguuaaaauuugaagcgucagauaggaugagaauacacagagaauccggauuaugucaagguuauaagagucuacguguggcuagauuguugugcaagucaaaagguucaucucucguaaucucaauauuauuaucuauguugauacuaagcuuugucacaccaauagaggggacauuaacuaacuacccagaaucaaggaaguaugaucuggaggaaauugcugauguccuggaaggauuuauuguagaaaaagggauaaaagaauacgugguuuuuuauacuucuauuuuuggggcuuuacucuuacuaauggcauuaguuaucacaauaacacuaaauaagguuacagaguaucucacaaacaucaauguucuauacugucaugaauguucaauguaucacucgaagaagaauauaaaauauauuggggauuuuacaaauaaauguggcuuuugcacauguggagaguuggaagaucaagaagguuuaaaaauacauaaaguuagcagaaagugcauauauaaauaucaacuaaccuggucuaaaauaaucaugacaauacuagugugucuacugauugcucaaaacaccauccuaauagucgcagcaucggaugauugcuggacaaaaaaaucuuuagagauggaauguauaggcccuuuacagcaaguggauacaugcgacgauaaagcaagcagaucuuauaguggggaggcaagaaagcuagugagagcaucuaaaauaucggaccuggaugcagcacaggugggacuauuaggaucuacgauagaaucagcaauagcaagcauaagaaagcagagaacauauccaaccaugcaucuccuugaaucgguauuccugggaaagcauugugauuacuauaaaacuuucgaacauaauaguggcuacucacaggcaaaguggagguuaacagcuaaaacacaucauuuugauauuugcucaagacauagcacccaucauuucuguagauguaucucagaugggacaaagugccaaaauggggauugggacuuugcaggugaaaugaacucaacauaccagucaaaaaaggauuuuuuugagcacgacuucaagcuauucugcacucuuguagaaaaugcuuuuccaggcacaacagagucacuuuuuuaugaaauguugucuaagaaaaacacaacugguaucaaacagcuauuagauaaauuaacaagaaaauuugggaauaacaauauguuuguagggauauggaaauuuggacaguaucuaaugucacugccauauguuaaugaagcaucauuaaccccugcccaaauuucuaaaauacuagagguuacagaccagcaccaucggucuauaucuggaaggcaagaaucauuggcuagugcuaccccugggaguaaguccaaggaauguggucaugcaaaaaaggucucuugcauaaguccuagguuuaguguuccgauggaaggauugauggcauguggggacucaccaaauuacaaaauuuauaaaacaccaacaaagcuuuauaaaucaaacaauaagggggaaguguggugcucaggugauguccauuguucucaggaguuaagcccagcaucacaagaaucuguugacaggauaaaacaaauuacuugcuuucugacagaaccugaaguaagugaugacguuuuuucaauugcaauaucuacgugcaaaguucaagauaaggggguauguacagugaaugaagauagguggaacguaauaaaaugugauagugggcugauauauuauacugaccagagagaugggcaggauacaggcaaugauuucggagaguauuguuugucccauagcugcagaauagagagguuccccauaaacccggcaauaauuagggacuguuuaugggaguaccauucgcggaaauccaaauauaucaccagcuuggacuuagagaaucuagaagaauucaaaagggcuauuucugaaaaauuaucacauacucuuauaguuuauaauuucaaaccaacagcuaaucuuccccauauaaagccgguguacaaauauaucacagugcaagggguagagaauucugauggaguagauucagcauauauagcugcuaguaugccagcuuugagcggaacaaguauaggauauaauauaaugucuagagauaauuucccauuauuugauauaauuauauuuauaaaaagugcuauuauuaaggcaacuuacaaucauauauaugacacaggccccacuauaggaauuaauguaaugcaugaugaacauugcacagggcaauguccaacagauauaccacauaaagaaaauuggauuacauuugcucaagagagaacuagucguuggggaugcgaagaauuugggugccuugcuguaaauacaggcuguguuuuugguucuugucaagauauaauaaggccagaaacaaagguguaucggaaagcaguugaggagaguguuuuauugacaguauguauaacuuacccaggcaaaacauucugcacagaaauaaaugccauagaaccuaaaaucacagaugaguuagaauuacaguucaaaacaguugauacaaaaacauuacccaauaucuuagcuguccaaaaccauaaguuauauaguggacaaauuaaugauuugggaucauuuucucaaggcuguggcaauauacagagaaccaauucauccauuauaggcacagguacugcaaaguuugauuauguuugucauggugcuuccaggaaagauaucauuguaaggagauguuacaauaauaacuaugagucaugcaaauuauugaaggaggaacaaucuuuaauguucgcagauaaccaugaaacuauugacguagcuaaugucagacaucuccuuggagaucugcaauuuaaauuaauguugggagaucuaagguauaagucauuugcagaaaacccagauuuggaaauagaggcaaaguguguugggugcccgucauguuuuacuaguuacuccugcagcuucaagauugcuacaaauauugacacuguaugcucaauugaagggccuuguacaacuuuucauaauagauuaaugauuaccucuacaaaacaagauuauggcaucaaaaugagcuguaaaacaaaaccaaaagaaacagaagaguuccagauuugcaagaaaacuuacacaguauuguucacaacaguugagaaaaaugauaaaaucgaaauaagcacaggggaucaaacaucuuuuauccaagagagggaugauagaugcaaaacaugguuaugcagaguuagggaugaagggaucaguguuauuuuugaaccaauaagggcuuucuuuggaagcuacuuuaguauagcuuuuuauguagugaucaguauuauuguccuauuucuagcaaucuacaucuucuugccuaugguguucaaacuuagagauguguuaaaaaggaaugaauaucuauacuugcaggaaauaaagcauaaauaa

SEQ ID NO: 4189 - RNA, 4305 nt, Artificial Sequence
  derived and/or modified CDS sequence (wt) from NRIV(Adrar)__KJ716849.1__GP
auguugcuacuucuuguuuuguuaauccccugcuauguaucagccucuccuguaguaacaagaugcuuccauggaggacaauugauagcagagaagaaaucccaaacagcugugucagaauuuugccugaaagaugaugucuccacuauuaaaucagaaauaacauaugagaagaacaacacugguuuauuugcccauagcaaaguuuugcgaaauuggaucauaaaagacuggaaaaauugcaacccuguucccacagcagggggcagcauaaauguuauagaagucaauacagaucugagcuugaccacaaaaacauauguauguagcagagauugcacaauuacaguugauaaagaggaugcucagauaauuuuccaaaccgagaaguugaaccauuucgaggucucugggacuacauugagcucaggcugguuuaaaaccaaagcaucaguaacauuggacaggacuugcgaacauauuaaaguaaccugugggaaaaagacucugcaauuccaugcuugcuuuaagcaccauauguccuguauuagauucuuccaugguacuauucuuccuggaacaauggcuacuuccauuugucaaaauauagaacucauaauuauaauaagucugacauugauuaucuuuauccugaugguaauauuaaccaaaaccuauauauguuaucuauugaugccacuauucaugccgauugcauacuuuuaugguuggucuuauaacaaaagcugcaaaaaaugcucaugcuguggucuagcuuaucacccuuuuacaaauugcgggucacauuguguaugcggguuaaaauuugaagcaucagauaggaugagaauacacagagaauccggguuaugucaaggcuauaagagucuacguguggcuagauuguugugcaagucaaaagguucaucucucguaaucucaauauuauuaucuauguugauacuaagcuuuguuacaccaauagaggggacauuaacuaacuacccagaaucaaggaaguaugaucuggaggaaauugcugauguccuggaaggauuuauuguagaaaaagggauaaaagaauacguaguuuuuuauacuucuauuuuuggggcuuuacucuuacuaauggcauuaguuaucacaauaacauuaaauaagguuacagaguaucucacaaacaucaauguucuauacugucaugaauguucaauguaucacucgaagaagaauauaaaauauauuggagauuuuacaaauaaauguggcuuuugcacauguggagaguuggaagaucaagaagguuuaaaaauacauaaaguuagcagaaagugcauauauaaauaucaacuaaccuggucuaaaauaaucaugacgauacuagugugucuacugauugcucaaaacaccauccuuauagucgcagcaucagaugauugcuggacaaaaaaaucuuuagagauggaauguauaggcccuuuacagcaaguggauacaugcgacgauaaagcaagcagaucuuauaguggggaggcaaaaaagcuagugagagcaucuaaaauaucagaucuggaugcagcacaaguggggcuauuaggaucuacgauagaaucagcaauagcaagcauaagaaagcagagaacauauccaaccaugcaucuccuugaaucgguauuccugggaaagcauugugauuauuauaaaacuuuugaacauaauaguggcuacucacaggcaaaauggagguuaacagcuaaaacacaccauuuugauauuugcucaagacauaguacccaucauuucuguagauguaucucagaugggacaaagugccaaaauggggauugggauuuugcaggugaaaugaacucaacauaccagucaaaaaaagauuuuuuugagcacgacuucaagcuguucugcacucuuguagaaaaugcuuuuccagguacaacagagucacuuuuuuaugaaaugcugucuaagaaaaacacaacugguaucaaaaagcuauuagauaaauuaacaagaaaauuugggaauaacaauauguuuguagggauauggaaauuuggacaguaucuaauaucacugccauauguaaaugaaacaucauuaaccccugcucaaguuucuaaaauacuagagguuacagaccagcaccaucggucuauaucuggaaggcaggaaucauuggcuagugcuaccccugggaguaaauccaaggaauguggucaugcaaaaaaggucuccugcauaaguccuagauuuaguguuccgauggaaggauugauggcauguggggacucaccaaauuacaaaauuuauaaaacaccagcaaagcuuuauaaaucaaacaauaagggggaaguguggugcucaggugauguccauuguucucaggagcuaagcccagcaucacaagaaucuguugacaggauaaaacaaauuacuugcuuucugacagaaccugaaguaagugaugacguuuuuucaauugcaauaucuacgugcaaaguucaagauaaggggguaugcacaguaaacgaagauagguggaacguaauaaaaugugauagugggcugauauauuauacugaucagagagaagggcaggauacaggcaaugauuucggagaauauuguuugucccauagcugcaggauagagagguuccccauaaacccggcaauaauuagugauuguuuaugggaguaccauucgcggaaauccaaauauaucaccagcuuggauuuagagaaucuagaagaauuuaaaagggccaucucugaaaaauuaucacauacucuuauaguuuauaauuucaaaccaacagcuaaucuuccccauauaaagccgauauauaaauauaucacagugcaagggguagagaauucugauggaguggauucagcauauauagcugcuaguaugccagcuuugagcggaacaaguauaggauauaauauaaugucuagagauaauuucccacuauuugauauaauuauauuuauaaaaagugcuauuauuaaggcaacuuacaaucauauauaugacacaggccccacuauaggaauuaaugugaugcaugaugaacauugcacagggcaauguccaacagauauaccacauaaagaaaauuggauuacauuugcucaggagagaacuagucguuggggaugcgaagaauuugggugccuugcuguaaauacaggcuguguuuucgguucuugucaagauauaauaaggucagaaacaaagguguaucgaaaagcaguugaggagagugucuuauugacaguauguauaacuuacccaggcaaaacauucugcacagaaauaaaugcuauagaaccuaaaaucacagaugaguuagaauuacaguucaaaacaguugauacaaaaacauuacccaauaucuuagcuguccaaaaucauaaguuauauagugggcaaauuaaugauuugggaucauuuucacaaggcuguggcaacauacagaaaaccaacuuauccauuauaggcacagguacugcaaaguuugauuauguuugucauggugccuccaggaaagauaucauuguaagaagauguuacaauaauaacuaugagucauguaaauuauugaaggaggaacaaucuuuaauguuugcagauaaucaugaaacuauugacguagcuaaugucaggcaucuccuuggagaucugcaauuuaaauuaauguugggagaucuaagguacaagucauuugcagaaaacccagauuuggaaauagaggcaaaguguguugggugcccgucauguuuuacuagcuacuccugcagcuucaagauugcuucaaauauugacacuguaugcucaauugaagggccuuguacaacuuuucauaauagauugaugauuaccucuacaaaacaagauuauggcaucaaaaugagcuguaaaacaaaaccaaaagaaacagaagaauuccagauuuguaagaaaacuuacacaguacuguucacaacaguugagaaaaaugauaaaaucgaaauaagcacaggggaucaaacauccuuuauccaagagaaggaugauagaugcaaaacaugguuaugcagaguuagggaugaagggaucagugucauuuucgaaccaauaagggcuuucuuuggaagcuacuuuaguauagcuuuuuauguagugaucaguauuauuguccuauuucuagcaaucuacaucuucuugccuaugguguucaaacuuagagauguauuaaaaagaaaugaauaucuauacuugcaggaaauaaagcauaaguaa

SEQ ID NO: 4190 - RNA, 4305 nt, Artificial Sequence
  derived and/or modified CDS sequence (wt) from NRIV(DakArD28542)__JX857317.1__GP
auguugcuacuucuugucuuauuaaucccuugcuauguaucagccucuccuguaguaacaagaugcuuccauggagggcaauugauagcagagaagaaaucccaaacagcuguaucagaauuuugccugaaagaugaugucucuacuauuaagucagaaauaacauaugagaagaacaacacugguuuauuugcccauagcaaaguuuuacgaaauuggaucauaaaagacuggaaaaauugcaacccuguucccacagcagggggcagcauaaauguuauagaagucaauacagauuugagcuugaccacaaaaacauauguguguagcagagauugcacaauuacaguugauaaagaggaugcucagauaauuuuccaaaccgagaaguugaaccauuucgaggucucugggacuacauugagcucaggcugguuuaaaaccaaagcaucaguaacauuggacaggacuugugaacauauuaaaguaacaugugggaaaaagacccuacaauuccaugccugcuuuaagcaccacauguccuguauuagauucuuccauggcacuauucuuccuggaacaauggcuacuuccauuugucaaaauauagaacuuauaauuauaauaagucugacauugauuaucuuuauccugaugguaauauuaaccaaaaccuauauauguuaucuauugaugccacuauuuaugccgauugcauacuuuuaugguuggucauauaacaaaagcugcaaaaaaugcucaugcuguggccuagcuuaucaccccuuuacaaauugugggucacauuguguaugcggguuaaaauuugaagcaucagauaggaugagaauacacagagaauccggauuaugucaaggcuauaaaagucuacguguggcuagauuguugugcaagucaaaagguucaucucucauaaucucaauauuauuaucuauguugauacuaagcuuuguuacaccaauagaggggacauuaacuaacuacccagaaucaaggaaguaugaucuggaggaaauugcugauguccuggaaggauuuauuguagaaaaagggauaaaagaauacguaguuuuuuauacuucuauuuuuggggcuuuauucuuacuaauggcauuaguuaucacaauaacacuaaauaagguuacagaguaucuuacaaacaucaauguuuuauacugucaugaauguucaauguaucacucaaagaagaauauaaaauauauuggggauuuuacaaauaaauguggcuuuugcacauguggagaguuggaagaucaagaagguuuaaaaauacauaaaguuagcagaaagugcauauauaaauaucaacucaccuggucuaaaauaaucaugacgauacuagugugucuacugauugcucaaaacaccauccuaauagucgcagcaucagaugauugcuggacaaaaaaaucuuuagagauggaauguauaggcccuuuacagcaaguggauacaugcgacgauaaagcaagcagaucuuacaguggggaggcaaaaaagcuagugagagcaucuaaaauaucagaccuggaugcagcacaaguggggcuauuaggaccuacgauagaaucagcaauagcaagcauaagaaagcagagaacauauucaaccaugcaucuccuugaaucaguauuccuuggaaagcauugugauuacuauaaaacuuucgaacauaauaguggcuacucacaggcaaaguggagguuaacagcuaaaacacaucauuuugauauuugcucaagacauaguacccaucauuucuguagauguaucucagaugggacaaagugccaaaauggggauugggauuuugcaggugaaaugaacucaacauaccagucaaaaaaggacuuuuuugagcaugaccucaagcuguucugcacccuuguagaaaaugcuuuuccaggcacaacagagucacuuuuuuaugaaauguuaucuaagaaaaacacaacuggugucaaaaagcuauuagauaaauuaacaagaaaauuugggaauaacaauauguuuguagggauauggaaauuuggacaguaucuaaugucacugccauaugucaaugaaacaucauuaaccccugcucaaguugcuaaaauacuagagguuacagaucagcaccaucgaucuauaucuggaaggcaagaaucauuggcuagugcuaccccugggaguaaguccaaggaauguagucaugcaaaaaaggucuccugcauaaguccuagguuuaguguuccgauggaaggauuaauggcauguggggacucaccaaauuacaaaauuuauaaaacaccagcaaagcuuuauaaaucaaacaacaagggggaaguguggugcucaggugauguucauuguucucaggagcuaagcccagcaucacaagaaucuguugacaggauaaaacaaauuacuugcuuucugacagaaccugaaguaagugaugacguuuuuucaauugcaauaucuacgugcaaaguucaagauaagggaguauguacaguaaaugaagauagguggaacguaauaaaaugugauagugggcugauauauuauacugaccagagagaugggcaggauacaggcaaugauuucggagaauauuguuugucccauagcugcagaauagagagguuccccauaaacccggcaauaauuagugauuguuuaugggaguaccauucgcggaaauccaaauauaucaccagcuuggaccuagagaaucuagaagaauucaaaagggcuauuucugaaaaauuaucacauacucuuauaguuuauaauuucaaaccaacagcuaaucuuccccauauaaagccgguauacaaauauaucacagugcaagggguagagaauucugauggaguagauucagcauauauagcugcuaguaugccagcuuugagcggaacaaguauaggauauaauauaaugucuagagauaacuuuccauuauuugauauaauuauauuuauaaaaagcgcuauuauuaaggcaacuuacaaucauauauaugacacaggccccacuauaggaaucaauguaaugcaugaugaacauugcacagggcaaugcccaacagauauaccacauaaagaaaauuggauuacauuugcucaagagagaacuagucguuggggaugcgaagaauuugggugccuugcuguaaauacaggcuguguuuuugguucuugucaggauauaauaaggccagaaacaaagguguauagaaaagcaguugaggagagugucuuauuaacaguauguauaacuuacccaggcaaaacauucugcacagaaauaaaugccauagaaccuaaaaucacagaugaguuagaauuacaguucaaaacaguugauacaaaaacauuacccaauaucuuagcuguccaaaaccauaaguuauauaguggacaaauuaaugauuugggaucauuuucacaaggcuguggcaacauacagaaaaccaauucauccauuauaggcacagguacugcaaaguuugauuaugugugucauggugcuuccaggaaagauaucauuguaaggagauguuacaauaauaacuaugagucauguaaauuauugaaggaggaacaaucuuuaauguucgcagauaaccaugaaacuauugacguagcuaaugucagacaucuccuuggagaucuacaauuuaaauuaauguugggagaucuaagguacaagucauuugcagaaaacccagauuuggaaauagaggcaaaguguguugggugcccgucauguuuuacuaguuacuccugcagcuucaagauugcuucaaauauugacacuguaugcucaauugaagggccuuguacaacuuuucauaauagauugaugaucaccucuacaaaacaagauuauggcaucaaaaugagcuguaaaacaaagccaaaagaaacagaagaguuccagauuugcaagaaaacuuacacaguauuguucacaacaguugagaaaaaugauaaaaucgaaauaagcacaggggaucaaacauccuuuauccaagagagggaugauagaugcaaaacaugguuaugcagaguuagggaugaagggaucaguguuauuuuugagccaauaagggcuuucuuuggaagcuacuuuaguauagcuuuuuauguaguggucaguauuauuguccuauuucuagcaaucuacaucuucuugccuaugguguucaaacuuagagauguguuaaaaaggaaugaauaucuauacuugcaggaaauaaagcacaaguga

SEQ ID NO: 4191 - RNA, 4305 nt, Artificial Sequence
  derived and/or modified CDS sequence (wt) from NRIV(SUD-HKV141)__JX857323.1__GP
auguugcuacuucuugucuuauuaauccccugcuauguaucagccucuccuguaguaacaagaugcuuccauggagggcaauugauagcagagaagaaaucccaaacagcuguaucagaauuuugccugaaagacgaugucucuacuauuaagucagaaauaacauaugagaagaacaacacugguuuauuugcccauagcaaaguuuuacgaaauuggaucauaaaagacuggaaaaauugcaacccuguucccacagcagggggcagcauaaauguuauagaagucaauacagauuugagcuugaccacaaaaacauauguguguagcagagauugcacaauuacaguugacaaagaggaugcucagauaauuuuccaaacugagaaguugaaccauuucgaggucucugggacuacauugagcucaggcugguuuaaaacuaaagcaucaguaacauuggacaggacuugugaacauauuaaaguaacaugugggaaaaagacccuacaauuccaugccugcuuuaagcaccacauguccuguauuagauucuuccauggcacuauucuuccuggaacaauggcuacuuccauuugucaaaauauagaacucauaauuauaauaagucugacauugauuaucuuuauccugaugguaauauuaaccaaaaccuauauauguuaucuauugaugccacuauuuaugccgauugcauacuucuaugguuggucauauaacaaaagcugcaaaaaaugcucaugcuguggccuagcuuaucacccuuuuacaaauugugggucacauuguguaugcggguuaaaauuugaagcgucagauaggaugagaauacacagagaauccggauuaugucaaggcuauaaaagucuacguguggcuagauuguugugcaagucaaaagguucaucucucauaaucucaauauuauuaucuauguugauacuaagcuuuguuacaccaauagaggggacauuaacuaacuacccagaaucaaggaaguaugaucuggaggaaauugcugauguccuggaaggauuuauuguagaaaaagggauaaaagaauacguaguuuuuuauacuucuauuuuuggggcuuuauucuuacuaauggcauuaguuaucacaauaacacuaaauaagguuacagaguaucuuacaaacaucaauguuuuauacugucaugaaugcucaauguaucacucaaagaagaauauaaaauauauuggggauuuuacaaauaaauguggcuuuugcacauguggagaguuggaagaucaagaagguuuaaaaauacauaaaguuaguagaaagugcauauauaaauaucaacucaccuggucuaaaauaaucaugacgauacuaguaugucuacugauugcccaaaacaccauccuaauagucgcagcaucagaugauugcuggacaaaaaaaucuuuagagauggaauguauaggcccuuuacaacaaguggauacaugcgaugauaaagcaagcagaucuuacaguggggaggcaaaaaagcuagugagagcaucuaaaauaucagaccuggaugcagcacagguggggcuauuaggaccuacgauagaaucagcaauagcaagcauaagaaagcagagaacauauucaaccaugcaucuccuugaaucaguauuccugggaaagcauugugauuacuauaaaacuuucgaacauaauaguggcuacucacaggcaaaguggagguuaacagcuaaaacacaucacuuugauauuugcucaagacauaguacccaucauuucuguagguguaucucagaugggacaaagugccaaaauggggacugggauuuugcaggugaaaugaacucaacauaccagucaaaaaaggacuuuuuugagcaugaccucaagcuguucugcacucuuguagaaaaugcuuuuccaggcacaacagagucacuuuuuuaugaaauguugucuaagaagaacacaacuggugucaaaaagcuauuagauaaauuaacaagaaaauuugggaauaacaauauguuuguagggauauggaaauuuggacaguaucuaaugucacugccauaugucaaugaaacaucauuaaccccugcucaaguugcuaaaauacuagagguuacagaucagcaccaucggucuauaucuggaaggcaagaaucauuggcuagugcuaccccugggaguaaguccaaggaauguggucaugcaaaaaaggucuccuguauaaguccuagguuuaguguuccgauggaaggauuaauggcauguggggacucaccaaauuacaaaauuuauaaaacaccagcaaagcuuuauaaaucaaacaacaagggggaaguguggugcucaggugauguucauuguucucaggagcuaaccccagcaucacaagaaucuguugacaggauaaaacaaauuacuugcuuucugacagaaccugaaguaagugaugacguuuuuucaauugcaauaucuacgugcaaaguucaagauaaaggaguauguacaguaaaugaagauagguggaacguaauaaaaugugauagugggcugauauauuauacugaccagagggaugggcaggauacaggcaaugauuucggagaauauuguuugucccauagcugcagaauagagagguuccccauaaacccggcaauaauuagugauuguuuaugggaguaccauucgcggaaauccaaauauaucaccagcuuggaccuagagaaucuagaagaauucaaaagggcuauuucugaaaaauuaucacacacucuuauaguuuauaauuucaaaccaacagcuaaucuuccccauauaaaaccgguauacaaauauaucacagugcaagggguagagaauucugauggaguagauucagcauauauagcugcuaguaugccagcuuugagcggaacaaguauaggauauaauauaaugucuagagauaacuuuccauuauuugauauaauuauauuuauaaaaagcgcuauuauuaaggcaacuuacaaucauauauaugacacaggccccacuauaggaaucaauguaaugcaugaugaacauugcacagggcaaugcccaacagauauaccacauaaagaaaauuggauuacauuugcucaagagagaacuagucguuggggaugcgaagaauuugggugccuugcuguaaauacaggcuguguuuuugguucuugucaggauauaauaaggccagaaacaaagguguauagaaaagcaguugaggagagugucuuauuaacaguauguauaacuuacccaggcaaaacauucugcacagaaauaaaugccauagaaccuaaaaucacagaugaguuagaauuacaguucaaaacaguugauacaaaaacauuacccaauaucuuagcuguccaaaaccauaaguuauauaguggacaaauuaaugauuugggaucauuuucacaagguuguggcaacauacagaaaaccaauucauccauuauaggcacagguacugcaaaguuugauuaugugugucauggugcuuccaggaaagauaucauuguaaggagauguuacaauaauaacuaugagucguguaaauuauugaaggaggaacaaucuuuaauguuugcagauaaccaugaaacuauugacguagcuaaugucagacaucuccuuggagaucugcaauuuaaauuaauguugggagaucuaagguacaagucauuugcagagaacccagauuuagaaauagaggcaaaguguguugggugcccgucauguuuuacuaguuacuccugcagcuucaagauuguuucaaauauugacacuguaugcucaauugaagggccuuguacaacuuuccauaauagauugaugaucaccucuacaaaacaagauuauggcaucaaaaugagcuguaaaacaaagccaaaagaaacagaagaguuccagauuuguaagaaaacuuacacaguauuguucacaacaguugagaaaaaugauaaaaucgaaauaagcacaggggaucaaacauccuuuauccaagagagggaugauagaugcaaaacaugguuaugcagaguuagggaugaagggaucaguguuauuuuugagccaauaagggcuuucuuuggaagcuacuuuaguauagcuuuuuauguaguggucaguauuauuguccuauuucuagcaaucuacaucuucuuaccuaugguguucaaacuuagagauguguuaaaaaggaaugaauauuuauacuugcaggaaauaaagcacaaguaa

SEQ ID NO: 4192 - RNA, 4305 nt, Artificial Sequence
  derived and/or modified CDS sequence (wt) from NRIV(SUD-HKV66)__JX857320.1__GP
auguugcuacuucuugucuuauuaauccccugcuauguaucagccucuccuguaguaacaagaugcuuccauggagggcaauugauagcagagaagaaaucccaaacagcuguaucagaauuuugccugaaagaugaugucucuacuauuaagucagaaauaacauaugagaagaacaacacugguuuauuugcccauagcaaaguuuuacgaaauuggaucauaaaagacuggaaaaauugcaacccuguucccacagcagggggcagcauaaauguuauagaagucaauacagauuugagcuugaccacaaaaacauauguguguagcagagauugcacaauuacaguugacaaagaggaugcucagauaauuuuccaaaccgagaaguugaaccauuucgaggucucugggacuacauugagcucaggcugguuuaaaacuaaagcaucaguaacauuggacaggacuugugaacauauuaaaguaacaugugggaaaaagacccuacaauuccaugccugcuuuaagcaccacauguccuguauuagauucuuccauggcacuauucuuccuggaacaauggcuacuuccauuugucaaaauauagaacucauaauuauaauaagucugacauugauuaucuuuauccugaugguaauauuaaccaaaaccuauauauguuaucuauugaugccacuauuuaugccgauugcauacuucuaugguuggucauauaacaaaaguugcaaaaaaugcucaugcuguggccuagcuuaucacccuuuuacaaauugugggucacauuguguaugcggguuaaaauuugaagcgucagauaggaugagaauacacagagaaucuggauuaugucaaggcuauaaaagucuacguguggcuagauuguugugcaagucaaaagguucaucucucauaaucucaauauuauuagcuauguugauacuaagcuuuguuacaccaauagaggggacauuaacuaacuacccagaaucaaggaaguaugaucuggaggaaauugcugauguccuggaaggauuuauuguagaaaaagggauaaaagaauacguaguuuuuuauacuucuauuuuuggggcuuuauucuuacuaauggcauuaguuaucacaauaacacuaaauaagguuacagaguaucuuacaaacaucaauguuuuauacugucaugaaugcucaauguaucacucaaagaagaauauaaaauauauuggggauuuuacaaauaaauguggcuuuugcacauguggagaguuggaagaucaagaagguuuaaaaauacauaaaguuaguagaaagugcauauauaaauaucaacucaccuggucuaaaauaaucaugacgauacuagugugucuacugauugcucaaaacaccauccuaauagucgcagcaucagaugauugcuggacaaaaaaaucuuuagagauggaauguauaggcccuuuacagcaaguggauacaugcgaugauaaagcaagcagaucuuacaguggggaggcaaaaaagcuagugagagcaucuaaaauaucagaccuggaugcagcacaggugaggcuauuaggaccuacgauagaaucagcaauagcaagcauaagaaagcagagaacauauucaaccaugcaucuccuugaaucaguauuccugggaaagcauugugauuacuauaaaacuuucgaacauaauaguggcuacucacaggcaaaguggagguuaacagcuaaaacacaucauuuugauauuugcucaagacauaguacccaucauuucuguagguguaucucagaugcgacaaagugccaaaauggggacugggauuuugcaggugaaaugaacucaacauaccagucaaaaaaggacuuuuuugagcaugaccucaagcuguucugcacucuuguagaaaaugcuuuuccaggcacaacagagucacuuuuuuaugaaauguuaucuaagaagaacacaacuggugucaaaaagcuauuagauaaauuaacaagaaaauuugggaauaacaauauguuuguagggauauggaaauuuggacaguaucuaaugucacugccauaugucaaugaaacaucauuaaccccugcucaaguugcuaaaauacuagagguuacagaucagcaccaucggucuauaucuggaaggcaagaaucauuggcuagugcuaccccugggaguaaguccaaggaauguggucaugcaaaaaaggucuccugcauaaguccuagguuuaguguuccgauggaaggauuaauggcauguggggacucaccaaauuacaaaauuuauaaaacaccagcaaagcuuuauaaaucaaacaacaagggggaaguguggugcucaggugauguucauuguucucaggagcuaaccccagcaucacaagaaucuguugacaggauaaaacaaauuacuugcuuucugacagaaccugaaguaagugaugacguuuuuucaauugcaauaucuacgugcaaaguucaagauaagggaguauguacaguaaaugaagauagguggaacguaauaaaaugugauagugggcugauauauuauacugaccagagggaugggcaggauacaggcaaugauuucggagaauauuguuugucccauagcugcagaauagagagguuccccauaaacccggcaauaauuagugauuguuuaugggaguaccauucgcggaaauccaaauauaucaccagcuuggaccuagagaaucuagaagaauucaaaagagcuauuucugaaaaauuaucacauacucuuauaguuuauaauuucaaaccaacagcuaaucuuccccauauaaaaccgguauacaaauauaucacagugcaagggguagagaauucugauggaguagauucagcauauauagcugcuaguaugccagcuuugagcggaacaaguauaggauauaauauaaugucuagagauaacuuuccauuauuugauauaauuauauuuauaaaaagcgcuauuauuaaggcaacuuacaaucauauauaugacacaggccccacuauaggaaucaauguaaugcaugaugaacauugcacagggcaaugcccaacagauauaccacauaaagaaaauuggauuacauuugcucaagagagaacuagucguuggggaugcgaagaauuugggugccuugcuguaaauacaggcuguguuuuugguucuugucaggauauaauaaggccagaaacaaagguguauagaaaagcaguugaggagagugucuuauuaacaguauguauaacuuacccaggcaaaacauucugcacagaaauaaaugccauagaaccuaaaaucacagaugaguuagaauuacaguucaaaacaguugauacaaaaacauuacccaauaucuuagcuguccaaaaccauaaguuauauaguggacaaauuaaugauuugggaucauuuucacaagguuguggcaacauacagaaaaccaauucauccauuauaggcacagguacugcaaaguuugauuaugugugucauggugcuuccaggaaagauaucauuguaaggagauguuacaauaauaacuaugagucauguaaauuguugaaggaggaacaaucuuuaauguuugcagauaaccaugaaacuauugacguagcuaaugucagacaucuccuuggagaucugcaauuuaaauuaauguugggagaucuaagguacaagucauuugcagagaacccagauuuagaaauagaggcaaaguguguugggugcccgucauguuuuacuaguuacuccugcagcuucaaaauugcuucaaauauugacacuguaugcucaauugaagggccuuguacaacuuuccauaauagauugaugaucaccucuacaaaacaagauuauggcaucaaaaugagcuguaaaacaaagccaaaagaaacagaagaguuccagauuuguaagaaaacuuacacaguauuguucacaacaguugagaaaaaugauaaaaucgaaauaagcacaggggaucaaacauccuuuauccaagagagggaugauagaugcaaaacaugguuaugcagaguuagggaugaagggaucaguguuauuuuugagccaauaagggcuuucuuuggaagcuacuuuaguauagcuuuuuauguaguggucaguauuauuguccuauuucuagcaaucuacaucuucuuaccuaugguguucaaacuuagagauguguuaaaaaggaaugaauauuuauacuugcaggaaauaaagcacaaguaa

SEQ ID NO: 4193 - RNA, 4344 nt, Artificial Sequence
  derived and/or modified CDS sequence (wt) from BWAV(M459)__NC_034490.1__GP
auggcaauguuugaauuaauuguucuccuggcuuuuucauauguuacaggaguuccacaggaauuaacuagauguuuuacagguggaucaguaguacgucagcauuggagcaaaaaugccauaucugaacucugcuugaaagaugauguuaguauaauaaaaagugaaauagaauauaaaaagaaugagacagguacauuugcauugaguaaaaucuauagaaaauggauaacuacagauugggaaaaaugucaaccgcaaaaaucuacagguggucauauuagugucuuagagguccgacaugaccuaacuuuagcaagugcaacauacaucuguggcaauccaugcacuauuaauguagacagagaaauggcucaaguccaucuucagacagagggaguaaaucauuuugaaauuucugguacaacaauuaaaucuggcugguucaaaacaacuacauauauuacuuuagaccaaacaugugaacauuuaaaaguaucaugugggaaacagucuguacaauuccaugcuugcuuuaagcaacauauggcaugcguaagauuuuuacauagaacaauccuaccuggcaauauggcaaauucuauaugccaaaauauagaaauaauuauuuuacuagcacuuaccuuaucuaucuuuauccucuugugcauauuaacaaaaacauauaucuguuacauauuauuaccaauauuuauaccaauaucuuauauauauggauacuuuuauaauagaucauguaaaaaaugcucccaauguggauuagucuaucauccauuuacagaaugugguagaaauuguguuuguggugccagauaugacacuucagaaaggaugaaauugcauagauuaucuggacugugcccaggauauaaaagucuaaaagcagcaagaguuuuaugcaaaucuaaaggcucagcaucaauauuaucaauacuaauuucauuauugauauuaacauuuguuacaccaaucaauggcuugauguuaaaggacacagauauuacuaauuuaaagauagacacauuaccagaugauauguuagaauuaauucacaauguagauuauuugaaacuaauauuggaaauuaacauaacgauauuuggauucauauuaauaauaauucucuuuaugcuguuaauguuuuauagauaccaacauaucuuuauuaguauauaugugauugauuguaaggaauguaacauguaucauagcaagucaggauugagguauaauggugauuuuacuaauaaauguaugacuuguacauguggugaaguagaugauauggagggcuugaacaaacacaaaaaaagauauaauuguuuaaucaaauauaaaacuacgauauugcaacacuuuuuccugucuauauuaguaugcuuaauacugaaggaaucaguuuuauuugcugcagcacaaucugaagaaauaauaaaaugccuagaacaagagucuuuaacaucaaaaugcacuggaccccuacuuaaaacuccacaaugcacagagcaacaaaaaaaucuuuuauuuauagaaauagcuaaacaaauggaaaaagauaauauaauuacuucauuagauaaugcuuugauugcaaagcucccaaaugaaauagcagguagcauggcaauacuugauacaaagaaauacuaucaugagcaaaucacauuagaauaugcuauuuugucuaaguauugugauuauuauaaaaaauaugaaggaaauacaggauacagccaaacaacauggagaacuuauuugcgaucacaggaucuugaaauauguuuaauauuaccauaucaauucuucuguagaugcuucaaaaguggaacaggauguauagacacaaaaauggaaauuaaaucgacaauggacacauauuauagcucacaucaaacuaaauuugauucagaucuuaauuauaugcuacaugucauucaccuagccuucaggggaagugcaacaaguuauauagcaaaauguuuaauagaaaaaaauuauacugaaacaauaucguacuuaacuaagauucaggagaaauauccaaacaaucaauuauugaaaguugcuauauucuuuaccaaucauuuauuaaaucagagcuuaguagaaaauuuugaaguuagcacagaauggucuagguacaaacauucaacugcccaaccugagcaugaguggaaaaaaggaagugaacuuaagauguuagacccuaauaagcuaaagacugggccagcuauucaaacauguuuacauauuaaagauuuacauuguauaucuccuagaucuagagcaccaacaucugguauaauaaccuguggauuaaaugaucaagcuugugucuaccggaaaccagacaagaagauauaugccucucauaugacacagcauggauuuuguguuauggauggacacugucugaagccauuugaaccuauuaguggagaaaugcuccaaauuauuaaaaaaucaaaauguuggacugaagauauagaagauuuaauaacugaaggucaagauaaagggagaauaaguugucagccaauugauguuggcaauugcaacgucagugggaacuuauggacaauuacauugugcucugauaaaaaguuuuauuauacagauaauaaacauguccaugauaauucuaaagauauuggcuacuauugcauggaagaaaauugcaagauacccagauucccaauucacccagauuuuguuaaagauugugaaugggauuuaaaucauauaaaaauagaucaucuaaaacaaauaaauauagaagauauaaauucuuauaagaaaauacuaacagaaaaauuaaccacagcacuuaacucuuuuaaauacaaagggaaugagaauuugccucauucuaucccuaaauauaaauauauaacaauucagggaacacaaaccaucgaugguauugaaaaugcauuuauugaaguugaaauuccugcccuuucaggaagugcaacuggauuuaaaauaucaucaagagaugguauugaauuauuugaugccauacuauauguaaagcaggcuucuuuuagcucaguuuacaaaaaauuauauguaacaggaccuacuauugggauaaacacuaaacaugaugaaaggugcaccggugcaugcccaaugacacucccacauuccuaugguuggcuaaccuuuucuaaagaaagaacaagucaaugggguugcgaagaauauggcuguuuggcaauuagugacggcuguguguuugguucaugccaagauauuauuaaggaugaucuaacuaucuauagaaaagagacagaagaacugucucuugcagaaauuuguauuaccuuuaugcauaauacuuuuugcacuucuauagauucaacuacacccaccauuacagauauuuuagaagcacaauucaagacaguugaaucuuucaaauuaccuaauacaguugggcuaaaaaugcauaaguuauauauugguacaauaaaugauauugguguguacaaaaaagcuuguggaaauguucaaaaauauaauaauacaauuuugggcucaggcagcccuaaguuugauuauguuugucacuuggcaaaaagaaaggaugugauuuuaaggaaauguuuugacaaugauuauaauucuugcaaauuacugaagguugcaaaugaucuaagaauugaagaagauggugaaaaauuaaaaguuauaaauuauaaaaaaguaauggguacuuuaaaauucaaagcuauauuuggugauauuaaauauaaaucuuuuacacaagauguagauauagaugcagaagcaacauguguuggguguuuaaauuguuuugaaaauauaaauugcgagauaaaggugcaaaguccauuagaaacaacuugcgaaguagaaagcuccugugaucuauuuacaacaagaauauuguuccaucaagauauacauaaauaugcauuaaaauuaauuuguucuaaagaggccuccaguaaauuuuggauuagguuuugcaacaaagaaaucaaaucaucaauaaguuugaucaaugcagcaccuaucuuagagcuggccccuauugaccaaacaucauauguaaaagaagaagaugagagaugugggacauggauguguagggucgcucaagagggaauuggaguuaucuuugagccauuuaaaaacuuguuugggaguuauuuaggaauauuuuacauuauuauaauugugauaauacugcuuguacucuuuguuuauauuuucuugccgaugauuuuaaagcugaaagagauuuuacaaaaaaaugagguugcauaccaacgagauaugaaaauuagauaa

SEQ ID NO: 4194 - RNA, 4344 nt, Artificial Sequence
  derived and/or modified CDS sequence (wt) from BWAV(UgAr1888)__KJ867186.1__GP
auggcaauauuuaaauuaauuguucuccuggcuuuuucauaugcuacaggaguuccacaggaauuaaguagauguuuuacagguggaucaguaguacgucagcauuggagcaaaaaugccauaucugaacucugcuugaaagaugauguuaguauaauaaaaagugaaauagaauauaaaaagaaugagacaggcacauuugcauugaauaaaaucuauaggaaauggauaacuacagauugggaaaaaugucagccacaaaaaucuacaggcggucauauuaguguuuuagagguucggcaugaccuaacuuuagcaagugcaacauacaucuguggcaauccaugcaccaucaauguagacagagaaauggcccaaguccaucuucaaacagagggggugaaucauuucgaaauuucuggcacaacaauuaaaucuggcugguucaaaacaacuacauauauuacucuagaucaaacaugugaacauuuaaaaguaucaugugggaaacagucuguacaauuccaugcuugcuuuaagcagcauauggcaugcguaagauuuuugcauagaacaauuuuaccuggcaauauggcaaauucuauaugucaaaauauagagauaauuauuuuacuagcacuuacuuuaucuaucuuuauccuguuaugcauauuaacaaaaacauauaucugcuauauauuauuaccaauauuuauaccgauaucuuacauauauggauacuuuuauaauagaucauguaaaaaaugcucccaauguggauuggucuaucauccauuuacagaaugugguagaaauuguguuuguggugcuagauaugacacuucagaacgaaugaaauugcauagacuaucuggacugugcccaggauauaagagucuaaaaacagcaagaguuuuauguaaaucuaaaggcucagcaucaauauuaucaauacuaauuucauuauuaauauuaacauuuguuacaccaauuaauggcuugauguugaaggacacagauauuacuaauuuaaagauagacacauuaccagaugauauguuagaauuaauucacaauguagauuacuugaaacuaauauuggaaauuaacauaaugauauuuggauucauauuaauaauaauucucuuuaugcuacuaauguuuuauagauaccaacauaucuuuauuaguauauaugugauugauuguaaggaaugugacauguaucauagcaaaucgggauuaagauauaauggcgauuuuacuaauaaauguaugacuuguacauguggugaaguagaugauauggaaggucugaacaaacacaaaaaaagguauaauuguuugaucaaguauaaaacuacaauauugcaacacuuuucccugucuauguuaguaugcuuaauacugaaagaaucgguuuuauuugcugcagcacaaccugaggaaauaauaaaaugccuagaacaagagucuuuaacaucagaaugcacugggccccuacuuaagacuccacaauguacagagcaacaaaagaaucuucuauuuauggaaauagcuaaacaaauggaaaaagauaauguaauuacuucauuagauaaugcuuuaauugcaaagcuuccaaaugaaauagcaggcagcauggcaauacuugauacaaagaaauauuaucaugagcaaaucacacuagaauaugcuauucugucuaaguauugugauuauuauaaaaaauaugaaggaaauacaggauacagccaaacaacauggagaacuuauuugcgaucacaggaucuugaaauauguuuaaucuuaccauaucaauucuucuguagaugcuucaaaagcggaacaggauguauagauacaaaaauagaauuuaaaucaacaauggacacauauuauaguucacaucaaacuaaauuugauucagaccucaauuauaugcugcaugucauucaucuagcuuucaggggaagugcaacaagcuauauagcaaaauguuuaauagaaaaaaauuauacugaaacaauaucauacuuaacuaagauucaggagaaauauccaaauaaucaguuguuaaaaguugcuauauucuuuacuaaucauuuauuaaaucagagcuuaguagaaaauuuugaaguuagcacagaauggucuagguacaaacauucagcuacccaaccugagcaugaguggaagaaaggaagugaguuaaagauauuagacucuaauaaguuaaagacugggccagcuauucaaacauguuuacauauuaaagauuuacauuguauaucuccuagaucuagggcaccaacaucuggcauaauaaccuguggauuaaaugaucaagcuuguguguaucggaagccaaacaaagagauauaugccucucauaugacacagcauggauuuuguauuauggacggacacugucugaaaccauuugagccuauuaguggagaaaugcuucaaauuauuaaaaaaucaaaauguuggacugaagauauagaagauuuaauaacugaaggucaagauaaaggaagaauaaguugucagccgauugauguuggcaauuguaaugucaguggaaacuuauggacaauuacauugugcucugauaaaaaguuuuauuauacagauaauaaacauguccaugauaguucuaaagauguuggcuauuauuguauggaagaaaauugcaagauaccuagauucccaauucauccagauuuuguuaaagauugugaaugggauuuaaaucauauggaaauagaucaucuaaaacaaauaaauauagaggauauaaauucuuauaagaaaauacuaacagaaaaauuaaucacagcacuuaacucuuuuaaauauaaaggaaaugagaauuugccucauucuaucccuaaauaugaauauauaacaauucagggaacacaaaccauugaugguauagaaaaugcauuuauugaaguugaaauuccugcccuuucagggagugcaacuggauucaaaauaucaucaagagaugguauugaauuauuugaugccauacuauauguaaagcaggcuucauuuagcucaguuuacaaaaaauuauauguaacaggaccuacuauugggauaaauaccaaacaugaugagagguguaccggugcgugcccagugacacucccacauuccuauggcuggcuaaccuuuucuaaagaaagaacaagucagugggguugugaagaauaugguuguuuggcaauuagugacggcuguguguuugguucaugccaagauauuauuaaggaugaucuaacugucuauagaaaggagacagaagaacugucucuugcagaaauuuguauuacauuuaugcauaauacuuuuugcacuucuauagauucaacuacacccaccauuacagauauucuagaggcacaauucaagacaguugaaucuuucaaauuaccuaauacaguugggcuaaaaaugcauaaguuauauauugguacaauaaaugauauugguguguauaaaaaagcuugcggaaauguucagaaauauaauaauacaauuuugggcucaggcaguccuaaguuugauuauguaugucacuuggcaaaaagaaaggaugugauuuugaggaaauguuuugacaaugauuacaauucuugcaaauuacuaaagguugcaaaugaucuaagaauugaagaagauggugaaaaauuaaaaguuauaaauuauaaaaaaguaaugggcacuuuaaaauucaaagcuauauuuggugauguuaaauauaaaucuuuuacacaagauguagauauagaugcagaagcaacauguguuggauguuuaaauuguuuugaaaauauaaauugugagauaaaagugcaaaguccauuagaaacaacuugugaaguagaaagcuccugugauuuauuuacaacaagaauauuguuccaucaagauauacauaaauaugcauuaaaauuaauuuguucuaaagaggccacuaguaaauuuuggauuagguuuuguaagaaagaaaucaaaucaucaauaaguuuaauaaaugcagcaccuauccuagaauuagccccuauugaucaaacuucauauguaaaggaagaagaugagagaugcggaacauggaugugcagaguugcucaagagggaauugggguuaucuuugagccauuuaaaaauuuauuugggaguuauuuaggaauauuuuacauuauuauaauuguaauaauacugcuugugcuuuuuguuuauauuuuuuuaccaaugauuuuaaagcuaaaagagauuuuacaaaaaaaugagguugcauaccaacgagauaugaagguuagauaa

SEQ ID NO: 4195 - RNA, 4332 nt, Artificial Sequence
  derived and/or modified CDS sequence (wt) from BWAV/PGAV(SAAr1)__KJ867177.1__GP
augauuugcauaugcauuuucguggccauuuucccagcuaucuaugcaauuccagauagcuauagcagguguuucacagguggcacaguugucaaagagauguggucuaaagaugcuguuacagaacuuugcaucaaagaugauguuagcauugucaaaacugaaacaucauauaagaaaaacgggacugggacauuugcuuuaaauaagguaaccaggaaauggcucaugacagauugggaaaaaugcaagccucaaaagucuagcaguggacauauaaaugugauugaggucagggaugaucuaacacuagcaacuucaacauauauauguucaaguucuugcacuauuaauguagauagagaaacagcacaaauacaguugaacacagauucuaucaaucauuucgaaauagcugguacaaccauuaagacagguugguuuaaauccacuaccuuaguugcauuagaucaaacaugugagcacuuaaaaguaucaugugguaagcagucaguacaauuccaugcuuguuuuaaucagcauaugucauguguuagauuucuucauagaacuauauugccaggcaauauggcaaagucaauaugccaaaauauagaaauuauaauacuuguuggccuaauuauucucauauucuugcuacuauguaucuuaacaaaaacauacauaugcuauauauuacuaccaauauucaucccauuaucauaugcauauggguauuucuauaauaaagcauguaagaaauguucacaaugcgguuuaguuuaccauccauucacagaaugugggucaaauugcguguguggggcuagguaugacacuucagaaagaaugaaacuccauagaauuucaggauuaugcccaggguauaaaaguuugcgaacagcuagagucuuaugcaagucaaaagguucagcaucuaucuuaucuauuuuaauuucaauacuaaucuuaauguuugucacaccuauuaacggcuacaugauaacuaaugaauuugaugaaggaaaauuaacaguagauagccugccagaugauauguuaaguaugauaucuagacuuucagccuuacaauuuauauuuacuuuaaauauugcauguucagugcuaguaacucuauuaacaugccuuuucuugaucauuuuuuauagauuccaacauagauuccuuaguaaguaugccauaaauugcacagaaugugauauguaccaucaaaagaaaggauuaaucuauaauggggauuuuacuaacaaauguaugacauguacauguggugaagucaaugauauggaagguuuaaauaaacacaaaaaaagauacaacugcuuaauaaaguauaaagcagccugguuuuuaaaccuaacuauaacaauaauaugucuuaugcuaauuaaagaugguaguaugauggcagcagcagaaaccaacauagaaacaugcauggcaaagccuagcuugaccacugauuguacggggccuuuucuaaaaauaacuaaaugugaugaaucucaaaaagcauuaccauuucaagaaaucgcuaaacaacuaguaaaauccaaugucuuaacacuucuugacaagcauauuguagaaaaacuuccuaaugaaauagcuggcagccugucuauuuuggacaaaaagcaacacuaccaugagcaauuggcaguugaauauggaauauuaucuaaguauugugauuauuacgaguuauacaagagcaauucuggcuauagucaaucuacauggggaacauauuugcguucacaugauuucgaaauuuguuuauugcuaccauaccaauauguguguagaugcuuuaaaucaggaacuggaugcacugauacuaaauuugaauuugaacagaaaaugaaugagacauauaauaguaagaacgauauguacaauucagauuucacacuagcuuuaacuguuuuacacuuagcuaugcgaggcacagcaucaacauauauaauagauaauguuuuacaaaagaauuauucaaauguuaucgaauacuuaaauacuacaaaaaacaacuucaaauccaaccagguauuuggaguuuugguagacuuuacuauauauuuauuaagacaugcuucauaugccaaauacaauuuaccacaaagucuuaaaaaauucagaucaguaaguucagacuuaacaacaauuucaggcagaucaucuggacagaauauagucucugauuugcaucaaggagauguuauaaaaacauguuuaaacauuaagcaauuaaacuguauuucaccuaaguccagaacaacaacaacgaaucugauaacauguggauccucucagauuaguguauauaauuuaccucgaggccaauuguaugaaucugucacuacagagcauggaacaugugcaggugauggccauugcuugacugauuucaugcccauaaauagugacuuucuagcuacgcuaaaaaaaucaaaauguuggacaacagacauaccuaauauaaucaagcuuguagagagugacgguaaaauaaguugucagccuauugauguaggauccugcaacguaucaggcaauauauggacaaucacaaaaugcucagauaauaaauauuauuauacugacaauaagcauguucaugaugaugaaaaagacauuggucauuauuguauggaagaaaccuguaaguuuguucgcuuccccauaaaugacaaauuugucagcaacugugaaugggaucugaaucacaucgaaauaaauaagcucaaucagguugaauuagacaauauaaaugcauauaaaaagguuuuaacugaaaaauuaacuagcucucuuaguguuuucaaauauaaauuaacacaaaauuugccacauguuauuccgaaauucaaauauauaaccauacaaggaacccaaacgguagaugguauugagaauucauucauagaaguugaaauuccagcacugucaggugcugcaucaggauuuaaaauaaugacaaaagagaauaaugaauuauuugaugcaauauuguauguaaagcaagcuuccuuuaguaguauuuacaaaaagaucuauacaacagggccaacuauaggaauaaauacaaaacaugaugaaaaauguacuggugcgugcccuguaaauuuaccacauaguacagguuggcuuacauuugcuaaagagagaacuagcacaugggguugugaagaauauggaugccuugcuauaaaugauggauguguuuuuggcucaugccaagauauaauaaaggaugaaauguacauauucaaaaaggaaacagaagaaguggcauuaguagagauuuguauaagcuucaaucauaagacauucugcacugauguagauucaacaacacccauaauuacugauacucuagaggcacaauucaagacaguagaaucauauaaauuaccaaaucauguagcuuuaaagcaacauaagcuguauguaggccaaaucaaugauuuuggaguauauaaaaaggcauguggaaaugugcaaaaaauaaauaauacuauuuauggagaagguacuccacgauuugauuauuuaugucaccuagcuaagaggaaagauguuuuagucaggaaaugcuuugauaaugauuauaacucuugcucucucuuaacuauagcagaugaccugagauuggaagaagacggugaaaagcuaaaagucaucaauuauagaaaaguacuaggcucuaugaaguucaaagcucucuuuggggauauaagauauaaaucauucacagaggauauugaauuggauguagaggcuucuugugcagguuguauaaauuguuuugacaauauacauugugaaauaaaauuaacaaaugguuuagacacaucuugcaguuucgaaucuaguugugaugcauucaauuccagaauauuauuuaauucaaaucaacauguauauucuacuaaguugauauguacuaaagaacaaacaaaggcuuuugaaauaaaaaucugcggaaaaacuauaaaagcugauuuagugguaacugaagcaaaaccaauacuugaguuaaccccuauugaucagacauccuauauuaaagaagaagacaccagauguggaacaugguuuugcaggcugacaaaagaaggauucucaguauuguuagaaccauucaagaacuuauucgggaguuauuuagggauugcuuauacuaucauaauagccuuguuaugcuuguuuguuuuuauauacauaaucuuaccuaugauaaugaaguugaaagaaguuuuaaagcaaaaugaaauagcuuaucagaaggaacaaaagaaaagguga

SEQ ID NO: 4196 - RNA, 4332 nt, Artificial Sequence
  derived and/or modified CDS sequence (wt) from BWAV/PGAV(191B-07)__KJ867180.1__GP
augauuuacauauacauuuucguagccauuuucccagcuaucuaugcaauuccagauagcuauagcagguguuucacagguggcacaguugucaaagagauguggucuaaagaugcuguuacagaacuuugcaucaaagaugauguuagcauugucaaaacugaaacauccuauaagaagaacgggacugggacauuugcuuuaaauaagguaaccaggaaauggcucaugacagauugggaaaaaugcaaaccucaaaagucuagcaguggacauauaaaugugauugaggucagggaugauuuaacauuagcaacuucaacauauauaugcucaaguucuugcacuauuaauguggauagagaaacagcacaaauacaguugaacacagauucuaucaaucauuucgaaauagcugguacaacuauuaagacagguugguuuaaaucuacuaccuuaguugcauuagaucaaacaugugagcacuuaaaaguaucaugugguaagcagucaguacaauuccaugcuuguuuuaaucagcauaugucauguguuagauuucuucauagaacuauauugccaggcaauauggcaaagucaauaugccaaaauauagaaaucauaauacuuguuggccuaacuauccuuauauucuugcuacuauguaucuuaacaaaaacauacauauguuauauauuacuaccaauauucaucccauuaucauaugcauauggguauuucuauaacaaagcauguaagaaauguucacaaugcgguuuaguuuaccauccguucacagaaugugggucaaacugcguguguggggcuagguaugauacuucagaaagaaugaaacuccauagaauuucaggguuaugcccaggguauaaaaguuugcgaacagcuagagucuuaugcaagucaaaaggcucagcaucuaucuuaucuauuuuaauuucaauacuaauuuuaauguuugucacaccuauuaauggguacaugauaacuaaugaauuugaugaaggaaaauugacaguagauagccugccagaugauauguuaaguaugauaucuagacuuucagccuuacaauuuauauuuacuuuaaauauugcguguucagugcuaguaacucuauuaacaugccuuuucuugaucauuuuuuauagauuucaacauagauuccuuaguaaguaugccauaaauugcacagaaugugauauguaucaucaaaagaaaggauuaaucuauaauggggauuuuacuaacaaauguaugacauguacauguggugaaguugaugauauggaaggcuuaaauaaacacaaaaagagauacaacugcuuaauaaaguauaaagcagccugguuuuuaaaucuaacuauaacaauaauaugucuuaugcuaauuaaagaugguaguaugauggcagcagcagaaagcaauauagaaacaugcauggcaaagccuagcuugaccacugauuguacggggccuuuucuaaaaauaacuaaaugugaugaaucucaaaaagcauuaccauuucaagaaaucgcuaaacaacuaguaaaauccaaugucuuaacacuucuugacaagcauauuguagaaaaacuuccuaaugaaauagcuggcagccugucuauuuuggacaaaaagcaacacuaccaugagcaacuggcaguugaauaugggauauuaucuaaguauugugauuauuacgaauuauauaagagcaauucuggcuauagucaaucuacauggagaacauauuugcguucacaugauuucgaaauuuguuuauugcuaccauaccaauauguguguagaugcuucaaaucaggaacuggaugcacugauacuaaauuugaauuugaacagaaaaugaaugagacauauaauaguaagaacgauauguauaauucagauuucacacuagcuuuaacuguuuugcacuuagcuaugcgaggaacagcaucaacauauauaauagauaauguuuuacaaaagaauuauucaaaugucaucgaauaccuaaauacuacaaaaaacaacuucaaaucuaaccaaguauuuggaguuuugguagacuuuaccauauauuuauuaagacaugcuucauaugccaaauacaauuuaccacagagucuuaaaaaauucagaucaguaaguucagacuuaacaacaauuucaggcagaucaucuggacaaaauauagucucugauuugcaucaaggagauguuauaaaaacauguuuaaacaucaagcaauuaaacuguauuucaccuagguccagaacaacaacaacaaaucugauaacauguggaacuucccaaauuaguguauauaauuuaccucgaggccaauuguaugaaucuguuacuacagaacauggaacaugugcagaugauggccauugcuugacugauuucaugcccauaaauagugacuuucuagcuacgcuaaagaaaucaaaauguuggacaacagauauaccuaauauaaucaagcuuguagagagugaugguaaaauaaguugucagccuauugauguaggauccugcaauguaucagguaauauauggacaaucacaaaaugcucagauaauaaguauuauuauacugacaauaagcauguucaugaugaugcaaaagauauuggucauuauuguauggaagaaaccuguaaauuuguucgcuuccccauaaaugacaaauuugucagcaacugcgaaugggaucugaaucauaucgaaauaaauaagcucaaucagguugaacuagacaauauaaaugcauauaaaaagguuuuaacugaaaaauuaacuaguucucuuaguguuuucaaauauaaauuaacacaaaauuugccacauguuauuccaaaauucaaauauauaacuauacaaggaacccaaacgguagaugguauugagaauucauucauagaaguugaaauuccagcacuaucaggugcugcaucaggauuuaaaauaaugacaaaagagaacaaugaauuauuugaugcaauauuguauguaaagcaagcuuccuuuaguaguauuuacaagaagaucuauacaacagggccaacuauaggaauaaauacaaaacaugaugaaaaaugcacuggugcaugcccuguaaauuuaccacauaauacagguuggcuuacauuugcuaaagagagaacuagcacaugggguugugaagaauauggaugccuugcuauaaacgauggauguguuuuuggcucaugccaagauauaauaaaggaugaaauguacauauucaaaaaggaaacagaagaaguggcauugguagaaauuuguauaagcuucaaucauaaaacauucugcacugauguagauucaacaacacccauaauuacugauacucuagaggcacaauucaagacaguagaaucauauaaauuaccaaaucauguagcuuugaagcaacauaagcuguauguaggccaaaucaaugauuuuggaguauauaaaaaggcauguggaaaugugcaaaaaauaaauaauacuauauauggagaagguacuccacgauuugauuauuuaugucaccuagcuaagaggaaagauguuuuagucaggaaaugcuuugauaaugacuauaacucuugcucucucuuaacuauagcagaugaccugagauuagaagaagacagugaaaagcuaaaagucaucaauuauagaaaaguacugggcucuaugaaguucaaggcucucuucggggauauaagauauaaaucauucacagaggauauugaauuagauguagaggcuucuugugcagguuguauaaauuguuuugauaauauacauugugaaauaaaauuaacaaaugguuuagacacaucuugcaguuucgaaucuaguugugaugcauucaauuccagaauauuauuuaauucaaaucaacauguauauucuacuaaguuaauauguacuaaagaacaaacaaaagcuuuugaaauaaaaaucugcggaaaaacuauaaaagcugauuuagugguaacugaagcaaaaccaauacuugaguuaacuccuauugaucagacaucuuauauuaaagaagaagacaccagauguggaacaugguuuugcagguugacaaaagaaggauucucaguauuguuagaaccguucaagaauuuauucgggaguuauuuagggauugcuuauacugucauaauagcuuuguuaugcuuguuuguuuuuauauacauaaucuuaccuaugauaaugaaguugaaagagguuuuaaagcagaaugaaauagcuuaucagaaggaacaaaagaaaagguga

SEQ ID NO: 4197 - RNA, 4326 nt, Artificial Sequence
  derived and/or modified CDS sequence (wt) from CEV(283)__KX817313.1__GP
augauuuucaugcuaauccuauuugcaguggcugcugcaagcccuguuuaucagaggugcuuccaagauggugcuauagugaagcaaaauccaucaaaggaagcagugacggaagugugccuuaaagaugauguaagcaugauaaaaacugaggccagauauacuaagaacaguacuggaguauucucaaacaauguagcaauaaggaaguggcuagucucugauuggcaugauugcagacccagaaaagucguugggggucauauaaaugucauagaaguuggggaugacuuaacacuccauacugagucauacguuugcagugccgauugcacuauagguguugacaaagaaacagcccaagucaggcuacagacugauacaacaaaucauuucgagauugcaggaaccacaguaaaaucuggaugguucaagagcacaacauauauuagucuggaucagaccugcgaacauuugaagguuucuugcgguccaaaguccauacaauuccacgccugcuucaaccaacacaugucaugugucagauucuuacauagaacuauucugccagguucuauugcgaacucaauaugccaaaauguugaaauaauaauauuaguaacacuagccuugcugauuuuuauuuuacuuaguaucauaaguaaaacauauauaugcuaucuauugaugccuauauucaucccaauugcuuauauauauggucuaauuuauaacaaaucauguaaaaaaugcaagcuaugugguuuagucuaucacccauuuacugagugugguacucacugcgucuguggugcaagauaugacacgucagauaggaugaaacuccaucgagcaucaggucucugcccuggauauaaaagucuuagagcugcuagaguuaugugcaaaucgaaagggccagccuccauacugucaauaaucacugcaguucuaauacuaacuuuugucacaccuauaaacgcaaugaugguuggagagagcaaggaaaccuuugaacuugaggagcucccugaugacaugcuagaaauggcuaacaaucuaaacacuuauuauaugcucuguguggcaaauuaugcagucacauggagcuugcuaauaguugccuuaauaauagguuuauuauucaagaaauaccaacaucgauucuuagauauuuaugccauguacugugaagagugcgauauguaucaugauaggucugguauuaaauggaacggugauuucacgaauaaguguggccauugcacaugcgggcaguacgaagaugcauccgggcucuuagugcaccggaaaacauauaauugccuaauacaguacaaaucuaaauggauuaugaacuuuuugguaacuuauguaaucuugguauugcuuaaagauucuguaguuauuguucaggcaaaagggguggauuucagugaauguauugaagcagaaaaaguaagguggaacuguacaggcccuuuuguuaaucuaggaaacugugagaaaaaacaaaagaaagaaccauacucuaauauugcugcucaauuaaagggcuugggugcuaucucuauacuggauguuccuauaauugcaaguauuccugaggauauugccggagcauuaagauacauagaagaccagagaucauaccacucucaguugacuguugaguaugcuauguugaccagauacugugauuauuacacucaguucagugacaauucugguuauagucagacaaccuggaggguuuaccuuagaucacacgauuuugaggcaugcguuuuguauccaaaccagcacuucugcagauguguaaagcauggggacaaauguaguaguucaaauugggacuuugccucugaaaugaagaauuacuacucugguaagcaaagcaaguuugauaaggauuugaauuuagcccucacaucucuacaccaugcuuucagagggaccucuucaucuuacauagcaggguugcuaucuaguaaagcaaaugaugaguuagugcaguacacaucuaaaauuagggagaaguuccccgggaaugcacuacuaaaggcaguaauugacuauauugcauauaugaaggggcuuaccgaaaugaguaacuucaaaaaggaugaguucugggaugaguuaguauaugugccugacccuacuaagccucccaagcuaucaagaagcaguggaacaguauaugauuucaaaucagcuacauccaacuugggugaaaagaacuguaaggauguaaaggguguuguaugcuugucgccuagaucuggugugacauaugacucaauaauagcuuguggugaaggauccaguccaaauaucuauagaauacccaaaacaggaguguaccaauccaauucagaaccaucuaauuacugugugucggauagccacugccuugaagauuuugaagugauaaaccaagaggagcuagaugcuauaaaaaagucuagaugcugggaaguugauuaccuauaugcuaacccuucuaaacaaagugauggcauaagaagcugccguaugagagaugcugggcacugcaaugucaccacaaauagauggccaauaauacaaugugaugacaauaaauacuacuauucugaauugcagagagacuaugacaaagagcaagauauaggucacuuuugccuuagcccuagguguaccacugucagauucccuauccauccaaaacauguaagcaacugcgauuggcaagugagccacuccacaguagauaaaguggauguacauaaccuggaggauauugagcaauacagaaaagccauaacacaaaagcuccaaaauagcuuaucgauauuuaaguaugcuagaaccaagaaucucccacauauaaaaccuauauauaaauauauaacaauugaagguacagaaacugcagaaggaauugaaagugcuuauauagaaucagaaauaccagcauuagcagggaccucuauuggauuuaaaauaaauaccaaagaggggaagcauuuacuagauguuauagcuuauguuaagcaagcuucuuacucgucauuauacaauaaaauguacgugaccgggccuacaguaggcauaaauacaaaacaugaugaguuaugcacuggcccuugcccuguuaaugucccacacucagacggauggcugacauucgcuagagaaagaacuaguucuugggguugugaggaauucggguguuuagcaaucagugauggaugcguuuuugggucuugccaggaucuaauaaaggaagaacuggcaguguauaggaaagagacagaagaagcaaccaauguugaauuaugcuugacuuuuucagauaagaccuacuguacagaauuaaauccuauaacaccuauaauaacaaaucuguuugaaguacaauucaaaacuguagaaacuuacagccugccuaggguuguagcaguccaaaaccacgagauuagaauaggacagaucaaugacuuaggcauuuauucuaagggcuguggaaauguccaaaaagucaacaacaccauauaugguaauggaguuccaaaauucgauuaccuuugucaucuagcaaguagaaaggagguaauuguuagaaaauguuuugacaaugauuuucaggcaugcaaauuuuugcaaaguccaccaagcuauaggcuugaggaagaugacggaucaaucacagugauagauuauaagaaaauccucggcacaauaaaaaugaaagcuauacuaggagauguaaaauauaagacauuugcagagaauaucgauauaacugcugaaggaguuuguacaggaugugucaauuguuuugaaaauauacacugugagcuuacaauacacacaacuauagaggccaguugcccaguuacuaguccuugcacuuuauuucaugaucggauauugaucacuccagaugaacacaaguaugcuaugaaaguaauuugcacagagaagcaaacaggaacauuaccguucaaaaucuguaacucaaaagucgaugccacuuuaacuuuaguagaagccaaaccuauucuagaacuggccucuguugaucaaacugcauauauaagagaaaaagaugaaagguguaaaacauggaugugcagaguaagggaugaagggauucagguuauauuagagccauuuaaaaaucucuuugguucuuauauugguauauuuuauacuucaauccucauuguuauuacaauauuuauaauuauuuauguaauccugcccauauguuuuaaauugaaagacacuuuacaaaagcaugaagaugcauacaagagagaaaugaaaauaagauaa

SEQ ID NO: 4198 - RNA, 4326 nt, Artificial Sequence
  derived and/or modified CDS sequence (wt) from CEV(BFS283)__AF123483.1__GP
augauuuucauacuaauccuauuugcaguggcugcugcaagcccuguuuaucaaaggugcuuccaagauggugcuauagugaagcaaaauccaucaaaggaagcagugacggaagugugccucaaagaugacguaagcaugauaaaaacugaggccagauauaccaagaauaguacuggaguguucucaaacaacguggcgauaaggaaguggcuagucucagauuggcaugauugcagacccagaaaagucguugggggucauauuaaugucauagaaguuggggaugacuugacacuccauacugagucauacguuugcagugcugauugcacuauagguguggacaaagaaacagcccaaguuagguugcagacugauacaacgaaucauuucgagauugcaggaaccacaguuaaaucuggcugguucaaaagcacgacauauauuagccuagaccagacuugcgaacauuugaagguuucuugcgguccaaaguccauacaauuccaugccuguuucaaucaacacaugucaugugucagauuuuuacauagaacuauucugccagguucuauugcaaacucaauaugucaaaauguugaaauaauaauauuagugacauuggccuugcugauuuuuauccugcuuaguaucauaaguaaaacauacauaugcuaucuguugaugccuauauuuaucccaaucgcuuauauauauggccuaauuuauaacaaaucaugcaaaaaaugcaagcugugugguuuaguuuaucacccaauuacagagugugguacccauugcgucuguggcgcaagauaugacacaucagauaggaugaaacuccauagagcaucaggucuuugcccuggguacaaaagucuuagagcugcuagaguuauguguaagucaaaaggaccagccucuauacugucaauaaucacugcuguuuuaauacuaaccuuugucacaccuauaaaugcaaugaugguuggagggagcaaagagaccuuugaacuugaggagcucccugaugacaugcuagaaauggcuaacaauuuaaauacuuauuauaugcucugcguaacaaauuaugcaguuacauggagccuguugauaauugccuuagcaauagguuuauuauuuaaaagauaccaacaucgguuuuuagauauuuaugcuauguauugugaagaaugcgauauguaucaugauaggucugguauuaaauggaacggugauuucacaaauaaguguggccaauguacaugcggacaguacgaagaugcauccggacucuuggugcaccgaaaaacauacaauugccuaauacaguacaaaucuaaguggauuaugaacuucuugauaacuuauguaaucuugguauugcuuaaagauucuguaguuaucguucaagcaaaaggaacagauuucagugaauguauugaugcagauaaaauaaaguggaacuguacagguccuuuuguuaaucuaggaaacugugagaaaaagcaaaagaaagaaccauacucuaauauugcugcucaauugaagggcuugagugcuaucucuauacuagauguuccuauaauugcaagcaucccugaggauauugcuggggcauugagauacauagaagaccagagaucauaccacucucaguugacuguugaguaugcuauguuaaccagauauugugauuauuacacucaguucagugacaacucugguuauagucaaacaaccuggagaguuuaccuuagaucacauguuuuugaggcaugcauuuuguacccaaaucagcacuucugcagauguguaaaacauggagauaaauguagcagcuccaacugggacuuugccucugaaaugaagaauuauuacucugguaagcaaaacaaguuuaauaaagacuugaauuuggcccuuacaucucuacaccaugccuucagagggaccuccucgucuuacauagcaggauugcuaucuacuaaagcaaaugaugaguuagugcaguauacaucuaaaaucagagagaaguuccccgggaaugcauuacuaaaggcaauaauugacuauauugcauacaugaagggacucacagagaugagcaacuucaaaaaggaugaguuuugggaugaguugguauaugugccugacccuacuaagccucccaagcuaucaaggggcagugaaacaguuuaugauuucaaaucagcuacguccaacuugggugaaaagaacuguaaggauguaaaggguguuguguguuuaucgccuagaucuggugugacauaugacucaauaauagccuguggugaagggucuagcccgaauaucuacaaaauaccaaaaacaggaguguaccaauccaauucagaaccaucuaacuacugugugucagauagccacugucuugaagauuuugaaguaauaagccaagaggaguuggaugcuauaaaaaaguccagguguugggaaguugauuaccuauaugccaauccuccuaaacaaagugauggcguaagaagcugccguaugaaagaugcugggcacugcaaugucacuacaaacagauggccaauaauacaaugugaugacaauaaauacuauuauucugagcugcagagagacuaugauaaagagcaggauauaggucauuucugccuuagccccaggugugccacuguuagauucccuauccauccaaagcauauaagcaacugcgauuggcaagugagccacuccacaguagacaaagugaauguacauaaccuagaagauauugagcaguacaggaaggccauaacgcaaaagcuccagaauagcuugucaauauuuaaguaugcuagaaccaagaaccucccacacauaaagccuauauauaaauacauaacaauugaagguacagaaacugcagaaggaauugaaagugccuauauagagucagaaauaccagcauuagcagggacuucuaucggauuuaaaauaaauaccaaggaggggaaacauuuauuagauguuauagcuuauguuaagcaagcuucuuacuccucauuauacaauaaaauguaugugacuggacccacaguaggcauaaauacaaaacaugaugaguugugcacuggcccuugcccuguuaaugucccacauucagacggguggcuaacauuugcuagagaaagaacuaguucuugggguugugaggaauucggguguuuagcaauuagugauggaugcguuuuuggguccugucaagaucuaauaaaggaagaacuaacaguguauaggaaagagacagaagaagcaaccaauguugaacuaugcuugacuuuugcagacaagaccuacuguacagaauuaaauccuguaacaccuauaauaacgaaucuauuugaaguacaauucaagacuguggaaacuuauagucugcccaggguuguagcaguccagaaucaugagauuaggauaggacagaucaaugaccuagguguuuacucuaagggcugugggaauguccaaaaaguuaauaacaccauauaugguaauggaguuccaaaauucgauuaccuuugccaccuagcaaguagaaaagaggugauuguuaggaaauguuuugauaacgauuuucaggcaugcaaauuuuugcaaagcccaccgagcuauaggcuugaagaggaugauggaucaaucacagugauagauuauaagaagauccuugguacaauaaagaugaaggcuauacuaggggauguaaaauauaagacauuugcagagaauauagauauaacugcugaaggaguuuguacaggauguaucaauuguuuugagaauauacauugugagcuuacaauacacacaacuauagaggccaguuguccaguuacuaguccuugcacuuuguuccaugauaggauauugaucacuccagaugaacacaaguaugcuauaaaaguaauuugcacagagaaacaaacaggaacauuaccauucaaaaucuguaacucaaaaaucgaugccacucugacuuuaguagaagccaaaccuauuuuagagcuagccccugucgaucaaacugcauauauaagggaaaaagaugaaaggugcaaaacauggauguacagaguaagggaugaagggauucagguuauauuggagccauuuaaaaaucucuuugguucuuauauagguauauuuuauacuucuauccuuguuguuauugcaauguuuauaauuguuuauguaauccugcccauauguuuuaaacugaaagacacuuuacaacggcaugaagaugcauacaaaagagaaaugaaaauaagauaa

SEQ ID NO: 4199 - RNA, 4329 nt, Artificial Sequence
  derived and/or modified CDS sequence (wt) from CHATV(Mohko ILO8-3)__KF719222.1__GP
augaugauuuucauauugauacuguuugcagucagugcugcaaguccaguauaucaacgguguuuccaagauggggcuauagugaagcaaaacccaucuaaggaggcuguuacagaaguaugccucaaagacgacguuagcaugauaaagacagaagccagguaugugaagaaugcuacaggaaucuauucuaacaauguggcaaucaggaaaugguuagucucagacuggcaugacuguaggccuaggaaagucucagguggacacaucaauguuauagaaguuggugaugaucuuucacuucauacugaaucuuaugucugcagugcugauugcacaauuggaguggauaaagaaaccgcacaaguuagacuucaaacugacacaacaaaccauuuugagauagcaggaacaacagucaaguccggaugguuuaaaagcacaacauacauaacucuagaucaaacaugugagcacuugaaagucucuuguggaccuaagucaguucaauuccacgcaugcuuuaaucaacacauguccugcgucagauucuugcauaggacaauucugccuggauccauugccaacucaauaugccagaauauagaaauaauaauucuaguaacucuuacacuacuaauuuuuguacuuuuaaguauauugaguaagacauauaucuguuauuuacuaaugccuaucuuuauuccuauagcauauauauaugguauuauuuacaauaagucuuguaagaaauguaaauugugcggguuaguuuaccacccauucacagaaugcgggacacauuguguaugcggugcucgcuaugauaccuccgauagaaugaaauuacacagaucuucuggucuaugcccuggguauaagagucuaagggcugccagaguuauguguaaguccaaaggcccugcaucaauacuaucgauaauuacagcaauacugguucuaacuuuugucacaccaauaaauucaaugguuauaggagaaagcaaagaggucuuugaauuggaagagcucccagaugauauguuggaaauggcacugaagauuaaucuuuauuauuuuguuuguguuauaaauuaugcugugacuuggagccucguaauuguugccuugcuaauugcguuaauauucaaaaaguaccaacacagauucuuaaaucuuuaugcaauguacugugaggaaugugacauguaucaugauagaaucggcuugaagaggaauggagauuucacaaauaaaugcaggcaauguacgugcggacaguaugaggaugcuacugggcuaaugacacacagaaagacauacaauugccuugugcaauauaagucuaaguggauuuugaauuucuugauaacuuauaugaucuuaacucugauuaaggacucagcuauaauuguacaagcagcugguacagacuucagugcuuguuuagaagcacagaguguggauuggaauugcacagggccauuuuuaaaccucggaaauugccaaaaacagcagaaaaaggaguccuaugcaaauauugcuacacaacucaaaggcuugcaggcaaucucaguacuggaugugccuaugauagcaaacauaccggaggauauagcaggagcacuaagauauauagaagaaaaagacacauuucauguccaauuaacugcagaauaugcuaugcugacuagguacugcgauuacuacacacaauuugcagacaauucugguuacagucagacgacauggaggguuuauuugagaucacacgauuuugaugcuugcauacuauacccaaaccaacauuuuugucgaugugucaagcacggagacaaaugcaguaguuccaacugggauuuugcaaaugagaugaagaacuauuacucagggaagcaaaacaaauuugauaaagauuugaauuuggcccugauggcagugcaccaugcauucagagguaccucaucagcauauauugcaacaauguuguccaaaaaaucgaauaaugaucugguuacauacaccaauaagauaaaggaaaaguuccccggaaaugcuuuauuaaaagcuauaauggauuauauaucauacaugaagggcuuaucugaaaugacaaacuuuaaauacgaugaauucugggaugaucuucugcacaagccaagccccacaaaugccccuccucugucaagagauagugaaccaucauacaacuucaagucaguuauuuccucaaggucugugaaaagcuguaaaaauguuaaaaacguagugugcuugucaccuagaucuggcgugucuuacgacucuauauuggcaugcggugaaccaaauggaccaaguguauacaagaagccauccgaugguguauuccaguccaauucggauaagacaauguauugcuuagcugauagucacugcuuagaagauuuugaaguaguuagucaggaagaguuagaugcuauaaaaaaguccaaguguuggguaacagaauacccuaauguaaaauuguccaaauugagugaugggauuacgagcugcagaaugaaagauucagggaaaugcaauguugcagcuaacagauggccaauaauacaaugcgaaaaugauaaauucuauuacucagaauuacagaaugauuacgauaaaacacaggauaucggacauuuuugccuuaguccagggugcucuacaauccgguucccaauuaaccagaagcauauaucuaacuguaauuggcagguuagucggucuagcauagcaaaaaucgaugugcaugauauugaggacauugaucaguauagaaaggccauaacucagaaacuucaaacuggucucucauuauuuaaauaugcuaagacaaaaaaucuaccacauauaaagccaauuuacaaauauauaacuauugaaggaacugagacugccgaaggcauagaaagugcauauauugaaucugagauaccugcauuagcugggacaucaauugguuucaaaaucaacucuaaagaagggaagcauuuauuggauauuguugguuaugucaaaagugcaucauacucaucuguguauacaaagcuuuacucaacagguccaacaucaggaauaaauacgaaacaugaugagcuaugcacugggccaugcccugugaauauaaaccaucagacaggaugguugaccuuugcgaaagaaagaacaagcucauggggcugugaagaauuugguugccuugcuauuagugaugggugugucuuugggucaugucaggauauagugagagaugaauugucaguauauaggaaagaaacagaagaaguaacagauguagaacuuugucugaccuucucagacaagacuuacuguacaaauuuaaauccuauaacgccaaucauaacagacuuauuugagguccaguuuaaaacuguggaaacuuacagcuuaccaagaauaguggccauccagaaccaugaagugaagauuggccaaauaaaugauuugggaguuuacucgaaagguugugguaacguucaaaaagugaaugggacaguuuauggcaauggggucccaaaauuugauuauuugugucaucuagcuaguaggaaagaggucauuguaagaaagugcuuugauaaugauuaccaagcauguaaauucuuacaaacaccagcaagcuacagacuggaggaaaguaguggcacagugacuguuaucgauuauaagaaaauauuagggacaaucaaaaugaaagcuaucuuaggggaugucaaauauaaaacuuuugcagauaauguagauaugacugcugagggaucaugugccgggugcauaaauuguuuugaaaauauccauugcgaauuaacacuacauacaacaauagaugcaaguugcccuguuacaagcccgugcacaguauuucaugauaggauacuaauaacaccaaaugagcauaaguaugcaaugaaaguuaucuguacugaaaagccggguaauacauuaacaaucaaaauuugcggcacuaaaauugacgcuucguuagcucuuauugaugcuaagccaauacuagaguuagcaccaguugaucagaccgcuuacauuagagaaaaagaugaaaggugcaagacuuggauguguagaguaagagaugaaggcuugcaggucauuuuagaaccuuucaagaacuuauuuggcucuuauauagggauauuuuauaccuuuauuaucuguauuauuguauuauugauuguuaucuacauuguuuugccuaucugcuuuaagcuaagagacacucucaggcagcaugaggaugccuauaaaagagagaugaaaauuagguaa

SEQ ID NO: 4200 - RNA, 4329 nt, Artificial Sequence
  derived and/or modified CDS sequence (wt) from CHATV(Mohko M07-1)__KF719225.1__GP
augaugauuuucauauugauacuguuugcagucagugcugcaaguccaguauaucagcgguguuuccaagauggggcuauagugaagcaaaacccaucuaaggaggcuguuacagaaguaugccucaaagacgacguuagcaugauaaagacagaagccagguaugugaagaaugcuacaggaauuuauucuaacaauguggcaaucaggaaaugguuagucucagacuggcaugacugcaggccuaggaaagucucagguggacacaucaauguuauagaaguuggugaugaucuuucacuucauacugaaucuuaugucugcagugcugauugcacaauuggaguggauaaagaaaccgcacaaguucgacuucaaacugacacaacaaaccauuuugagauagcaggaacaacagucaaauccggaugguucaaaagcacaacauacauaacucuagaucaaacaugugaacacuugaaggucucuuguggaccuaagucaguucaauuccaugcaugcuuuaaucaacacauguccugcgucagauucuuacauaggacaauucugccuggauccauugccaacucaauaugucagaauauagaaauaauaauucuaguaacucuuacacuacuaaucuuuguacuuuuaaguauauugaguaagacauauaucuguuauuuacuaaugccuaucuuuauuccuauagcauauauguaugguauuauuuacaauaagucuuguaaaaaauguaaauugugcggguuaguuuaccacccauucacggaaugcgggacacauuguguaugcggugcucgcuaugauaccuccgauagaaugaaauuacacagaucuucuggucuaugcccuggauauaagagucuaagggcugccagaguuauguguaaguccaagggcccugcaucaauauuaucgauaauuacagcaauacugguucuaacuuuugucacaccaauaaauucaaugguuauaggagaaagcaaagaggucuuugaauuggaagagcucccggaugauauguuggaaauggcacugaagauuaaucuuuauuauuuuguuuguguuauaaauuaugcugugacuuggagccucauaauuguugccuugcuaauugcguuaauauucaaaaaguaccaacacagauucuuaaaucuuuaugcaauguacugugaggaaugugacauguaucaugauagaaucggccugaagaggaauggagacuucacaaacaaaugcaggcaauguacaugcggacaguaugaggaugcuacugggcuaaugacacacagaaagacauacaacugccuugugcaauauaagucuaaguggauuuugaauuucuugauaacuuauauggucuuaacucugauuaaggacucagcuauaauuguacaagcagcugguacagacuucagugcuuguuuagaagcacagaguguggacuggaauugcacagggccauuuuuaaaccucggaaauugccaaaaacagcagaaaaaggaguccuaugcaaauauugcuacacaacucaaaggcuugcaggcgaucucaguacuggacgugccuaugauagcaaacauaccggaggauauagcaggagcacuaagauauauagaagaaaaagacaccuuucauguucaauuaacugcggaauaugcuauguugacuagguacugcgauuacuauacacaauuugcagauaauucugguuauagucagacgacauggaggguuuauuugagaucacacgauuuugaugcuugcauacuauacccaaaccaacauuuuugccgaugugucaagcacggagauaaaugcgguaguuccaaccgggauuuugcaaaugagaugaagaacuacuauucaggaaagcaaaacaaauuugauaaagauuuaaauuuggcccugauggcagugcaccaugcauuuagagguacuucaucugcauauauugcaacaauguuguccaaaaaaucgaauaaugaucugguuacauacaccaauaagauaaaggaaaaguucccuggaaaugcuuuauugaaagcuauaauggacuauauaucauacaugaagggcuuaucagaaaugacaaacuuuaaguacgaugaauucugggaugaccuucuacacaagccaagcccuacaaaugccccuccucugucaagagauagugaaccaucauacaacuucaagucaguuaucuccucaagaucugugaaaagcuguaaaaaugucaaaaacguaguguguuugucaccuagaucuggcgugucuuacgacucuauauuggcaugcggugaaccaaauggaccaaguguguacaagaagccaucugaugguauauuccaguccaauucggauaagacaauguauugcuuagcugauagucacugcuuagaggauuuugaagugguuagucaggaagaauuagaugcuauaaaaaaguccaaguguuggguaacagaauacccuaauguaaaauuguccaaacugagugaugggaucacaagcugcagaaugaaagauucaggaaaaugcaauguugcagccaacagauggccgauaauacaaugugaaaaugauaaauucuauuacucagaauuacagaaugauuacgauaaaacacaggauaucggacauuuuugccuuaguccagggugcucuacaauccgguucccaauuaaccagaagcauauaucuaacuguaauuggcaaguuagucgaucuagcauagcaaaaaucgaugugcaugauauugaggacauugaucaguauagaaaggccauaacucagaaacuucaaacuggucucucauuauuuaaauaugccaagacaaaaaaucuaccacauauaaagccaauuuacaaauauauaacuauugaaggaacugagacugccgaaggcauagaaagugcauauauugaaucugagauaccugcauuagcugggacaucaauugguuuuaaaaucaacuccaaagaagggaagcauuuauuggauauugucgguuaugucaaaagugcaucauacucaucuguguauacaaagcuuuacucgacagguccaacaucaggaauaaauacaaaacaugaugagcuaugcacugggccaugcccugugaauauaaaucaccagacaggaugguugacuuuugcgaaagaaagaacaagcucauggggcugugaagaauuugguugccucgcuauuagugaugggugugucuuugggucaugucaggauauagugagagaugaauugucaguauauaggaaagaaacagaagaaguaacagauguagaacuuugucuaaccuucucagacaagacuuacuguacaaauuuaaauccuauaacgccaaucauaacagacuuauuugagguccaguuuaaaacuguggaaacuuacagcuuaccaagaauaguggccauccaaaaccaugaaguaaagauuggccaaauaaaugauuugggaguuuacucgaaagguugugguaacguucaaaaagugaaugggacaguuuauggcaauggggucccaaaauuugauuauuugugucaucuagcuagcaggaaagaggucauugugaggaagugcuuugauaaugauuaccaagcaugcaaauucuuacagacaccagcaaguuacagacuggaggaaaauaguggcacagugacuguuauugauuauaaaaaaauauuggggacaaucaaaaugaaagcuaucuuaggggaugucaaauauaaaacuuuugcagauaauguagauaugacugcugaaggaucaugugccggguguauaaauugcuuugaaaauauccauugcgaguuaacacuacauacaacaauagaugcaaguugcccuguuacaagcccgugcacaguauuucaugauaggauacuaauaacuccaaaugagcauaaguaugcaaugaaaguuaucuguacugaaaagccagguaauacauuaacaaucaaaauuugcggcacuaaaauugaugcuucauuagcucuuauugaugcuaagccaauacuagaguuagcaccaguugaucaaacagcuuacauuagagagaaagaugagaggugcaagacuuggauguguagggugagagaugaaggcuugcaggucauuuuagaaccuuucaagaacuuauuuggcucuuauauagggauauuuuauaccuuuauuaucuguaugauuguauuauugauuguuaucuacauuguuuugccuaucugcuuuaagcuaagagacacucucaggcagcaugaggaugccuacaaaagagagaugaaaauuagguaa

SEQ ID NO: 4201 - RNA, 4329 nt, Artificial Sequence
  derived and/or modified CDS sequence (wt) from CHATV(Mohko M07-2-83)__KF719228.1__GP
augaugauuuucauauugauacuguuugcagucagugcugcaaguccaguauaucagcgguguuuccaagauggggcuauagugaagcaaaacccaucuaaggaggcuguuacagaaguaugccucaaagacgacguuagcaugauaaagacagaagccagguaugugaagaaugcuacaggaauuuauucuaacaauguggcaaucaggaaaugguuagucucagacuggcaugacugcaggccuaggaaagucucagguggacacaucaauguuauagaaguuggugaugaucuuucacuucauacugaaucuuaugucugcagugcugauugcacaauuggaguggauaaagaaaccgcacaaguucgacuucaaacugacacaacaaaccauuuugagauagcaggaacaacagucaaauccggaugguucaaaagcacaacauacauaacucuagaucaaacaugugaacacuugaaggucucuuguggaccuaagucaguucaauuccaugcaugcuuuaaucaacacauguccugcgucagauucuuacauaggacaauucugccuggauccauugccaacucaauaugucagaauauagaaauaauaauucuaguaacucuuacacuacuaaucuuuguacuuuuaaguauauugaguaagacauauaucuguuauuuacuaaugccuaucuuuauuccuauagcauauauguaugguauuauuuacaauaagucuuguaaaaaauguaaauugugcggguuaguuuaccacccauucacggaaugcgggacacauuguguaugcggugcucgcuaugauaccuccgauagaaugaaauuacacagaucuucuggucuaugcccuggauauaagagucuaagggcugccagaguuauguguaaguccaagggcccugcaucaauauuaucgauaauuacagcaauacugguucuaacuuuugucacaccaauaaauucaaugguuauaggagaaagcaaagaggucuuugaauuggaagagcucccggaugauauguuggaaauggcacugaagauuaaucuuuauuauuuuguuuguguuauaaauuaugcugugacuuggagccucauaauuguugccuugcuaauugcguuaauauucaaaaaguaccaacacagauucuuaaaucuuuaugcaauguacugugaggaaugugacauguaucaugauagaaucggccugaagaggaauggagacuucacaaacaaaugcaggcaauguacaugcggacaguaugaggaugcuacugggcuaaugacacacagaaagacauacaacugccuugugcaauauaagucuaaguggauuuugaauuucuugauaacuuauauggucuuaacucugauuaaggacucagcuauaauuguacaagcagcugguacagacuucagugcuuguuuagaagcacagaguguggacuggaauugcacagggccauuuuuaaaccucggaaauugccaaaaacagcagaaaaaggaguccuaugcaaauauugcuacacaacucaaaggcuugcaggcgaucucaguacuggacgugccuaugauagcaaacauaccggaggauauagcaggagcacuaagauauauagaagaaaaagacaccuuucauguucaauuaacugcggaauaugcuauguugacuagguacugcgauuacuauacacaauuugcagauaauucugguuauagucagacgacauggaggguuuauuugagaucacacgauuuugaugcuugcauacuauacccaaaccaacauuuuugccgaugugucaagcacggagauaaaugcgguaguuccaacugggauuuugcaaaugagaugaagaacuacuauucaggaaagcaaaacaaauuugauaaagauuuaaauuuggcccugauggcagugcaccaugcauuuagagguacuucaucugcauauauugcaacaauguuguccaaaaaaucgaauaaugaucugguuacauacaccaauaagauaaaggaaaaguucccuggaaaugcuuuauugaaagcuauaauggacuauauaucauacaugaagggcuuaucagaaaugacaaacuuuaaguacgaugaauucugggaugaccuucuacacaagccaagcccuacaaaugccccuccucugucaagagauagugaaccaucauacaacuucaagucaguuaucuccucaagaucugugaaaagcuguaaaaaugucaaaaacguaguguguuugucaccuagaucuggcgugucuuacgacucuauauuggcaugcggugaaccaaauggaccaaguguguacaagaagccaucugaugguauauuccaguccaauucggauaagacaauguauugcuuagcugauagucacugcuuagaggauuuugaagugguuagucaggaagaauuagaugcuauaaaaaaguccaaguguuggguaacagaauacccuaauguaaaauuguccaaacugagugaugggaucacaagcugcagaaugaaagauucaggaaaaugcaauguugcagccaacagauggccgauaauacaaugugaaaaugauaaauucuauuacucagaauuacagaaugauuacgauaaaacacaggauaucggacauuuuugccuuaguccagggugcucuacaauccgguucccaauuaaccagaagcauauaucuaacuguaauuggcaaguuagucgaucuagcauagcaaaaaucgaugugcaugauauugaggacauugaucaguauagaaaggccauaacucagaaacuucaaacuggucucucauuauuuaaauaugccaagacaaaaaaucuaccacauauaaagccaauuuacaaauauauaacuauugaaggaacugagacugccgaaggcauagaaagugcauauauugaaucugagauaccugcauuagcugggacaucaauugguuuuaaaaucaacuccaaagaagggaagcauuuauuggauauugucgguuaugucaaaagugcaucauacucaucuguguauacaaagcuuuacucgacagguccaacaucaggaauaaauacaaaacaugaugagcuaugcacugggccaugcccugugaauauaaaucaccagacaggaugguugacuuuugcgaaagaaagaacaagcucauggggcugugaagaauuugguugccucgcuauuagugaugggugugucuuugggucaugucaggauauagugagagaugaauugucaguauauaggaaagaaacagaagaaguaacagauguagaacuuugucuaaccuucucagacaagacuuacuguacaaauuuaaauccuauaacgccaaucauaacagacuuauuugagguccaguuuaaaacuguggaaacuuacagcuuaccaagaauaguggccauccaaaaccaugaaguaaagauuggccaaauaaaugauuugggaguuuacucgaaagguugugguaacguucaaaaagugaaugggacaguuuauggcaauggggucccaaaauuugauuauuugugucaucuagcuagcaggaaagaggucauugugaggaagugcuuugauaaugauuaccaagcaugcaaauucuuacagacaccagcaaguuacagacuggaggaaaauaguggcacagugacuguuauugauuauaaaaaaauauuggggacaaucaaaaugaaagcuaucuuaggggaugucaaauauaaaacuuuugcagauaauguagauaugacugcugaaggaucaugugccggguguauaaauugcuuugaaaauauccauugcgaguuaacacuacauacaacaauagaugcaaguugcccuguuacaagcccgugcacaguauuucaugauaggauacuaauaacuccaaaugagcauaaguaugcaaugaaaguuaucuguacugaaaagccagguaauacauuaacaaucaaaauuugcggcacuaaaauugaugcuucauuagcucuuauugaugcuaagccaauacuagaguuagcaccaguugaucaaacagcuuacauuagagagaaagaugagaggugcaagacuuggauguguagggugagagaugaaggcuugcaggucauuuuagaaccuuucaagaacuuauuuggcucuuauauagggauauuuuauaccuuuauuaucuguaugauuguauuauugauuguuaucuacauuguuuugccuaucugcuuuaagcuaagagacacucucaggcagcaugaggaugccuacaaaagagagaugaaaauuagguaa

SEQ ID NO: 4202 - RNA, 4326 nt, Artificial Sequence
  derived and/or modified CDS sequence (wt) from CHATV(LEIV-15854)__HQ734820.1__GP
augauuuucauauugauacuguuugcagucagugcugcaaguccaguauaucaacgguguuuccaagauggggcuauagugaagcaaaacccaucuaaggaggcuguuacagaaguaugccucaaagacgacguuagcaugauaaagacagaagccagguaugugaagaaugcuacaggaaucuauucuaacaauguggcaauuaggaaaugguuagucucagacuggcaugacugcaggccuaggaaagucucagguggacacauuaauguuauagaaguuggugaugaucuuucacuucauacugaaucuuaugucugcagugcugauugcacaauuggaguggauaaagaaaccgcacaaguuagacuucaaacugacacaacaaaccauuuugagauagcaggaacaacagucaaguccggaugguuuaaaagcacaacauacauaacucuagaucaaacaugugagcacuugaagguaucuuguggaccuaagucaguucaauuccaugcaugcuuuaaucaacacauguccugcgucagauucuugcauaggacaauucugccuggauccauugccaacucaauaugccagaauauagaaauaauaauucuaguaacucuuacacuacuaauuuuuguacuuuuaaguauauugaguaagacauauaucuguuauuuacuaaugccuaucuuuauuccuauagcauauguguaugguauuauuuacaauaagucuuguaaaaaauguaaauugugcggguuaguuuaccacccauucacagaaugcgggacacauuguguaugcggugcucgcuaugauaccuccgacagaaugaaauugcacagaucuucuggucuaugcccuggguauaagagucuaagagcugccagaguuauguguaagucuaaaggcccugcaucaauacuaucgauaauuacagcaauacugguucuaacuuuugucacaccaauaaauucaaugguuauaggagaaagcaaagaggucuuugaauuagaagagcucccagaugauauguuggaaauggcacugaagauuaaucuuuauuauuuuguuuguguuaugaauuaugcugugacuuggagccucguaauuguugccuugcuaauugcguuaauauucaaaaaguaccaacacagguucuugaaucuuuaugcaauguacugugaggaaugugacauguaucaugauagaaucggcuugaagaggaauggagauuucacaaacaaaugcaggcaauguacaugcggacaguaugaggaugcuacugggcuaaugacacacagaaaaacauacaacugccuugugcaauauaagucuaaguggauuuugaauuucuugauaacuuauauggucuuaacucugauuaaggacucggcuauaauugugcaagcagcugguacagacuuuagugcuuguuuagaagcacagaguguggauuggaauugcacagggccauuuuuaaaccucggaaauugccaaaaacagcagaaaaaggaguccuaugcaaauauugccacacaacucaaaggcuugcaggcaaucucaguacuggaugugccuaugauagcaaacauaccggaagauauagcaggagcacuaagauauauagaagaaaaagacaccuuucauguccaauuaacugcagaauaugcuaugcugacuagguauugcgauuacuacacacaauuugcagauaauucugguuauagucagacgacauggaggguuuauuugagaucacacgauuuugaugccugcauacuauacccaaaccaacauuuuugucgaugugucaagcacggagauaaaugcaguaguuccaacugggauuuugcaaaugagaugaagaacuacuacucaggaaagcaaaacaaauuugauaaagauuuaaauuuggcccugauggcaguacaccaugcauucagagguaccucaucugcauauauugcaacaauguugucaaaaaaauugaauaaugaucugauuacauacaccaauaagauaaaggaaaaguucccuggaaaugcuuuauugaaagcuauaauggauuauauaucauacaugaagggcuuaucagaaaugacaaacuuuaaguaugaugaauucugggaugaccuucugcacaagccaagccccacaaaugccccuccucugucaagagauagugaaccaucauacaacuucaagucaguuauuuccucaagaucugugaaaagcugcaaaaaugucaaaaauguaguguguuugucaccuagaucaggugcgucuuacgacucuauauuggcaugcggugaaccaaauggaccgaguguguacaagaagccaucugaugguguauuucaguccaauucggacaagacaauguauugcuuagcugauagucacuguuuagaagauuuugaagugguuagucaggaagaauuagaugcuauaaaaaaguccaaguguuggguaacagaauacccuaauguaaaauuguccaaauugagugaugggaucacaagcugcagaaugaaagauucagggaaaugcaauguugcagcuaacagauggccaauaauacaaugcgaaaaugauaaauucuauuacucagaauuacagaaugauuacgauaaaacgcaggauaucggacauuuuugccuuaguccaggaugcucuacaauccgguucccaauuaaccagaagcauauaucuaacuguaauuggcagguuagucgaucuagcauagcaaaaauugaugugcaugacauugaggacauugaucaguauagaaaggccauaacucagaaacuucaaacuggucucucauuauuuaaauaugcuaagacaaaaaaucuaccacauauaaagccaauuuacaaauauauaacuauugaaggaacugagacugcugaaggcauagaaagugcauauauugaaucugagauaccugcauuagcugggacaucaauugguuuuaaaaucaacucuaaagaagggaagcauuuauuggauauuguugguuaugucaaaagugcaucauauucaucuguguauacaaagcuuuacucgacagguccaacaucaggaauaaauacgaaacaugaugagcuaugcacugggccaugcccuguaaauauaaaccaccagacaggaugguugaccuuugcgaaagaaagaacaagcucauggggcugugaagaauuugguugccuugcuauuagugauggguguguuuuuggaucaugucaggauauagugagagaugaauugucaguauauaggaaagagacagaagaaguaacagauguagaacuuugucuaaccuucucagacaagacuuacuguacaaauuuaaauccuauaacgccaaucauaacagacuuauuugagguccaguucaaaacuguggaaacuuacagcuuaccaagaauaguggccguccaaaaccaugaaguaaagauuggccaaauaaaugauuugggaauuuacucgaaagguugugguaacguucaaaaaguaaaugggacaguuuauggcaauggagucccaaaauuugauuacuugugucaucuagcuaguaggaaagagguuauugugaggaagugcuuugauaaugauuaccaagcauguaaauucuuacaaacaccagcaagcuacagacuagaggaaaauaguggcacagugacuguuauugauuauaaaaaaauauuggggacaaucaaaaugaaagcuaucuuaggggaugucaaguauaaaacuuuugcagauaauguagacaugacugcugagggaucaugugccgggugcauaaauuguuuugaaaauauccauugcgaauuaacacuacauacaacaauagaugcaaguuguccuguuacaagcccgugcacaguauuucaugauaggauacuaauaaccccaaaugagcauaaguaugcaaugaaaguuaucuguacugaaaagccggguaauacauuaacaaucaaaauuugcagcacuaaaauugacgcuucguuagcucuuauugaugcuaagccaauacuagaguuagcaccaguugaucagacagcuuauauuagagaaaaagaugaaaggugcaagacuuggauguguagaguaagagaugaaggcuugcaggucaucuuagaacccuucaagaacuuauuugguucuuauauagggauauuuuauacuuuuauuaucugugugauuguacuauugauuguuaucuacauuguuuuaccuaucugcuuuaaacuaagagacacucucaggcagcaugaggaugccuauaaaagagagaugaaaauuagguaa

SEQ ID NO: 4203 - RNA, 4326 nt, Artificial Sequence
  derived and/or modified CDS sequence (wt) from CHATV(LEIV-17756)__EU621834.1__GP
augauuuucauauuaauacuguuugcaguuagcacugcgaguccaguauaucaacggugcuuccaggauggggcuauagugaagcaaaacccauccaaggaagcugucacagaggugugccucaaagaugaugucaguaugauuaagacggaggccagguauauuaggaaugccacagggacuuucucuaacaacguagcaaucaggaaauggauugucucggauuggcaugauuguagaccuaaaaaagucucaggugggcacaucaauguaauagaagucggugaugaucucucacuccacacugaauccuaugucugcagugcugauugcacaauuggaguggauaaagaaacugcucaggucagacuccagacugacacaacaaaccauuuugagauagcaggcacgacagucaagucaggaugguuuaagagcacaacauauauaacccuagaccaaacaugugagcaucuaaaagucucuugugggccuaaaucaguccaauuccaugcaugcuuuaaccagcauaugucuugcgucagauucuuacauagaacaauucuaccuggaucuauugcuaauucaauaugucaaaauauagaaauaauaauuuuaguaacucuuacauuacuaauuuuuguacucuuaaguauauuaagcaagacuuauaucuguuauuuacugaugccgauuuuuaucccuauagcauauauauacggcaucauuuauaauaaaucuuguaaaaaaugcaaauuauguggacuaguguaucauccguucacagaaugugggacgcauuguguaugcggugcccgcuaugauacuucugacaggaugaaacugcauaggucauccggucuaugcccuggauacaagaguuugagagcugccagaguuaugugcaagucaaaggggccugcaucaauacugucaauaaucacagcaauauugguucugaccuuugucacaccaauaaauucaaugguuguaggagaaaguaaagagguauucgaacuggaggagcucccagaugauaugcuagagauggcauuaaaaauaaacuucuacuauuuugucugcguuaugaauuaugcugugacuuggggccucauaguuguugcucuguuaauuggguugauuuucaaaaaguaccagcacagauuuuugaaucuuuaugcaauguauugugaggaaugugauauguaucaugauagaacaggcuugaagaggaauggagacuuuacgaacaagugcaggcaauguacaugugggcaguacgaagaugcuacugggcuaaugacacaccggaaaacauacaauugccuugugcaguauaaauccaaauggaucuugaauuuccuaauaacuuacaugguuuuaacuuugaucaaggauucagcuauaguugugcaggcuacaggaacagauuuuagcucuugucuggaaacacaaaguguaaauuggaauuguacaggaccauuucuaaaccuugggaauugccaaaaacagcaaaaaaaggagucuuaugcaaauauugcaacgcaacucaaaggccugcaagcaaucucaguucuugacaugcccaugauagcaagcauaccagaagauauagcaggggcacuaagauauauagaagagagggagaccuuucauguccaauuaacugcagaauaugcuauguugacuagguauugugauuacuacacucaauuugcagacaacucaggcuacagucaaaccacauggaggguuuaucugcgaucacaugacuuugaugcuuguauacuuuacccaaaucaacacuuuugccgaugugucaagcauggagauaagugcaguaguucuaacugggacuuugcaaaugagaugaagaauuacuauucaggaaagcagaauaaauuugauaaagauuugaaccuagccuuaaugacaaugcaucaugcauucaggggaacaucaucugcauauauugcagcauuguugucaaagaggucaaaugaugaucuaguugcauauacaaauaagauaaaagagaaauuuccuggaaaugcucuauugaaagccgugauggauuauauaucauauaugaagagcuugucugaaaugucaaacuuuaaauaugaugaguucugggaugaucuucuucacaagcccaaucccacaaaagcuccuucccucucaagaggugacgagccagcauacaauuucaaauuggcaauuucuucaaggucuaugaaaagcugcaaaaaugucaaaaguguaguauguuuaucgccuagaucuggagugucguaugauucaauauuagcauguggcgagccaaaugcuccaagcguacacagaaagccaucugacgguguauuucaauccaauucagauaaaacgauguauugucuagccgacagccauugcuuagaagacuuugaagugguuagccaagaagaauuagaugcaauaaagaaaucugaguguuggguaacggaauauccaaauguaaaauuaucuaaacuaagugaugggaucaagagcugcagaaugaaagauucaggaaaaugcaauguugcaacaaacagauggccaauaauacaaugcgaaaacgauaaauucuacuauucugaauugcagaaugauuaugauaagacacaggacauugggcacuuuugucuuaguccaggauguucuacaauccgguucccaaucaaucagaagcauauauccaauugcaacuggcagguuagccguucuaguauagcaaaaauugaugugcauaauauugaagacauagagcaguauagaaaggcuauaacucagaaacuucaaacuagucuuucccuguucaaauaugccaggacaaaaaaucugccacauauaaagccaauuuacaaauauauaacuauugaaggaacugaaaccgcugaagguauagagagugcauauauagaaucugaaauaccugcauuagcuggaaccucaauugguuuuaaaaucaacucuaaagaagggaaacaucuacuagauguuauugguuaugucaaaagugcuucauauucaucuguauauacuaagcucuauucaacagguccgacaucaggcauaaauacaaagcaugacgaacuguguacuggaccaugccccgcaaacauaaaacaccagacuggaugguugacuuuugcaagagaaagaacaagcucaugggguugugaagaauuuggcugucuugcuaucagugauggauguguuuucggcucaugccaggauauagugagggaugaguuaucaguguauaggaaggaaacagaagaagugacugaugucgagcugugccuaacuuuuucagauaagacuuauugcacaaaccugaaccccauaacaccaaucauaacagauuuauucgaaguacaauucaaaacuguggaaaccuauagcuuaccaaggauaguagcaauccaaaaucaugaaauaaaaauagggcagauaaaugauuuaggaguuuacucaaagggaugugguaauguccaaaaggugaaugggacaguuuaugguaaugggguuccaaaauuugacuacuugugccaucuagcuagcaggaaagagguuauugugaggaaguguuuugacaaugauuaucaagcauguaaauucuugcaaacaccggcaaguuacagguuagaagagaacaguggcacaguaacugugauugauuauaagaagauacuggggacaaucaagaugaaagccauucugggagauguuaaauauaagacauuugcagauaauguagauauaacugcugaggggucaugcacuggaugcauaaauuguuuugaaaauauccauugcgagcuaacaauacauacuacaauagaugcaagcugcccugucacaagcccaugcacaguguuccaugauagaauacuagugacuccaaaugagcauaaguaugcaaugaaaguuauaugcacugaaaagccagguagcacauuagcaaucaagaucugcaauacaaaaauugaugcuucacuggcucuuauugaugccaagccgauauuagaacuagcaccagucgaucagacagccuacaucagggagaaggaugagaggugcaaaaccuggaugugcagggugagagaugaaggcuugcagguuauuuuagagccuuuuaagaacuuauuuggcucuuauauaggaauauuuuauaccuucguuaucucuauaauugcauuauuaauuguuaucuacauuauuuugccuaucugcuucaagcuaagagauacucuuaggaagcacgaggaugcuuauaagagagaaaugaaaauuagauaa

SEQ ID NO: 4204 - RNA, 4326 nt, Artificial Sequence
  derived and/or modified CDS sequence (wt) from CHATV(LEIV-18733)__HQ734821.1__GP
augauuuucauauuaguacugcuugcagucaguacugcgaguccaguguaucagcggugcuuccaggauggggcuauagugaagcagaacccaucuaaagaggcuguuacagaggugugccuuaaagaugauguuagcaugauaaagacagaagcaagguauaugaagaaugccacaggaacuuuuuccaacaacguagccaucaggaaauggcuggucucagacuggcaugacugcagaccuaagaaagucucgggcgggcauauuaaugucauagagguuggugaugaucucucacuccauacugagucuuaugucugcagugcugauugcacaauuggaguggauaaagagacugcacagguuagacuccaaacugacacaacgaaccauuuugaaauagcaggcacaaccguaaaaucagggugguuuaagagcacaacauacauaacucuagaccaaacaugugagcaucugaaagucucaugcggacccaaaucaguucaauuccaugcaugcuucaaccaacacauguccugugucagauuuuugcacagaacagucuugccuggauccauugcuaauucaauaugccaaaauauagaaauaauaauuuuagugacucucacgcuauugauuuuuguacucuuaaguauacuaaguaagacuuacaucugcuacuugcugaugccuaucuuuaucccuauagcauauguauaugguaucauuuacaauaagucuugcaaaaaauguaagcuauguggguuaguuuaucacccauucacggaaugcgggacacauuguguaugcggugcucgcuaugacaccucugauaggaugaaacugcacaggucuucugguuugugcccuggcuacaagaguuuaagagcugcaagggucauguguaagucaaaggguccugcgucaauacugucaauaauuacggcaauauugguucuaaccuuugugacaccaauaaauucaaugguuauaggagaaagcaaggaaguuuucgaacuagaagaacucccagaugacaugcuagaaauggcuuugaaaauaaauuuuuacuauuuuguuugcgucauaaacuaugcugugacuuggggucucauaguuguugcuuugcuaauugggcugguauuuaaaaaguaccagcauagauuuuuaaaccuuuaugcgauguauugugaagagugcgacauguaucacgauagaacuggauugaaaaggaauggagacuuuacaaauaaauguagacagugcacauguggacaguaugaagaugccacuggucuaauaacgcacaggaagacauauaacugccuugugaaauauaagucuaaauggauauuaaauuuccuaauaacuuauauggucuuaacuuugauuaaggauucagcuauaguugugcaggcugcuggaacagauuucagugcuuguuuagaagcacagaguguggauuggaauugcacaggaccauuuuugaaccuugguaauugucaaaaacagcagaagaaggagucuuaugcaaacaucgcaacacaacucaaaggccuacaggcgaucucaguacucgacaugcccaugauagcgaguauaccagaagauauagcaggggcauuaagauauauagaagaaaaagaaacuuuccauguucaacuaacugcagaauaugcuauguuaaccagauauugcgauuauuauacucaauuugcagacaacucgggcuacagucagacuacauggagaguuuaucugagaucacaugacuuugaugcuuguauacuuuauccaaaucaacacuuuugccgaugcguuaagcauggagacaaaugcaguaguucuaacugggauuuugcuaaugagaugaaaaacuacuacucagggaaacaaaguaaauuugauaaggauuuaaauuuggcccugaugacaguacaucaugcauucagagggaccucaucugcauacauugcaacaaugcuaucuaaaaaaucaaauaaugaccuaguugcauauacaaauaagauaaaagagaaauucccuggaaaugcuuuguugaaggcugucauggauuacauaucguacaugaagagucuauccgaaaugacaaauuucaaauacgaugaguucugggacgaucucuuguacaggccgaauccuacaaaagcuccuucccucucaagagaaagcgaaacaucguacaacuuuaaacuggucauuucuccuaaauccaugaaaagcugcaaaaauguuaaaaguguaguaugcuuaucacccagaucuggagcaucauaugauucaauauuagcauguggcgagccaaaugggccaagcguguauagaaaaccaucuggcgguguauuccaauccaauucagauaaaacaauguauugccuagcugauagccauugcuuggaggauuuugagguaauuggucaagaagaguuggaugcaauaaagaaauccguguguugggcaguagaauauccagaugugacauugucuaaguugagcgaugggguuaagaguugcagaaugaaggauucaggaaagugcaauguugcagcuaacagauggccgauaauacaaugugaaaaugacaaauucuauuauucagagcugcaaaaugauuaugauaaaacacaggacaucggccauuucugucuuaguccugggugcucaacaguaagauucccaaucaaucagaagcauauaucuaauugcaauuggcagguuagccggucuagcauagcaaagauugaugugcaugauauugaagauaucgaucaguacagaaaggcuauaacucagaagcuccaaacaagucucucucuauucaaauaugcuaagacaaaaaaucuaccgcauauuaaaccaauuuacaaguauauaacuauugaaggcacugaaacugcugaagguauagaaagcgcauauauugaaucugaaauaccugcauuagcuggaacgucaguuggguucaaaaucaauuccaaggaggguaagcacuuacuggacaucauugguuauguuaaaagugcaucauacucuucuguauauacuaagcucuacucaacagguccgacaucgggcauaaauacaaaacaugaugaauuaugcaccggaccaugcccugcaaauaucaaccaccaaaaugggugguugaccuuugcaaaggagagaacaagcucuugggguugugaggaauuugguugccuugccaucagugauggaugugucuuugggucaugccaagauauagugagggaugaguugucaguauauaggaaggaaacagaagagguuaccgauguagaacuguguuuaacauucucagacaagacuuauugcaccaacuuaaaccccauaacgccuauuauaacagaccuauucgaggugcaguucaaaacuguagaaaccuacagucuaccaagaauaguagcaauucaaaaccacgagauaaagauugggcaaauaaaugauuugggagucuacucaaaaggaugcggcaauguccagaaagugaaugggacaguuuaugguaauggaguuccaaaauuugauuauuuaugccauuuggcuagcaggaaagagguuauugugaggaagugcuucgauaaugauuaucaggcuugcaaauucuuacaaacgccagcuaguuacagacuugaagaaaauagugguacaauaacagugauugacuacaaaaagauacuaggaacaaucaagaugaaagccauccuaggggauguuaaguauaagacauuugcagacaauguagacauaacuguugaagggucaugcgccgggugcauaaauugcuuugagaauauucauugugaauuaacaauacauacgacaauagaagcaaguugcccugucacaagcccaugcacaguauuucacgauaggauacuaauaacuccgaaugagcauaaguaugcgaugaaaguugucugcacagaaaagccaggcaauacacuaacucucaagguuugcaauacuaaaguagaugcaucacuagcucuuauugaugccaaaccaauauuagaauuagcgccaguugaucagacagccuacaucagggaaaaagaugaaagguguaaaacauggaugugcagaguaagagaugaaggcuugcagguuauacuagagccuuucaaaaauuuguuugguucuuauauagggauauuuuauacuauuaucaucucuauaauugugcuauuaauuguuaucuacauuaucuugccuguuuguuucaaguuaagggauacucuaaggcagcaugaggacgccuacaagagagagaugaaaguuagauag

SEQ ID NO: 4205 - RNA, 4326 nt, Artificial Sequence
  derived and/or modified CDS sequence (wt) from CHATV(LEIV-22712)__HQ734822.1__GP
augauuuucauauuaauacuguucgcagucagugcugcaaguccaguauaucagcgauguuuccaggauggggcuauagugaagcaaaacccauccaaggaagcugucacagaggugugccucaaggaugauguaagcaugauaaaaacagaagcuagguauacaaaaaaugccacagggacuuucucuaacaauguagcaaucaggaaaugguuggucucagauuggcaugauugcagaccuaagaaaguuucaggcggacacaucaauguaauagaagucggugaugaucuuucacuccacacugagucuuaugucuguagugcugacugcacuauuggaguggauaaggaaacugcacagauuagacuucaaacugacacaacaaaucacuucgagauagcaggcacgacaguuaaaucaggaugguuuaagagcacgacguacauaacccuagaucaaacaugugagcacuuaaaagucucuugcggacccaagucaguacaguuccaugcaugcuucaaucaacauaugucuugugucagauucuugcauagaacaguucugcccggguccauugcgaauucaauaugccagaauauagaaauaauaauucuaguaacucuuacauugcuaaucuuuguacucuuaaguauauuaaguaagacguauaucuguuacuugcugaugccuauuuuuaucccuauagcauauguauacgguauuauuuacaauaaaucuuguaaaaaauguaagcuaugugggcuaguuuaccauccauucacagaauguggaacacauuguguguguggcgcccgcuacgauacuucugacaggaugaaguuacacagaucuucuggccugugcccuggguacaaaaguuuaagagcugccagaguuauguguaagucaaaagggccugcaucaguacugucaauaaucacagcaauauuaguucuaacuuuugucacaccaauaaauucaaugguuguaggagaaaguaaagagguauuugaacuagaagagcucccagaugauaugcuagaaauggcauugaagauaaacuucuacuacuucauuugcgucaugaauuaugcugugacuuggggccucauaguuguugguuugcugauuggauugguauucaaaaaguaccagcacagauucuuaaaccuuuaugcuauguacugugaagaaugugacauguaucacgauagaacuggcuuaaagaggaauggagauuuuacaaauaaaugcaggcaguguacgugcggacaguaugaagaugccacugggcuuauaacacacaggaaaacauacaauugccuuguacaguauaaauccaaauggaucuugaauuucuuaauagcuuauaugacuuugacuuugauuaaagauucagcuauaauuguacaggcuacugguacagauuuuaucucuugucuagaaacgcaaaguguaaauuggaauugcacaggaccauuuuugaaccuugggaauugucaaaaacagcaaaaaaaggagccauaugcaaauauugcgacacagcucaaaggcuuacaagcaaucucaguucuugacauacccaugauagcaaacauaccggaagauauagcaggggcgcuaagauauauagaggagaaggaaacuuuucauguccaauugacugcagaauaugcuaugcugaccagauauugugauuauuauacucaauuugcagacaacucaggcuacagucaaacuacauggaggguuuauuugagaucacaugauuuugaugcuugcauauuguacccgaaccagcauuuuugccgaugugucaagcauggagauaagugcaguagcuccaacugggauuuugcaaaugagaugaagaauuauuacucugggaaacagaguaaauuugacaaagauuugaacuuggcauugaugacaaugcaccaugcauucagagggacaucaucugcauauauugcaacauugcugucaaagaaguuaaacgacgaccuagcugcauauacaaacaagauaaaggagaaauucccuggaaaugcccuauugaaggccaugauggacuauauaucauauaugaagagcuuaucugaaauggcaaauuucaaauaugaugaguucugggaugaucuuuugcacaaaccugauccuacaaaagcaccccuccucucaagaggcagugagccaguguauaacuucaaauuagucgucucuucaaggucugugaaaagcuguaagaaugucaagaguguaguguguuugucgccuaggucugggguaucauaugauucagucuuggcauguggcgaaccaaaugguccgaguguguacaggaagccaucugauggcguguuccaauccaacucagauaaaacaauauauugcuuggccgacagccauugcuuagaagauuuugaaguaauuagucaagaagaguuagaugcaauaaaaaaguccgaguguuggguaauugaauacccgaaugugaaauuaaccaaaccaagcgaugggaucaaaagcugcagaaugaaagauucagggaaaugcaauguugcaacuaacagauggccgauaauacaaugcgaaaacaacaauuuuuacuacucugagcuacaaaacgauuaugacaaaacacaagacauuggacacuuuugucuuagcccagggugcucuacaauccgguacccaaucaaucagaagcauauauccaauugcaacuggcagguuagccauucuagcauagccaaaauugaugugcauaauauugaagacaucgagcaguauagaaaagcuauaacucagaagcuccaaacuagccucucccuauucaaguaugcuaagacuaagaaucuaccgcauauaaaaccaauuuacaaauauauaacuaucgaaggaacugaaacugccgaaggcauagaaagugcauauauagaaucugaaauaccugcauuggcugggaccucaauuggcuucaaaaucaauucuaaggaagggaagcaucuacuagauguuauugguuauguuaagagugcaucauauucaucuguauacagcaagcucuauucaacagguccaacaucagguauaaacacaaagcaugaugaacuguguacugggccaugccccgaaaauauaaaacaccaaacuggaugguuaaccuuugcaagagaaagaacaagcucaugggguugugaagaauuuggcugucucgcuaucagugaugggugugucuucgggucaugucaagauauagugaaagaugaguuaucaguguauaggaaggaaacagaagaggugaccgauguugaguugugccuaacuuucucagauaaaacuuauugcacaaaucuaaacccaauaacgccaaucauaacaaacuuauucgaaguacaauuuaaaacuguggaaaccuacagucuaccaagaauuguagcuauccaaaaucacgaaauaaagauugggcagauaaaugauuuagggguuuacucgaaagggugcggcaauguucagaaagugaaugggacaguuuauggcaaugggguaccaaaauucgauuauuuaugccaucuagcuagcaggaaagaaguuauuguaaggaaauguuuugauaaugauuaucaagcauguaaguucuuacaaacaccggcaaguuacagauuggaagaaaauaguggugcaauaacugugauugacuacaaaaagauacugggaacaauuaaaaugaaagccauucuaggagauguuaaauacaaaacauuugcagauaauguagacauaacugcugaggggucaugcacuggaugcauaaauugcuuugaaaauauucauugcgaauugacaauacauaccacuauagaggcaaguuguccuguaacgagcccaugcacaguguuccaugauagaauauuaguaaccccaaacgaacacaaauaugcaaugaaaguugucugcaccgaaaagccagguagcacacuaguaaucaaggucuguaauacuaaaauugaugcuucauuggcccucauugaugcuaagccaauacuagaauuggcgccggucgaccagacagcuuacaucagagaaaaagaugagagauguaagaccuggaugugcagaguaagggaugaaggcuugcagguuauuuuggagccuuuuaagaauuuguuuggcucuuauauagggauauuuuauaccuucauuauuucuauaauuguauuacuaauugucaucuacauuaucuugccuauuugcuucaagcugagggacacucuuagaaagcaugaagaugccuacaagagagaaaugaaaauuagguag

SEQ ID NO: 4206 - RNA, 4332 nt, Artificial Sequence
  derived and/or modified CDS sequence (wt) from INKV(KN3641)__U88059.1__GP
auggaaguccuaaacuuaaucugguugcugacauuaugcucggcuaguccaguguuucagcgguguuuccaagauggggcuauagugaagcaaaacccaucaaaggaggcagugacagaaguuugccuaaaggaugacgugagcaugauaaaaacagaagcaaaauacaucaaaaauacaacaggaacauuugccaacaacauagccaugagaaaaugguuaguugcagauuggcaugauugcaggccccaaaaaucaucagguggccauaucaauguuauugaaguuggcgaugacuugucacuucauacggaaucauauauuugcagugcugacugugucauaacgguugacaaagaaacagcucaaauucguuuacaaacugacaacacaaaccacuuugagguugcugguacuacaguuaaaucagggugguucaagaguacuacauauauuacacuugaucaaacaugugagcaucugaaagugucaugcggaccuaaaucaauacaguuccaugcuugcuuuaaucaacauaugucaugugugcgauuucugcauaggacaauacuuccagguucgauagcaaauucuauaugucagaauauagaaauaauuauucugguaacuuugucuuuagugauuuuuauauuuuuaacaauaguuaguaagacauauguauguuaccuauuaaugccuauauuuaucccaauagcauauauuuacggguggauauauaacaaaucuuguaaaaaauguagauuguguggguuaguuuaccacccauuuaccgagugugggacacauuguguuuguggugcaagauaugaaacuucugauaggaugaaauugcauagggcaucuggguuguguccgggguauaagaaucucagagcagccagaguuaugugcaaaucaaaagggccagcaucaguuuuauccauuaugacagcaguucucauacuaacguuugucacuccuauuagugcuauggucauuggugaaucaagugaaguguacacacuaggugacuugccugaugauaugguagaaauggcagaaagaguaaauaucuacuaucagaucauuauaauuaauuacagcauaacauggguuuucuuacuacuuggcuuaauuauagcauauuucuuuaggaaauaucaacauagauuuuuaagcuuuuaugcaauguauuguaaagaaugugacauguaucaugaaagagcugguuugaccuacuggggugacuuuacaaauaaaugcaggcaaugcacaugugggcaauuugaggauguuacuggguugauggugcauaagaaaucuuacaauugcauaauuaaauacaaagcaaaguggauaagagauaugcuaaucacauauuuacuuaucaugcuaaucaaagauucacuauuauuugucggugcgacaggaacagauuucgcugcauguauagaugagaaaacagucacauggaaucguacuggaccauuucuaaauuuaggcaggugcgauaaaucccagaagaagacugguuauacugauauagcugaucaguugaaagguuugggugcgauaucagugcuagauauuccaaugauaaaaaagaugccagaugagauaucuggaucacugaaguguauagaugauuuagagacacaucaugaacaauugacugcugaauaugccuuccuuacuagauacugcgauuauuauacacaguacacugauaauucagguuauagucaaacuguguggaggacuuauuugcgaucucaugauuuuggugcaugugucguuuauccaaaucaacauuucugcagauguguaaaacauggugauaagugcaauagugcuaagugggauuucgcaaaugaaaugaaaacauucuauacuggucagaaagcaaaauuuaacaaagauuuaaauuuggcauuauugguauuacacaaagcauuuagaggaacuggcacuucauauauugcagaaaguauggcccgaaaagauaacaggucuaugacacauuuugccuuagagauaaagaaaaaauucccaacaaaugcgcuauugacagcauugauagauuacauuucuuauuuacaaucaccugcagagaugucuacuuuugaacuugaugaggauugggaagauuucaaauacaaaccugaaccaacagaaucgccucaacuuagaucacauagaacugaucaguauaauuuuaaaaaugcagauaguaauagcaauguuaaagucugcaaaaauauucaaaaagugucauguauuucaccuaggucuagagccaaauuugaaaauauaauagcauguggagaacaugcgaacccaucaguauauacgaugcccaaugucaguauuuaccaaucuaauucagagaggagccacuacuguauagcugacucacauuguuuagaagaauaugaaguaguggaaacagaacucuuaaaugcauugaaaaaaucuaaauguugggcuagagaaauggaugauauuguucugcacaaacaaguugauggcuuaaggaguuguagaaugaaagauacugggaacuguaacguucaagaaaaugauuggacuauuguuuuaugugagaauggcaauuauuauuauucagaagcucacagagacuaugauaaagaucaagauguaggucacuuuugucucagcccucgauguaguacaauacgcuacccaauaaguaaaaggcauauuaaaaauugugauuggcagaucucacauucaacaauugacaagaucucaguucaggaauuagcagauauagagcaauauaagaaagccauaucacagaaguuacagacaagucuaucgaucuuuaaguaugugaaaacaaagaaucuuccacauauuaaaccagcauacaaauauauaaccguggaagguguugaaacuguugaagggauagaaaaugcuuuuauagaaucugaaauuccugcacuagcuggcacagccauugguuucaaaauaaauucaagagagggcaacuaccuaauggauguaauagguuauguuaaaaguggaucauauucagcaacauacacaaaacuauauauaacugguccaacuauagggguaaauacuaagcaugaugaaaagugcacaggacccugcccagcuauaauagaucauaaagaaggcugguuaacuuuugcaaaaggaagaacuagcacaugggguugugaagaauuugguuguuuagcaguuagugauggcuguguauuuggaucuugucaagauaucauaaaagaugaauuagcuguccauaggaaaacuacugaggagcccaccacaguagaauuaugcuugacauuuucagacaagacauauugcacuaacuugaaugccauaaccccuauaauaacagauaaauuugaaguucaauucaaaacaguugagucuuacacauuaccaaggauaauagcuauaaaaaaucacgaaauuaaaguugggcaaaucaaugaccuagguguguacucuaaaggaugugggaauguucaaaaaauaaaugggacaaacuauggcaauggauuaccaaaguuugauuauuuaugccauuuagcagguagaaaagaaguuaucauaaggaaauguuucgauaacgauuaccaagcuugcaaauuucuacaaaguccuccaagcuaucguuuagaggagcaucaaggcacaguaacaguaauagauuauaaaaaaauucuaggcacuauaaagauggaggcuauauuaggagaugugaaauauaggaauuaccagaguaauauugaaaucaaugcuaaaggaacaugugcuggauguauaaauuguuuugaaaauauucacugugaauuuacuauacauaccacaguagaagcaaguugcccuauagugacagacuggguuucauuccaugacagaauacugaucacaccagacgaacauaaauaugcauuaaaaguuguaugucaagaaaaaccuaaacugucucuaaaauuuaagaucuguaacacaaauauugaugcgucuaugacuguuguggauuccaagccgauccuagagcuugcaccaguugaucaaacuacauacauuagagaaagagaugaaagaugcaaaacuuggaugugcaggguucgagaugaaggguuccagguaauauuggaaccguuuaaaaaccuuuuuggcucuuacauuggaauauuuuauacggguauauuauguauuguaugucuccuuauuguuauuuauauuauacugccuauuuguuucaaguugagggacacucuaaggcaacuugaggaugcauauaagaaggaggugaaaauaagauga

SEQ ID NO: 4207 - RNA, 4332 nt, Artificial Sequence
  derived and/or modified CDS sequence (wt) from INKV(SWAR83-161)__U88060.1__GP
auggaaguccuaaacuuaaucugguugcugacauuaugcucggcuaguccaguguuucagcgguguuuccaagauggggcuauagugaagcaaaacccaucaaaggaggcagugacagaaguuugccuaaaagaugacgugagcaugauaaagacagaagcaaaauacaucaaaaaugcgacagggacauuugccaacaacauagcaaugagaaaaugguugguugcagauuggcaugauuguaggccccaaaaaucaucagguggucauauuaauguuauugaaguuggcgaugacuugucacuucauacagaaucauauauuugcagugccgacugugucauaacggucgacaaggaaacagcucaaauucgcuugcaaacugacaacacaaaucacuuugaaguugcugguacuacaguuaaaucagggugguucaagaguacuacauauauuacacuugaucaaacaugcgagcaucuuaaaguaucauguggaccuaaaucaauacaauuccaugcuugcuuuaaucagcacaugucaugugugcgauuccugcauaggacaauacuuccagguucaauagcaaauucuauaugucagaacauagaaauaauuauccuggugacucugucuuuagcgauuuuuauauuuuuaacaauaguuaguaagacauauguauguuacuuauuaaugccuauauuuauuccaauagcauauauuuacggauggauauauaacaaaucuuguaaaaaauguaaguuauguggguuaguuuaccacccauuuacugagugugggacacauuguguuuguggugcaagguaugaaacgucugauaggaugaaauugcauagagcaucuggauuguguccaggauauaagaaccucagagcagccagaguuauguguaagucaaaagggccagcaucaguuuuauccaucaugacagcaauucuuauacuaacauuuguuacuccuauuagugcuauggucauuggugaaucaagugaaguguacacacuagaugaauugccugaugauaugguacaaauggcagaaagaguaaauauauacuaccagaucauuauuauuaauuacagcauaacaugggcuuucuuauuauuuggcuuaguucuagcauauuucuuuaagaaauaucaacauagguucuugagcuuuuaugcaauguauuguaaagaaugugacauguaccaugagagagcagguuugacauauuggggugacuucacaaacaaaugcaggcaauguacaugugggcaauuugaggauguuacuggguuaauggugcauaagaaaucuuauaauuguauaauuaaauacaaagcaaaauggauaagagacauacuaaucacauaucugauuaucauguuaaucaaagauucacuauuguuuguuggugcaacaggaaccgauuuugcugcaugcauagaugagaaaacagucacauggaauuguacuggaccauuucuaaacuuaggcaagugcgauaaaucccaaaagaagauugguuaugcugauauugcugaucaguugaaaggucugggugcaauaucagugcuagauauuccaaugauaaaaaggaugccggaugagauaucugggucacugaaguauauugaugguuuagagacauaccaugaacaacugacugccgaauaugccuuccuuacuagauacugugauuauuauacacaguacacugauaauucagguuacagucaaacuguguggaggacuuauuugcgaucucaugauuuuggugcaugugucguuuauccaaaucaacauuucugcagauguguaaaacauggugauaaguguaauagugcuaagugggacuuugcaaaugaaaugaagacauuuuauacuggucaaaaagcaaaauucaacaaagaucuaaacuuggcauuauuaguauuacacaaagcauucagaggaacugguacuucauauauugcagaaaguauggcccggaaagauaacaggucuaugacacauuuugccuuagagauaaagaaaaaguuuccaacaaaugcacuauugacagcauuaauagauuacauuucuuauuuacaaucacuugcagagaugucuacuuuugaacuugaugaggauugggaagauuucaaguauaaacccgaaccaacagaagcaccucaacuuagaucacauagaacugaucaguauaauuucaaaaaugcagauaguaauagcaauguuaaagucugcaaaaacauucaaaaagugucaugcauuucaccuagauccagggcuaaguuugaaaauauaauagcaugcggagaacaugcgaacccaucaguauauaugaugcccaauguuaguauuuaucaaucuaauucagagaggagucacuacuguauagcugacucacauuguuuagaagaguaugaaguaguggagucagaacucuuaaaugcauugaaaaaaucuaaauguugggcuaaagaaauggaugauauuguucugcauaaacaaucugauggcuuaaggaguuguagaaugaaagauacugggaauuguaauguucaagaaaaugacuggacuauuguucugugugagaauggcaauuauuauuauucagaagcucacagagacuaugauaaagaucaagauguuggccauuuuugucucagcccucgguguaguacaauacgcuacccaauaaauaaaagacauauuagaaauugugauuggcagaucucccauucaacaauugacaagaucucaguucaagaauuggcugauauagagcaauauaaaaaggcuauaucacaaaaguuacaaacaagccuaucaaucuucaaguaugugaagacaaaaaaucuuccacauauuaaaccagcauauaaauacauaacuguggaagguauugaaacuguugaagggauagaaaaugcuuuuauagaaucugaaaucccugcacuagcuggaacagcuauugguuuuaaaauaaacucgagggagggcaacuaccuaauggauguaauaggcuaugucaaaagugcaucauauucagcaacauacacaaagcuauauacaacugguccaacuauaggaguaaauacuaagcaugaugaaaaguguacaggaccuugcccaccuauaauagaucauaaagaaggcugguuaaccuuugcaaaagaaagaacuagcacaugggguugugaagaauuugguuguuuagcaguuagcgauggcuguguauuuggaucuugucaagauaucauaaaagaugaguuagcugucuauaggaaaacuacugaagagcucacuacaguagaauuaugccuaacauucucagauaaaacauauugcacuaaucugaaugccauaacuccuauaauaacagauaaguuugaaguucaauucaaaacuguugaaucguacacauugccaagaauaauagcuauuaaaaaucaugaaauuaagguugggcagaucaaugaucuagguguguacuccaaaggaugugggaauguucaaaaaauaaaugggacaaauuauggcaauggagugccgaaauuugauuacuuaugccauuuggcaaguaggaaagaaguuaucauaagaaaauguuuugauaaugauuaccaagcuugcaaauuucugcaaaguccuccaagcuaucgcuuagaggagcaucaaggcacaguaacagucauagauuauaaaaagauccuaggcauuauaaagaugaaagcuauauuaggagauguaaaauacaaaaauuaucagagcaauauugaaaucaaugcugaaggaacaugugcuggauguauaaauuguuuugaaaacauucacugugaauuuacuauacauaccacaguagaagcaaguugcccuauagugacagacuguguuucauuccaugauagaauacugaucacaccagacgagcauaaauaugcauuaaaaguuguaugucaggaaaagccuaaauugucucuaaaauuuaagaucuguaacacaaauauugaugcgucuaugacuauaguggauuccaagccaauccuagagcuugcaccaguugaccaaacuacauacauuagagagaaagacgaaagaugcaaaacguggaugugcaggguucgagaugaaggauuccaaguaauauuggaacccuuuaaaaaccuuuuuggcucuuacauugggauauuuuauacagguauauuauguauuauaugccuccuuauuguuauuuacaucauauugccuauuuguuucaaguugagggacacucuaaggcaacaugaagaugcauacaagaaggagaugaaaauaagauaa

SEQ ID NO: 4208 - RNA, 4332 nt, Artificial Sequence
  derived and/or modified CDS sequence (wt) from INKV(Lovanger)__KU681435.1__GP
auggaaguccuaaacuuaaucugguugcugacauuaugcucagcuaguccaguguuucagcgguguuuccaagauggggcuauagugaagcaaaacccaucaaaggaggcagugacagaaguuugccuaaaagaugacgugagcaugauaaagacagaagcaaaauacaucaaaaaugcgacagggacauuugccaacaacauagcaaugagaaaaugguugguugcagauuggcaugauuguaggccccaaaaaucaucagguggucauauuaauguuauugaaguuggcgaugacuugucacuucauacagaaucauauauuugcagugcugacugugucauaacggucgacaaggaaacagcucaaauucgcuugcaaacugacaacacaaaucacuuugaaguugcugguacuacaguuaaaucagggugguucaagaguacuacauauauaacacuugaucaaacaugcgagcaucuuaaaguaucauguggaccuaaaucaauacaauuccaugcuugcuuuaaucagcacaugucaugugugcgauuccugcauaggacaauacuuccagguucaauagcaaauucuauaugucagaacauagaaauaauuauccuggugacucugucuuuagcgauuuuuauauuuuuaacaauaguuaguaagacauauguauguuacuuauuaaugccuauauuuauuccaauagcauauauuuacggauggauauauaacaaaucuuguaaaaaauguaaguuauguggguuaguuuaccacccauuuacugagugugggacacauuguguuuguggugcaagguaugaaacgucugauaggaugaaauugcauagagcaucuggauuguguccaggguauaagagccucagagcagccagaguuauguguaagucaagggggccagcaucaguuuuauccaucaugacagcaauucuuauacuaacauuuguuacuccuauuagugcuauggucauuggugaaucaagugaaguguacacacuagaugaauugccugaugauaugguacaaauggcagaaagaguaaauauauacuaccagaucauuauuauuaauuacagcauaacaugggcuuucuuauuauuuggcuuaguucuagcauauuucuuuaagaaauaucaacauagguucuugagcuuuuaugcaauguauuguaaagaaugugacauguaccaugagagagcagguuugacauauuggggugacuucacaaacaaaugcaggcaauguacaugugggcaauuugaggauguuacuggguuaauggugcauaagaaaucuuauaauuguauaauuaaauacaaagcaaaauggauaagagacauacuaaucacauaucugauuaucauguuaaucaaagauucacuauuguuuguuggugcaacagggaccgauuuugcugcaugcauagaugagaagacagucacauggaauuguacuggaccauuucuaaacuuaggcaggugcgauaaaucccaaaagaagauugguuaugcugauauugcugaucaguugaaaggucugggugcaauaucagugcuagacauuccaaugauaaaaaggaugccggaugagauaucugggucacugaaguauauugaugguuuagagacauaccaugaacaacugacugccgaauaugccuuccuuacuagauacugugauuauuauacacaguacacugacaauucagguuacagucaaacuguguggaggacuuauuugcgaucucaugauuuuggugcaugugucguuuauccaaaucaacauuucugcagauguguaaaacauggugauaaguguaauagugcuaagugggauuuugcaaaugaaaugaagacauuuuauacuggucaaaaagcaaaauucaacaaagaucuaaacuuggcauuauuaguauuacacaaagcauucagaggaacugguacuucauauauugcagaaaguauggcccggaaagauaacaggucuaugacacauuuugccuuagagauaaagaaaaaguuuccaacaaaugcacuauugacagcauuaauagauuacauuucuuauuuacaaucacuugcagagaugucuacuuuugaacuugaugaggauugggaagauuucaaguacaaaccugaaccaacagaagcaccucaacuuagaucacauagaacugaucaguauaauuucaaaaaugcagauaguaauagcaauguuaaagucugcaaaaacauucaaaaagugucaugcauuucaccuagauccagggcuaaguuugaaaauauaauagcaugcggagaacaugcgaacccaucaguauauaugaugcccaaugucaguauuuaucaaucuaauucagagaggagucacuacuguauagcugacucacauuguuuagaagaguaugaaguaguagagucagaacucuuaaaugcauugaaaaaaucuaaauguugggcuaaagaaauggaugauauuguucugcauaaacaagcugauggcuuaaggaguuguagaaugaaagauacugggaauuguaauguucaagaaaaugacuggacuauuguucugugugagaauggcaauuauuauuauucagaagcucacagagacuaugauaaagaucaagauguuggccauuuuugucucagcccucgguguaguacaauacgcuacccaauaaauaaaagacacauuagaaauugugauuggcagaucucacauucaacaauugacaaaaucucaguucaagaauuggcugauauagagcaauacaaaaaggcuauaucacaaaaguuacaaacaagccuaucaaucuucaaguaugugaagacaaaaaaucuuccacauauuaaaccagcauauaaauacauaacuguggaagguguugaaacuguugaagggauagaaaaugcuuuuauagaaucugaaaucccugcacuagcuggaacagcuauugguuuuaaaauaaacucgagggagggcaacuaccuaauggauguaauaggcuaugucaaaagugcaucauauucagcaacauacacaaagcuauauacaacugguccaacuauaggaguaaauacuaagcaugaugaaaaguguacaggaccuugcccaccuauaauagaucauaaagaaggcugguuaaccuuugcaaaagaaagaacuagcacaugggguugugaagaauuugguuguuuagcaguuagugauggcuguguauuuggaucuugucaagauaucauaaaagaugaguuaguugucuauaggaaaacuacugaagagcucacuacaguagaauuaugccuaacauucucagauaaaacauauugcacuaaucugaaugccauaacuccuauaauaacagauaaguuugaaguucaauucaaaacuguugaaucguacacauugccaagaauaauagcuauuaaaaaucaugaaauuaagguugggcagaucaaugaucuagguguguacuccaaaggaugugggaauguucaaaaaauaaaugggacaaauuauggcaauggauggccgaaauuugauuacuuaugccauuuggcaaguaggaaagaaguuaucauaagaaaauguuuugauaaugauuacaaagcuugcaaauuucugcaaaguccuccaagcuaucgcuuagaggagcaucaaggcacaguaacagucauagauuauaaaaagauucuaggcacuauaaagaugaaagcuauauuaggagauguaaaauacaaaaauuaucagagcaauauugaaaucaaugcugaaggaacaugugcuggauguauaaauuguuuugaaaacauucacugugaauuuacuauacauaccacaguagaagcaaguugcccuauagugacagacuguguuucauuccaugauagaauacugaucacaccagacgagcauaaauaugcauuaaaaguuguaugucaggaaaagccuaaauugucucuaaaauuuaagaucuguaacacaaauauugaugcgucuaugacuauaguggauuccaagccaauccuagagcuugcaccaguugaccaaacuacauacauuagagagaaagacgaaagaugcaaaacguggaugugcaggguucgagaugaaggauuccaaguaauauuggaaccuuuuaaaaaccuuuuuggcucuuacauugggauauuuuauacagguauauuauguauuauaugccuccuuauuauuauuuacaucauauugccuauuuguuucaaguugagggacacucuaaggcaacaugaagaugcauacaagaaggagaugaaaauaagauaa

SEQ ID NO: 4209 - RNA, 4332 nt, Artificial Sequence
  derived and/or modified CDS sequence (wt) from INKV(Lovanger)__KX554936.1__GP
auggaaguccuaaacuuaaucugguugcugacauuaugcucggcuaguccaguguuucagcgguguuuccaagauggggcuauagugaagcaaaacccaucaaaggaggcagugacagaaguuugccuaaaagaugaugugagcaugauaaagacagaagcaaaauacaucaaaaaugcgacagggacauuugccaacaacauagcaaugagaaaaugguugguugcagauuggcaugauuguaggccccaaaaaucaucagguggucauauuaauguuauugaaguuggcgaugacuugucacuucauacagaaucauauauuugcagugcugacugugucauaacggucgacaaggagacagcucaaauucgcuugcaaacugacaacacaaaucacuuugaaguugcugguacuacaguuaaaucagggugguucaagaguacuacauauauuacacuugaucaaacaugcgagcaucuuaaaguaucauguggaccuaaaucaauacaauuccaugcuugcuuuaaucagcacaugucaugugugcgauuccugcauaggacaauacuuccagguucaauagcaaauucuauaugucagaacauagaaauaauuauccuggugacucugucuuuagcgauuuuuauauuuuuaacaauaguuaguaagacauauguauguuacuuauuaaugccuauauuuauuccaauagcauauauuuauggauggauauauaacaaaucuuguaaaaaauguaaguuauguggguuaguuuaccacccauuuacugagugugggacacauuguguuuguggugcaagguaugaaacgucugauaggaugaaauugcauagagcaucuggauuguguccaggguauaagagccucagagcagccagaguuauguguaagucaagggggccagcaucaguuuuauccaucaugacagcaauucuuauacuaacauuuguuacuccuauuagugcuauggucauuggugaaucaagugaaguguacacacuagaugaauugccugaugauaugguacaaauggcagaaagaguaaauauauacuaccagaucauuauuauuaauuacggcauaacaugggcuuucuuauuauuuggcuuaguucuagcauauuucuuuaagaaauaucaacauagguucuugagcuuuuaugcaauguauuguaaagaaugugacauguaccaugagagagcagguuugacauauuggggugacuucacaaacaaaugcaggcaauguacaugugggcaauuugaggauguuacuggguuaauggugcauaagaaaucuuauaauuguauaauuaaauacaaagcaaaguggauaagagacauacuaaucacauaucuaauuaucauguuaaucaaagauucacuauuguuuguuggugcaacagggaccgauuuugcugcaugcauagaugagaaaacagucacauggaauuguacuggaccauuucuaaacuuaggcaggugcgauaaaucccaaaagaagauugguuaugcugauauugcugaucaguugaaaggucugggugcaauaucagugcuagauauuccaaugauaaaaaggauaccggaugagauaucugggucacugaaguauauugaugguuuagagacauaccaugaacaacugacugccgaauaugccuuccuuacuagauacugugauuauuauacacaguacacugacaauucagguuacagucaaacuguguggaggacuuauuugcgaucucaugauuuuggugcaugugucguuuauccaaaucaacauuucugcagauguguaaaacauggugauaaguguaauagugcuaagugggauuuugcaaaugaaaugaagacauuuuauacuggucaaaaagccaaauucaacaaagaucuaaacuuggcauuauuaguauuacacaaagcauucagaggaacugguacuucauauauugcagaaaguauggcccggaaagauaacaggucuaugacacauuuugccuuagagauaaagaaaaaguuuccaacaaaugcacuauugacagcauuaauagauuacauuucuuauuuacaaucacuugcagagaugucuacuuuugaacuugaugaggauugggaagauuucaaguacaaaccugaaccaacagaagcaccucaacuuagaucacauagaacugaucaguauaauuuaaaaaaugcagauaguaauagcaauguuaaagucugcaaaaacauucaaaaagugucaugcauuucaccuagauccagggcuaaguuugaaaauauaauagcaugcggagaacaugcgaacccaucaguauauaugaugcccaaugucaguauuuaucaaucuaauucagagaggagucacuacuguauagcugacucacauuguuuagaagaguaugaaguaguggagucagaacucuuaaaugcauugaaaaaaucuaaaugcugggcuaaagaaauggaugauauuguucugcauaaacaagcugauggcuuaaggaguuguagaaugaaagauacugggaauuguaauguucaagaaaaugacuggacuauuguucugugugagaauggcaauuauuauuauucagaagcucacagagacuaugauaaagaucaagauguuggccauuuuugucucagcccucgguguaguacaauacgcuacccaauaaauaaaagacauauuagaaauugugauuggcagaucucacauucaacaauugacaaaaucucaguucaagaauuggcugauauagagcaauacaaaaaggcuauaucacaaaaguuacaaacaagccuaucaaucuucaaguaugugaagacaaaaaaucuuccacauauuaaaccagcauauaaauacauaacuguggaagguguugaaacuguugaagggauagaaaaugcuuucauagaaucugaaaucccugcacuagcuggaacagcuauugguuuuaaaauaaacucgagggagggcaacuaccuaauggauguaauaggcuaugucaaaagugcaucauauucagcaacauacacaaagcuauauacaacugguccaacuauaggaguaaauacuaagcaugaugaaaaguguacaggaccuugcccaccuauaauagaucauaaagaaggcugguuaaccuuugcaaaagaaagaacuagcacaugggguugugaagaauuugguuguuuagcaguuagugauggcuguguauuuggaucuugucaagauaucauaaaagaugaguuagcugucuauaggaaaacuacugaagagcucacuacaguagaauuaugccuaacauucucagauaaaacauauugcacuaaucugaaugcuauaacuccuauaauaacagauaaguuugaaguucaauucaaaacuguugaaucguacacauugccaagaauaauagcuauuaaaaaucaugaaauuaaaguugggcagaucaaugaucuagguguguacuccaaaggaugugggaauguucaaaaaauaaaugggacaaauuauggcaauggauugccgaaauuugauuacuuaugccauuuggcaaguaggaaagaaguuaucauaagaaaauguuuugauaaugauuaccaagcuugcaaauuucugcaaaguccuccaagcuaucgcuuagaggagcaucaaggcacaguaacagucauagauuauaaaaagauucuaggcacuauaaagaugaaagcuauauuaggagauguaaaauacaaaaauuaucagagcaauauugaaaucaaugcugaaggaacaugugcuggauguauaaauuguuuugaaaauauucacugugaauuuacuauacauaccacaguagaagcaaguugcccuauagugacagacuguguuucauuccaugauagaauacugaucacaccagacgagcauaaauaugcauuaaaaguuguaugucaggaaaagccuaaauugucucuaaaauuuaagaucuguaacacaaauauugaugcgucuaugacuauaguggauuccaagccaauccuagagcuugcaccaguugaccaaacuacauacauuagagagaaagacgaaagaugcaaaacguggaugugcaggguucgagaugaaggauuccaaguaauauuggaacccuuuaaaaaccuuuuuggcucuuacauugggauauuuuauacagguauauuauguauuauaugccuccuuauuguuauuuacaucauauugccuauuuguuucaaguugagggacacucuaaggcaacaugaagaugcauacaagaaggagaugaaaauaagauaa

SEQ ID NO: 4210 - RNA, 4335 nt, Artificial Sequence
  derived and/or modified CDS sequence (wt) from JSV__AF123487.1__GP
auggaaguccuaaacuuaaucugguuacuagcauuguguucagcuaguccaguauuucaacgauguuuucaagauggagcuauagugaagcaaaacccaucuaaggaagcagugacagaggugugcuuaaaggaugacgugagcaugauaaaaacagaagcaaaauauguaaaaaacaccacagggacauuugcuaauaacauagcuaugagaaaaugguuggucgcagauuggcaugacuguaggccccaaaagucaucagguggucauaucaacguuauugaaguuggagaugaucugucacuccacacagagucauauauuugcagugcagauuguguuaucacaguugacaaagaaacugcucagauccguuugcaaacugacaauacaaaccacuuugagguugcugggaccacaguaaaaucagguugguucaaaaguacaacuuauauuacacuugaucaaacaugugagcaucuuaaaguaucaugcggaccaaaaucgauacaguuucaugcuugcuucaaucagcauaugucuugugugcgauucuuacauagaacaauacuaccaggaucgauugcuaauucuauaugucaaaauauagaaauaauuaucuugguuacucucucauuaguaaucuucauauucuuaucaauaguaaguaagacauauguauguuacuuauuaaugccuaucuucaucccaauagcuuuuaucuauggauggauauacaauaaauccugcaagaaaugcaaauuaugcggcuuaguuuaucacccauucacagaguguggaacacacuguguauguggugcaagauaugaaacuucugauaggaugaaauugcauagagcaucuggauuguguccaggguacaagagucucagagcagcuagaguuaugugcaaaucaaaaggaccagcuucuauccuaucuauaaugacugcaauucucauacuaacauuugucacuccuauuagugccaugguuauaggugaaucaagugagguguacacacuagaugauuuacccgaugauaugguacaaauggcagagagggugaauaucuauuaucaaauaaucaucauuaauuauggugucacuugggcuuucuuauugcuugguuuaauuuuggcauacuucuucaaaaaauaucaacauaaauuucuagacuuuuaugcaauguauugugaggaaugcgauauguaucacgagaaaucugguuugacacacuggggcgacuuuacuaauaaauguagacagugcacaugcggucaguuugaagauguugcuggcuugaugauacauagaaaaucuuacaauuguuugguuaaauacaaagcaagauggauaagggacauacucaucauguauuuggcuaugauucugaucaaagauucacuauuauucguuggugcaucagggacagacuuugcugcauguauagaugagaaagucguuacauggaacugcacugggccauuccuaaauuuagguagaugcgacaaaucucagaagaaaacaaacuaugaagguauagcuaaucaguugaagggcuuaggaguuauaucuguuuuggauaucccgaugauaaaaaauaugccagaugaaauaucagguucacuaaaguauaucgauagccuagagacauaccaugagcaauuaacugcugaauaugcuuuccucaccagguacugcgacuauuauacacaauacacggauaacucuggcuauagucgaacaguauggaggacuuacuuacgaucucacgauuuuggugcaugugucguuuauccgaaucaccauuuauguagauguguaaaguauggggacaaaugcaauagugccaagugggauuuugccaaugagaugaaaacauucuacacaggccagaaagugaaguuuaauaaggauuuaaacuuggcauuauugguauuacauaaagcauuuagaggcacuggaacugcauaugucgcggaagcuauggcucggaaagauaacgguucuauggcacauuuugcuuuggagauaagaaaaaaguucccaacaaaugcuuuguuagcagcauuaauagauuauauaguuuauuuacagucccuugcagaaauagccacauuugaacucgaugaagauugggaagauuuuaaauauaagccagagccaacagaaucaacaccucaagcuaggucacacagaaaugaucaguauaacuucaaaaaugcugaaaguaauaguaauaccaaagucuguaagaauguucagaaaguacuauguauuucacccaggucaaaagcaaaauucgaaaauauuauagcauguggagagcaugcaaauccaucuguauacaugaugccaaaugucaguaucuaccaauccaauucggaaaggagucacuauuguauagcugacucucauugccuugagaaauaugaagugguggaaacagaacuuuugaaugcuuuaaagaagucaaaauguugggccaaggaaauggaugauauugucuuacauaagcagagugauggcuugaggaguuguagaauaaaagauacugggaacugcaauguucaagaaaaugauuggaccauugucuuaugugaaaauggcaacuauuacuacucugagguccacaaagacuaugauaaagaucaggauguaggucauuucugucuuaguccuagaugcacuacaauacguuauccaauaaguagaaggcauauaaggaagugcgaauggcaaauaucacauucaacaauugauaaaaucucuguucaagaguuagcagacauagagcaauauaagaaggccauaucacaaaaauugcaaacaagucuaucaauuuucaaguauguaagaacaaaaaaccucccacauaucaaacccgcauauaaguacauaacuguagaaggugucgaaacuauugaaggaaucgaaaacgccuuuauagagucugagauuccagcauuggcagguacagcuauagguuucaaaauaaauucaagagaaggcaacuauuuaauggaugugauaggauauguuaagagugcaucauauucagcaguauacacaaaacuauauacaacugggccuacuauaggaauaaacaccaaacaugaugaaaaaugcacaggaccuugcccagcuguaauagaucauaaggaugguuggcuaaccuucucaaaagagaggaccagcacuugggguugugaagaguucgguugcuuagcagucagugaugguuguguauuuggcucuugccaagauauaauaaaagaugaguuggcuguuuacaggaaaaccacugaagaacucacuacaguagaacugugcuugacauuuucagauaaaacauauugcaccaacuugaaugcuauaacuccuauuauaacagauaaauuugaagugcaguucaaaacuguugaaucuuauacacuaccaagggucauugccauaaagaaucaugagauuaaaguuggacaaaucaaugacuuaggugucuacucaaaaggauguggaaauguucaaaaggucaauggaacaaacuauggcaaugguucaccaagguuugauuaucucugccacuuggcgaguagaaaggaaguaauccuaaggaaauguuuugacaaugauuaucaggcuuguaaauucuugcagaguccuucaaguuaucguuuagaagagcaccaggggacagugacaguuauagauuauaaaaagauuuuaggcacuauaaagaugaaggcuauauuaggggaugugauauacauaaauuaucaaaauaauauagaaaucaaugcugagggaacaugugcuggauguauugauugcuuugaaaauauacacugugaauuuacuauacauacuacaguugaagcaaguuguccuauaacaacagagugugucucauuucaugauagaauauugaucacaccagaugaacauaaguaugcauugaagauuguaugccaugauaaaccaaaagugucucuuaaauuuaaaaucuguaacacaaauguugaugcagcuaugacuauuguggauucuaaaccaauuuuagaacuugcgccaguagaucaaacaacauauaucagagagaaagaugaaagaugcaagacuuggauguguagaguccgagaugaaggguuccaggugauauuagaaccuuuuaaaaaccucuuugguucguauauugggauauuuuauacugguauacugucuauuauuuguuuacucauugucgucuauauuauauugcccauuuguuucaaauuaagggacacuuuaaggcagcaugaagaugccuauagaaaggaaaugaagauaagauga

SEQ ID NO: 4211 - RNA, 4335 nt, Artificial Sequence
  derived and/or modified CDS sequence (wt) from JSV(BFS 4474)__KX817319.1__GP
auggaaguccuaaacuuaaucugguuacuagcauuguguucagcuaguccaguauuucaacgauguuuucaagauggagcuauagugaagcaaaacccaucuaaggaagcagugacagaggugugcuuaaaggaugacgugagcaugauaaaaacagaagcaaaauauguaaaaaacaccacagggacauuugcuaauaacauagcuaugagaaaaugguuggucgcagauuggcaugacuguaggccccaaaagucaucagguggucauaucaacguuauugaaguuggagaugaucugucacuccacacagagucauauauuugcagugcagauuguguuaucacaguugacaaagaaacugcucagauccguuugcaaacugacaauacaaaccacuuugagguugcugggaccacaguaaaaucagguugguucaaaaguacaacuuauauuacacuugaucaaacaugugagcaucuuaaaguaucaugcggaccaaaaucgauacaguuucaugcuugcuucaaucagcauaugucuugugugcgauucuuacauagaacaauacuaccaggaucgauugcuaauucuauaugucaaaauauagaaauaauuaucuugguuacucucucauuaguaaucuucauauucuuaucaauaguaaguaagacauauguauguuacuuauuaaugccuaucuucaucccaauagcuuuuaucuauggauggauauacaauaaauccugcaagaaaugcaaauuaugcggcuuaguuuaucacccauucacagaguguggaacacacuguguauguggugcaagauaugaaacuucugauaggaugaaauugcauagagcaucuggauuguguccaggguacaagagucucagagcagcuagaguuaugugcaaaucaaaaggaccagcuucuauccuaucuauaaugacugcaauucucauacuaacauuugucacuccuauuagugccaugguuauaggugaaucaagugagguguacacacuagaugauuuacccgaugauaugguacaaauggcagagagggugaauaucuauuaucaaauaaucaucauuaauuauggugucacuugggcuuucuuauugcuugguuuaauuuuggcauacuucuucaaaaaauaucaacauaaauuucuagacuuuuaugcaauguauugugaggaaugcgauauguaucacgagaaaucugguuugacacacuggggcgacuuuacuaauaaauguagacagugcacaugcggucaguuugaagauguugcuggcuugaugauacauagaaaaucuuacaauuguuugguuaaauacaaagcaagauggauaagggacauacucaucauguauuuggcuaugauucugaucaaagauucacuauuauucguuggugcaucagggacagacuuugcugcauguauagaugagaaagucguuacauggaacugcacugggccauuccuaaauuuagguagaugcgacaaaucucagaagaaaacaaacuaugaagguauagcuaaucaguugaagggcuuaggaguuauaucuguuuuggauaucccgaugauaaaaaauaugccagaugaaauaucagguucacuaaaguauaucgauagccuagagacauaccaugagcaauuaacugcugaauaugcuuuccucaccagguacugcgacuauuauacacaauacacggauaacucuggcuauaguaaaacaguauggaggacuuacuuacgaucucacgauuuuggugcaugugucguuuauccgaaucaacauuuuuguagauguguaaaguauggggacaaaugcaauagugccaagugggauuuugccaaugagaugaaaacauucuacacaggccagaaagugaaguuuaauaaggauuuaaacuuggcauuauugguauuacauaaagcauuuagaggcacuggaacugcauaugucgcggaagcuauggcucggaaagauaacgguucuauggcacauuuugcuuuggagauaagaaaaaaguucccaacaaaugcuuuguuagcagcauuaauagauuauauaguuuauuuacagucccuugcagaaauagccacauuugaacucgaugaagauugggaagauuuuaaauauaagccagagccaacagaaucaacaccucaagcuaggucacacagaaaugaucaguauaacuucaaaaaugcugaaaguaauaguaauaccaaagucuguaagaauguucagaaaguacuauguauuucacccaggucaaaagcaaaauucgaaaauauuauagcauguggagagcaugcaaauccaucuguauacaugaugccaaaugucaguaucuaccaauccaauucggaaaggagucacuauuguauagcugacucucauugccuugagaaauaugaagugguggaaacagaacuuuugaaugcuuuaaagaagucaaaauguugggccaaggaaauggaugauauugucuuacauaagcagagugauggcuugaggaguuguagaauaaaagauacugggaacugcaauguucaagaaaaugauuggaccauugucuuaugugaaaauggcaacuauuacuacucugagguccacaaagacuaugauaaagaucaggauguaggucauuucugucuuaguccuagaugcacuacaauacguuauccaauaaguagaaggcauauaaggaagugcgaauggcaaauaucacauucaacaauugauaaaaucucuguucaagaguuagcagacauagagcaauauaagaaggccauaucacaaaaauugcaaacaagucuaucaauuuucaaguauguaagaacaaaaaaccucccacauaucaaacccgcauauaaguacauaacuguagaaggugucgaaacuauugaaggaaucgaaaacgccuuuauagagucugagauuccagcauuggcagguacagcuauagguuucaaaauaaauucaagagaaggcaacuauuuaauggaugugauaggauauguuaagagugcaucauauucagcaguauacacaaaacuauauacaacugggccuacuauaggaauaaacaccaaacaugaugaaaaaugcacaggaccuugcccagcuguaauagaucauaaggaugguuggcuaaccuucucaaaagagaggaccagcacuugggguugugaagaguucgguugcuuagcagucagugaugguuguguauuuggcucuugccaagauauaauaaaagaugaguuggcuguuuacaggaaaaccacugaagaacucacuacaguagaacugugcuugacauuuucagauaaaacauauugcaccaacuugaaugcuauaacuccuauuauaacagauaaauuugaagugcaguucaaaacuguugaaucuuauacacuaccaagggucauugccauaaagaaucaugagauuaaaguuggacaaaucaaugacuuaggugucuacucaaaaggauguggaaauguucaaaaggucaauggaacaaacuauggcaaugguucaccaagguuugauuaucucugccacuuggcgaguagaaaggaaguaauccuaaggaaauguuuugacaaugauuaucaggcuuguaaauucuugcagaguccuucaaguuaucguuuagaagagcaccaggggacagugacaguuauagauuauaaaaagauuuuaggcacuauaaagaugaaggcuauauuaggggaugugaaauacaaaaauuaucaaaauaauauagaaaucaaugcugagggaacaugugcuggauguauugauugcuuugaaaauauacacugugaauuuacuauacauacuacaguugaagcaaguuguccuauaacaacagagugugucucauuucaugauagaauauugaucacaccagaugaacauaaguaugcauugaagauuguaugccaugauaaaccaaaagugucucuuaaauuuaaaaucuguaacacaaauguugaugcagcuaugacuauuguggauucuaaaccaauuuuagaacuugcgccaguagaucaaacaacauauaucagagagaaagaugaaagaugcaagacuuggauguguagaguccgagaugaaggguuccaggugauauuagaaccuuuuaaaaaccucuuugguucguauauugggauauuuuauacugguauacugucuauuauuuguuuacucauugucgucuauauuauauugcccauuuguuucaaauuaagggacacuuuaaggcagcaugaagaugccuauagaaaggaaaugaagauaagauga

SEQ ID NO: 4212 - RNA, 4323 nt, Artificial Sequence
  derived and/or modified CDS sequence (wt) from LUMV__AF123484.1__GP
augauacuuguuuuguuuuucguugcacuaagugcugcagggccaguuuaucagagauguuuccaagauggugcuauugucaaacagagcccauccaaacaagcugugacagaaguaugcuuaaaggaugaugucagcaugauaaaaacagaggcaagauacuucaagaauaccaccgggauuuaugcuaauaacguugcaauuagaaaguggcuuguugcagacuggcaugauuguagaccaaaaaaagucucaggggggcauauaaauguuauagaggugggagaugaccuaacacugcauacagaggcuuauguuugcaaugcugauugcauaauagguguagacaaagagacugcacaaguaagauugcaaacugauacaacaaaucacuuugaaauugcaggaacuacagucaaaucagggugguuuaagagcacuacuuauauaaccuuaggucaaacuugcgaacauuugaaagucuccuguggaccuaaaucuauccaauuccaugcauguuucaaucagcauaugucuuguguuagauuucuacauagaacaauauugccaggaucuauugcuaauucuguaugccagaauauagaaauaauaauuuuaacaguacuaaccuuacuuaucuuuacauuacuaaguauauuaagcaaaacauauauaugcuauauacucaugccuauauucaucccccucgcuuauauauauggauuaauauauaauaaauccugcaaaaaguguaagcuauguggccuaguauaccaucccuuuacagaguguggcacucauuguguaugcggugcaagauaugauacaucugauaggaugaaacugcacagagcuucaggacuaugcccaggguauaagagucuuagagcugcaagagucauguguaaauccaaaggcccagcuucuguuuuauccauuauaacugcgguauuaauccuaacauuuaucaccccuauaaaugcuaugauagcuggagagacgcaagagacuuuuaaacuagaagauuugccagaugauauguuaaguauggcaaugaagauaaacauguacuacauuauguguauguuaaauuauguugccacauggucauucauuuucugugccuuaauaauagccuuaauuuucaaaaaauaucaacauaaguuucuaagcuauuacgcuauguacugucaagaaugugacauguaucaugacaggucaggucuaaaauauaacggggguuucacaaauaaauguaggcaaugcacauguggacaauaugaggaugcuacaggcuugauggcucauaggaaaacauauaacuguuuaauucaauauaaaucaaaaugguuaguuaacuucuuaauuacauauauaauucucaugcucaucaaagauucuguauugauagugcaugcugagggcacagacuuugaaaaguguagcagcgauauaaauauuguguggaauuguacagggccauuucuuagcuuaggcaauugcgaaaagaagcagaaaaaggagucauacaaugauauagcggcccaguuaaaaggucuagaugcaauaucugucuuggacaucccuaugauuucgaagauaccugaagauauagcuggggcauugagauucauagaggaacagaauucguaccauguucagcugacuguugaguaugcuauguugacuagauauugugauuauuauacacaauuuagugacaacucugguuauagucagacaacauggagaacauacuugaggucacaugauuuugaggcauguauauuauauccaaaucagcauuuuuguagaugugugaaacacggagacaaaugcucaagauccaacugggauuuugcuaaugagaugaagaauuauuauagugguaagcagucgaaguauaauaaagaucuaaauuuagcauuaaugucauuccaccaugcauuuagagggacaucuagcuucuauacugcaaaacuuuuaagagaaaagaaaacugaagaacuuaaaaacuacauugacaaaauuagaacugaguacccugguaaugcauuauuaaaggcuguaauugacuacauaaaauauaugauggguuugacugaaguaaguaacuucaaacaugacgaaaugugggaugacuuuauuuuugaaaauccuucaacaagaaguucauugucaaggaauucagagucaucguaugauuuuaaaacuaauauaaauucagauccaacaaauacauguaaaaacauuaaggcuguuacauguuuaucaccgaaaucaggaguaucauuugauucagugauugcuuguggcgaaucaaaucaaccaaguaucuaccaaaaaccaaggaaacaaguauaccagucuaauucugagcaaacgcauuuuugucuucuagacacacauugcuuggaaggcuaugagacagugggagaagaaguccuuagugcaaucaaaaaaucaaaaugcugggagacagacuuuacagaauauauccaauucaaacaaagcgaugguguaagaaguuguaggaugaaagauucaggggaaugcacaguaacuacuaauaaguggcccauaauacuuugugaaaacaacagauauuauuauucugagcuacauaaagauuacgauaaagaucaagauauaggccauuuuugccucaguccuagaugcaacaccauuagauauccuauaaaucaaaaucacaucucuaauuguacauggcaaguuaggcacaacaauauagauaaaauugagguacaugaauuagaagaucuagagcaauauaggaaagcuauuacgcaaaaacugcaaacaagcuuaacacuguuuaaguacucuagaacaaagaacuuaccccauaucaaaccuauuuacaaguauauaacuauagaaggaacagagacugcugaaggaaucgaaagugcuuauauagaaucagaaauuccugcucuggcaggaacaucgauaggauucaaaauaacaucuaaaucugggaaacauuuacuagauguuauuaguuaugucaaaagcgcgucuuauucagcugucuauacaaaacucuauacaacagggccuacuauaggaguaaauacgaaacacgaugaacugugcacaggaucaugcccugucaauguaccucauaauacaggcuggcucacauuugcuagagaaagaacaagcucauggggaugugaagaguuuggcugcuuagcaauuagugauggguguguuuuugguucuugccaagacaucauaaaggacgagcugacugucuauagggaagaaacugaggaaaccacaaauguggagcugugucugaccuuugcagauaaaacguauugcacuaaucucaaugccauaacucccauaauaacugaucaauuugaaguccaauuuaaaacaguagaagcauauagcuugccuagaauuauugcaguacggaaucaugaaaucaugguaggacaaauaaaugauauagguguuuauucaaaaggcugugggaauguacaaaaaauaaauaauacgaauuaugggaauggugugccuaaauuugacuacuuaugccauuuagcuaguaggaaggaaguaaucauuaggaaaugcuuugacaacgauuaucaagcuuguaaguucuuacagacgccugcaagcuauaggcuagaagaggaaggaggcucaguaacagucauagauuacaaaaagauccuuggcacuauaaaaaugaaggcuaucuuaggagaugucaaauacaaaacauuugcugacaauguagauauaacaguagagggugcuugcacaggauguaucaauugcuuugacaauauacacugugaguugacaauacauaguacuguagaagcuagcugcccaauaacaagcucguguacaguauuccacgauagaauauuaauaacaccgaaugagcacaaauaugcuauaaaagugauaugcaauggaaagcccgggauaucgcuaccauucaaaauuugcaacacaaaagucgaugcugccaugacuuuaacagaugcaaagcagauauuagaacuagcuccuguagaucaaacaacauauauuaaagagaaagaugaaaggugcaaaacuuggaugugcaggguuagggaugaaggccuucaaguuauauuugaaccauuuaaaaaccuauuugggucuuauauaggaauauuuuauacauuugugauauuuuuagucguaauauuuauaguuauauauauaguguuacccauauguuucaaacuuagggauacauuaagacagcaugaggaugcuuauaagagggaaaugaaaauuagauag

SEQ ID NO: 4213 - RNA, 4323 nt, Artificial Sequence
  derived and/or modified CDS sequence (wt) from LUMV(SAAr 1881)__KX817325.1__GP
augauacuuguuuuguuuuucguugcacuaagugcugcagggccaguuuaucagagauguuuccaagauggugcuauugucaaacagagcccauccaaacaagcugugacagaaguaugcuuaaaggaugaugucagcaugauaaaaacagaggcaagauacuucaagaauaccaccgggauuuaugcuaauaacguugcaauuagaaaguggcuuguugcagacuggcaugauuguagaccaaaaaaagucucagggggccauauaaauguuauagaggugggagaugaccuaacacugcauacagaggcuuauguuugcaaugcugauugcauaauagguguagacaaagagacugcacaaguaagauugcaaacugauacaacaaaucacuuugaaauugcaggaacuacagucaaaucagggugguuuaagagcacuacuuauauaaccuuagaucaaacuugcgaacauuugaaagucuccuguggaccuaaaucuauccaauuccaugcauguuucaaucagcauaugucuuguguuagauuucuacauagaacaauauugccaggaucuauugcuaauucuguaugccagaauauagaaauaauaauuuuaacaguacuaaccuuacuuaucuuuacauuacuaaguauauuaagcaaaacauauauaugcuauauacucaugccuauauucaucccccucgcuuauauauauggauuaauauauaauaaauccugcaaaaaguguaagcuauguggccuaguauaccaucccuuuacagaguguggcacucauuguguaugcggugcaagauaugauacaucugauaggaugaaacugcacagagcuucaggacuaugcccaggguauaagagucuuagagcugcaagagucauguguaaauccaaaggcccagcuucuguuuuauccauuauaacugcgguauuaauccuaacauuuaucaccccuauaaaugcuaugauagcuggagagacgcaagagacuuuuaaacuagaagauuugccagaugauauguuaaguauggcaaugaagauaaacauguacuacauuauguguauguuaaauuauguugccacauggucauucauuuucugugccuuaauaauagccuuaauuuucaaaaaauaucaacauaaguuucuaagcuauuacgcuauguacugucaagaaugugacauguaucaugacaggucaggucuaaaauauaacggggguuucacaaauaaauguaggcaaugcacauguggacaauaugaggaugcuacaggcuugauggcucauaggaaaacauauaacuguuuaauucaauauaaaucaaaaugguuaguuaacuucuuaauuacauauauaauucucaugcucaucaaagauucuguauugauagugcaugcugagggcacagacuuugaaaaguguagcagcgauauaaauauuguguggaauuguacagggccauuucuuagcuuaggcaauugcgaaaagaagcagaaaaaggagucauacaaugauauagcggcccaguuaaaaggucuagaugcaauaucugucuuggacaucccuaugauuucgaagauaccugaagauauagcuggggcauugagauucauagaggaacagaauucguaccauguucagcugacuguugaguaugcuauguugacuagauauugugauuauuauacacaauuuagugacaacucugguuauagucagacaacauggagaacauacuugaggucacaugauuuugaggcauguauauuauauccaaaucagcauuuuuguagaugugugaaacacggagacaaaugcucaagauccaacugggauuuugcuaaugagaugaagaauuauuauagugguaagcagucgaaguauaauaaagaucuaaauuuagcauuaaugucauuccaccaugcauuuagagggacaucuagcuucuauacugcaaaacuuuuaagagaaaagaaaacugaagaacuuaaaaacuacauugacaaaauuagaacuaaguacccugguaaugcauuauuaaaggcuguaauugacuacauaaaauauaugauggguuugacugaaguaaguaacuucaaacaugacgaaaugugggaugacuuuauuuuugaaaauccuucaacaagaaguucauugucaaggaauucagagucaucguaugauuuuaaaacuaauauaaauucagauccaacaaauacauguaaaaacauuaaggcuguuacauguuuaucaccgaaaucaggaguaucauuugauucagugauugcuuguggcgaaucaaaucaaccaaguaucuaccaaaaaccaaggaaacaaguauaccagucuaauucugagcaaacgcauuuuugucuucuagacacacauugcuuggaaggcuaugagacagugggagaagaaguccuuagugcaaucaaaaaaucaaaaugcugggagacagacuuuacagaauauauccaauucaaacaaagcgaugguguaagaaguuguaggaugaaagauucaggggaaugcacaguaacuacuaauaaguggcccauaauacuuugugaaaacaacagauauuauuauucugagcuacauaaagauuacgauaaagaucaagauauaggccauuuuugccucaguccuagaugcaacaccauuagauauccuauaaaucaaaaucacaucucuaauuguacauggcaaguuaggcacaacaauauagauaaaauugagguacaugaauuagaagaucuagagcaauauaggaaagcuauuacgcaaaaacugcaaacaagcuuaacacuguuuaaguacucuagaacaaagaacuuaccccauaucaaaccuauuuacaaguauauaacuauagaaggaacagagacugcugaaggaaucgaaagugcuuauauagaaucagaaauuccugcucuggcaggaacaucgauaggauucaaaauaacaucuaaaucugggaaacauuuacuagauguuauuaguuaugucaaaagcgcgucuuauucagcugucuauacaaaacucuauacaacagggccuacuauaggaguaaauacgaaacacgaugaacugugcacaggaucaugcccugucaauguaccucauaauacaggcuggcucacauuugcuagagaaagaacaaguucauggggaugugaagaguuuggcugcuuagcaauuagugauggguguguuuuugguucuugccaagacaucauaaaggacgagcugacugucuauaggaaagaaacugaggaaaccacaaauguggagcugugucugaccuuugcagauaaaacguauugcacuaaucucaaugccauaacucccauaauaacugaucaauuugaaguccaauuuaaaacaguagaagcauauagcuugccuagaauuauugcaguacggaaucaugaaaucaugguaggacaaauaaaugauauagguguuuauucaaaaggcugugggaauguacaaaaaauaaauaauacgaauuaugggaauggugugccuaaauuugacuacuuaugccauuuagcuaguaggaaggaaguaaucauuaggaaaugcuuugacaacgauuaucaagcuuguaaguucuuacagacgccugcaagcuauaggcuagaagaggaaggaggcucaguaacagucauagauuacaaaaagauccuuggcacuauaaaaaugaaggcuaucuuaggagaugucaaauacaaaacauuugcugacaauguagauauaacaguagagggugcuugcacaggauguaucaauugcuuugacaauauacacugugaguugacaauacauaguacuguagaagcuagcugcccaauaacaagcucguguacaguauuccacgauagaauauuaauaacaccgaaugagcacaaauaugcuauaaaagugauaugcaauggaaagcccgggauaucgcuaccauucaaaauuugcaacacaaaagucgaugcugccaugacuuuaacagaugcaaagcagauauuagaacuagcuccuguagaucaaacaacauauauuaaagagaaagaugaaaggugcaaaacuuggaugugcaggguuagggaugaaggccuucaaguuauauuugaaccauuuaaaaaccuauuugggucuuauauaggaauauuuuauacauuugugauauuuuuaguuguaauauuuauaguuauauauauaguguuacccauauguuucaaacuuagggauacauuaagacagcaugaagaugcuuauaagagggaaaugaaaauuagauag

SEQ ID NO: 4214 - RNA, 4329 nt, Artificial Sequence
  derived and/or modified CDS sequence (wt) from MELV__U88057.1__GP
augauugccuuaauauuucugauugcaauugcugcugcaagcccaguauaccagagaugcuuccaggauggggguauagugaagcaaaacccauccaaagacgcaguuacagaagucugccuuaaagaugauguuagcaugauaaagaccgaagcaaaauauaugaaaaaugauacgggaacauuuucaaauaauguagcuaugagaaagugguugguugcagacuggcaugauuguaggccccaaaaaucaucuggagggcacaucaauguaauagaaguuggugaugaucucucauugcacacagaagcauacauuuguagugcugauuguaugauaaguguugauaaggaaacagcacaaauaaggcuacaaacagacagcaccacccacuuugaaauagcugggacaacuguaaaaucagguugguuuaaaagcacaacuuacauaacacuagaucaaacaugugaacaucugaaagucucauguggcccaaaguccauacaauuccaugcauguuucaaucagcauaugucuuguguaagauuccugcauagaacaauauugccagguucuauagcaaacucuauaugccaaaauauugagauaauuauccuuguaacauuaacgcuauuaaucuuuauauuucuuaguauacuuaguaagacguauaucuguuacauuuuaaugccuauguucauaccuguggcuuauauauaugguuggauuuauaacaaaucuugcaagaaauguaaguuaugugguuuaguauaucauccauuuacugaauguggaacccauuguguguguggugcuagauaugaaacaucugauagaaugaaguugcauagaucuucuggauuauguccaggguauaagaguuuaagagcugcaagaguaauguguaagucaaaaggcccagcaucgauucugucgguacuaacugcuguucucauauuaacauuuguaacaccuaugaaugcauuaacccuagguucuucagaggagaacuacaaacuggagaaucuaccagaugauauguuggacauggcugaaaggauagauauuuacuauuuaagcauuaucuuaaauuauaguauaaccuggggcuuaguaauacuccuagguuuaacuuucauccuauucagaagauuccagcauagauucuuaaauuguuaugccauguauugcagugaaugugacauguaccaugauaagaaugguuuaguaaggaauggugacuuuacaaacaaguguagacaaugcacuugugggcaguaugaagaugcagcuggauuaauaauccaucaaaaaucauauaauugucugauuaaauauaaagcaaaguggauucgaaauauacuguuaacauauaucauauuaauacugauuaaagacucuguucuacugacaucugcagaaggcccugauuuuucuguauguauagaacaaaaggcaauaucuuggaauugcacuggcccuuuccuaaaccuuggaagaugcgaaaagacucaaaaaaaagccagcuaugcuacaauugcuacacaguuaagaaguauagaugcaauaucagucuuagauaucccaaugauugcaaagauaccagaagauauaucuggggcacugaaauacauagagaguuuaaaaacuuaccaugagcaauugacggcagaauaugcuaugcugacuagauauugugauuauuacacucaauuuagugauaauucugguuauagccagacaagcuggaggaaauucuuaagaucacacgauuuugaaucuugcauaauuuacccaaaucaacacuuuuguagaugugucaaacaagaugagaaauguagcagugcuaaaugggacuuugcaagugaaaugaaaggauuuuacuugaauaaacaagccaaauuuaacaaagauuuaaauuuagccuuaucuaccuuucacaaagcuuucagagggacuccaaucucuuauguaacagaauugauaucaaagaacaaaaauagcuccuuguuaauguauguaucagaaauaaaaagaaaauucccagggaaugcacugcuaguugcauuauuagauuuuauaauguauuuacaaucauugagcgagaucucuggcuucgaacuuggggaugaaugggaagacuuuaaauaugauccagaacccacagagccagcuuugaugccaagaucgcacagguccgaucaauauaauuuuaaaaaugcugccaguguuaguaagacaaaaacuugcgaaaauauaaaaagagucuuauguuuaucucccagaucaagagcaacauuugaugauguuguagcaugcggugaguuugcaaaccccucuguauauauguuaccaaauaucacuauauaccaaucgaauauagagaggagucauuauugcauugcugauucgcauugucuagaagaauucgaauugguaaagccagagcuucuaacugcauuaaaaaagucaacauguugggcuggagaaauugaugauauaguucuacauaaacaaagugauggccugaggagcuguagaauaaaagacacaggaaccugcgauguauuaggcaaugaauggacuauaguuuuaugugaaaacaauaauuucuauuauucugaagugcauagagauuaugauaaagaucaagauauaggucauuuuugccuaaguccgcguuguaauauaauuagauacccaaucaacccuaggcauauaagaaccugcaaguggcaaauuucacauucuacaauagauaaaauuaccguacaugaguuggcagauauugaacaauauaaaaaagcuauuacgcaaaaauugcaaaacaguuuguccauauucaaauacaaaaggacaaagaauuuaccacauauaaagccaauuuauaaauacauugcaauagaagguacagaaacaguagaagguauugaaaaugcuuauauugaauccgaaauaccagcauuggcagguacugcuauagguuuuaaaaucaauucaaaggauggcaaucacuugauggauguaauaggauauguaaagagugcaucuuauucaucuacauacacaaaauuauacacaacugggccaacaauagggaucaacacgaagcaugaugaaaaaugcacugggagcuguccuacacaagucaagcauaaaaccgguugguuaacauuugcaaaagaaagaacaaguacaugggggugcgaagaguuuggauguuuggcuauuagugauggcugcguauuugggucaugucaggacauaauaaaggaugaauugaccguuuauaggaaaaccacugacgaagugacagagcuggaauugugccugacuuuugcagacaagacuuauugcacaaauuugaaugcuguuacaccuauaauaacagauaaauuugaggugcaauucaaaaccguggaaucuuacucauugccaagaauuauugcugucaaaaaccaugaaaucaagguuggacaaauuaaugauauuggagucuauucaaaaggaugugguaauguacaaaagguaaauggaacaaguuauggaaaugguguaccaaaauuugauuaucuaugccaucuagcaaguagaaaagaaguuaccauuaggaaaugcuuugacaacgauuaccaggcuuguaaauuuuuacagacaccuucaaguuauaggcuugaagaacaucagggcacaguaacaauaauagauuacaaaaaaauacuggguucuauuaaaaugaaggcaaucuuaggagaugucaaguacaaaaauuaugcuaguaauauugauaucaaugcugaagguucuugugcuggaugcauuaacuguuuugagaacauacauugugaguucacaauucauagcacaguggaaaccaguugucaaauugaaagcgacuguacaaguuuccaugacaggguguuaauaacaccaaaugaacauaaauaugcuuugaaauuaauaugccaugacaaaccugcuucuucgcuuaaauuuaaaauuuguaacacgaaagucgaggcagcuaugacuuuaguagaugcgagacccauaauagaguuagcaccuguggaucaaaccgcuuauauucgagaaaaagaugaaagaugcaaaacuuggaugugcagaguuagggaugaaggaauacagguuauuuuugagccuuucaaaaauuuauuuggcucauauauagguaucuuuuacgcuauaguaauauguauuauuguauuauuuuuaaucguuuauauagugcuaccaauuugcuucaagcucaaagacacucuaaagcaacaugaagaugcauacaaaagggaaaugaagauuagguaa

SEQ ID NO: 4215 - RNA, 4326 nt, Artificial Sequence
  derived and/or modified CDS sequence (wt) from SAV__AF123486.1__GP
augauaccuuugcuguuuuuaguuacgcuggugucugcaggcccaguguuucaacguugcuuccaagauggggcuauagugaagcaaaacccaucgaaagaggcagugacagaaguauguauaaaagaugauguaaguaugauuaaaacagaggcuagauaugucaggaauucaaguggagucuucucaaacaauguggcuuuacgaaaauggcucgugucggauuggcaugacugcaaaccaaaaaaagucaguggagggcauauuaauguuaucgagguugguaacgauuuaacuuuacacacagaaucguauguauguagugcagauugcacaauaggaauugacaaggaaacggcacaaaucagacuccaaacugauacuacaaaucacuuugaaguggcaggaacuacuguaaaaucugggugguucaaaagcacuacguauauuacauuagaccaaacuugcgagcacuugaaaguaucuugcggucccaaauccauacaguuccaugcaugcuuuaaucagcauaugucuugugucagguuccugcauagaaccauacuaccugguuccauggcuaacucuauaugccaaaauauagaaauaauaauccuaaccacacuagcauugcuuauauucuuauuauuaacuauuuuaagcaaaacauauaucugcuacuuacuaaugccuauauuuaucccaauagcacacuuauacggauuaauuuacaauaagucuuguaaaaagugucagcuaugcggccuaguguaucauccauuuacugagugcggcacccacuguguauguggugcuagauaugaaacaucagauagaaugaaauugcaucgugcaucaggccuuugcccaggauauaagaguuugagagcugcuagaguuauguguaaaucuaaaggaccagcaucaaaccuauccauaaucacugcaguccucacuuugacauuugugacaccuauaaauggguuaacaauaggggauaguaaggaaguuuuaaacccugaugagcucccagaugacauguuagaaauggcucaaaaauuaaacauguaucaacugauaugcauuauaaauuauacugcaacauggucuauuauaauuauagguuuagcugucuuuuacauuuucaaaaaguaccagcauagauucuacaauuacuaugcuauguauugccaagagugugauauguaccaugaaagaucuggccugaaguggaauggagacuucacaaauaagugcagacagugcacauguggugaguaugaagaugcagcugguuuaauaucucacaggaaaucuuauaacugucuucugcaguacaagguuaaguggguaaugaacuuuuuaaccauauauguugccuugaucauucugaaagacucaacauugauaguacaagcagcgggcacugauuucucagauuguauagaaaccgaggaauuaaauuggaacugcacuggcccuuucuugaauuuagguaauugcgaaaagaaacagaagaaggaaucauauucaaauauugcagaacaguugaaagguuugcaagcaauaucuguccuugauaucccauuaauugcaagaauaccugaggacauaucuggcggauugagauauaucgaaucuaucagaacucaucaugcgcaacuuaccgcugaauaugcaauguugacuagauacugugacuaccauaaacuauuuggggacaacucuggauacagucaaacaacauggagaauguaucuaagaucacaugacuuuggagcaugcauuuuauacccaaaucaacauuuuuguagguguguuaagcauggagaaaaaugcagcaguucaagcugggacuuugccagugagaugaagaauuauuacuccgggaaacagggaaaauuuaacaaagacuuaaacuuggccuuacagucuauccaucaugcauucaggggcaccucaucaucuuacauagcaacuaucuuaucagagaagaggaaugaccaacuuguggaauacauggaaaaacuaagggaaaaguuuauuggaaaugcuuuacucagagcugugcuagauuucauaacauauaugaagucuuuaacugaaaugacaaacuuuaaacaugacgaauuuugggaugaauuuguccaucugccugcaccaacaaaagccccaucuaugaggagaucuggaaaugagaauuacgacuuuaaagcaccaacaucuccagcugggacuaaaaguugcaaaaacauaaagaacguuguaugucucucaccuagauccggugcuuccuacgaaggcauuguagcuuguggagaaccuucagccccacaaauuuucaaaaugcccucugaaucuaucuaucauaacaaugcagaccagucuauguauuguauugcagauacccacugcuugcaagauuacuccccaguugaagaugaagaguugaaugccaucaaaaaaucaaaaugcugggaaacagaauuuaccaaugcagugccauuuaaacaaagugauggaauacgaagcuguagaaugagagauucugggaauuguaaugugacaacaaaccuauggccuguaaugcagugugacgaugguaaauuuuauuauucugagcaccaaaaagauuaugacaaggaucaagauauaggccauuuuugcuugagcccaagaugcaauaugguuagguucccuauaagcgagaaaaacauuuuagcaugcgauuggauagucagccauccaaauauugauaaaauagauguccauucucuugaagaucuagagcaauauaaaaaggcaauaacccagaagcuccagacuaguuugucuauauucaaauaugcaaaaacuaugaauuuaccacauguuaaaccaauauauaaguauauuucaauugaaggcacagagacugcagaagggguugaaaaugcuuucauagaaucagaaauaccagcauuagcaggaacaucaauaggauuuaaaguaaauucuaaagaugggaagcauauuauggauauuauugguuauguaaaaacugcaucauauucgucuguauauacuaagcuuuacacaacuaguccaacaacaggggugaauacaaagcacgaugaauuaugcacaggcccguguccuaaacagauugaacauaaaaauggcuggauaacuuuuucaaaggaaaggacaagcucaugggguugugaagaguucggaugucuagcaauaagugaugggugcguauuuggaucuugccaagacauuauuaaagaugaaaugucuguuuacaggaaagaaacagaggaaacuacaauuguugaacugugccuaacauuuucugauaaaacuuauugugucgaauuaaacccgguuacacccauaauaacagaucuuuucgaaguccaauucaaaacaguagagucauauacacuaccuagaaucguugcaguaaaaaaucacgaggugaugguaggccaaaucaaugaucuagggguuuauucaaaaggcuguggcaauguucaaaaagugaacgggacuguauaugguaaugguguaccaaaauuugauuaccuaugccaucuagccagccggaaagaaguuauaaucaggaaguguuuugacaaugacuaucaagcuuguaaguuccuacagagcccauccaguuacagacuagaggaggaugcuucuacaguaucaauaauugauuauaaaaaaauucuuggaacaauaaagaugaaggcuaucuugggagauguuagguacaagacauuuucagagucuauagacauuucugcagaggggacauguacaggaugugucaauugcuuugagaauauacauugcgaauuuaccauacauucaacaguagaagccagcuguccuguuguuaguacauguacucuuuuccaugacagaaucuuaauagggccagauaaucacaaguaugcaaugaaaguuauauguacagaggcgccuaaaacaagcuuaaguuucaaaauauguaauacaaaaguagaugcugcuaucaccauaguugacucgaaaccuauaguugaguuagcaccaguggaucagacugcauauauuagggaaaaagaugauaggugcaaaacauggaugugcagaguuagagaugaagguaugcaagucuugucagagccauucaaaaauuuauucggauccuauauaggaauauucuacacuggacuagcuguguugauaauugccuugauagcagucuacauagucaugcccauuugcuuuaagguaaaagauauauuaaagaaacaugaugaugccuacaggcgggaguuaaagauuagguaa

SEQ ID NO: 4216 - RNA, 4326 nt, Artificial Sequence
  derived and/or modified CDS sequence (wt) from SAV(20230)__KX817331.1__GP
augauaccuuugcuguuuuuaguuacgcuggugucugcaggcccaguguuucaacguugcuuccaagauggggcuauagugaagcaaaacccaucgaaagaggcagugacagaaguauguauaaaagaugauguaaguaugauuaaaacagaggcuagauaugucaggaauucaaguggagucuucucaaacaauguggcuuuacgaaaauggcucgugucggauuggcaugacugcaaaccaaaaaaagucaguggagggcauauuaauguuaucgagguugguaacgauuuaacuuuacacacagaaucguauguauguagugcagauugcacaauaggaauugacaaggaaacggcacaaaucagacuccaaacugauacuacaaaucacuuugaaguggcaggaacuacuguaaaaucugggugguucaaaagcacuacguauauuacauuagaccaaacuugcgagcacuugaaaguaucuugcggucccaaauccauacaguuccaugcaugcuuuaaucagcauaugucuugugucagguuccugcauagaaccauacuaccugguuccauggcuaacucuauaugccaaaauauagaaauaauaauccuaaccacacuagcauugcuuauauucuuauuauuaacuauuuuaagcaaaacauauaucugcuacuuacuaaugccuauauuuaucccaauagcauacuuauacggauuaauuuacaauaagucuuguaaaaagugucagcuaugcggccuaguguaucauccauuuacugagugcggcacccacuguguauguggugcuagauaugaaacaucagauagaaugaaauugcaucgugcaucaggccuuugcccaggauauaagaguuugagagcugcuagaguuauguguaaaucuaaaggaccagcaucaauccuauccauaaucacugcaguccucauuuugacauuugugacaccuauaaauggguuaacaauaggggauaguaaggaaguuuuuaaccuugaugagcucccagaugacauguuagaaauggcucaaaaauuaaacauguaucaacugauaugcauuauaaauuauacugcaacauggucuauuauaauuauagguuuagcugucuuuuacauuuucaaaaaguaccagcauagauucuacaauuacuaugcuauguauugccaagagugugauauguaccaugaaagaucuggccugaaguggaauggagacuucacaaauaagugcagacagugcacauguggugaguaugaagaugcagcugguuuaauaucucacaagaaaucuuauaacugucuucugcaguacaagguuaaguggguaaugaacuuuuuaaccauauauguugccuugaucauucugaaagacucaacauugauaguacaagcagcgggcacugauuucucagauuguauagaaaccgaggaauuaaauuggaacugcacuggcccuuucuugaauuuagguaauugcgaaaagaaacagaagaaggaaucauauucaaauauugcagaacaguugaaagguuugcaagcaauaucuguccuugauaucccauuaauugcaagaauaccugaggacauaucuggcggauugagauauaucgaaucuaucagaacucaucaugcgcaacuuaccgcugaauaugcaauguugacuagauacugugacuacuauaaacuauuuggggacaacucuggauacagucaaacaacauggagaauguaucuaagaucacaugacuuugaagcaugcauuuuauacccaaaucgacauuuuuguagguguguuaagcauggagaaaaaugcagcaguucaagcugggacuuugccagugagaugaagaauuauuacuccgggaaacagggaaaauuuaacaaagacuuaaacuuggccuuacagucuauccaucaugcauucaggggcaccucaucaucuuacauagcaacuaucuugucagagaagaggaaugaccaacuuguggaauacaugaaaaaacuaagggaaaaguuuauuggaaaugcuuuacucagagcugugcuagauuucauaacauauaugaagucuuuaacugaaaugacaaacuuuaaacaugacgaauuuugggaugaauuuguccaucugccugcaccaacaaaagccccaucuaugaggagaucuggaaaugagaauuacgacuuuaaagcaccaacuucuccagcugggacuaaaaguugcaaaaacauaaagaacguuguaugucucucaccuagauccggugcuuccuacgaaggcauuguagcuuguggagaaccuucagccccacaaauuuucaaaaugccuucugaaucuaucuaucauaacaaugcagaccagucuauguauuguauugcagauacccacugcuugcaagauuauuccccaguugaagaugaagaguugaaugccaucaaaaaaucaaaaugcugggaaacagaauuuaccaaugcagugccauuuaaacaaagugauggaauacgaagcuguagaaugagagauucugggaauuguaaugugacaacaaaccuauggccuguaaugcagugugacgaugguaaauuuuauuauucugagcaccaaaaagauuaugacaaggaucaagauauaggccauuuuugcuugagcccaagaugcaauaugguuagguucccuauaagcgagaaaaacauuuuagcaugcgauuggauagucagccauccaaauauugauaaaauagauguccauucucuugaagaucuagagcaauauaaaaaggcaauaacccagaagcuccagacuaguuugucuauauucaaauaugcaaaaacuaugaauuuaccacauauuaaaccaauauauaaguauauuucaauugaaggcacagagacugcagaagggguugaaaaugcuuucauagaaucagaaauaccagcauuagcaggaacaucaauaggauuuaaaguaaauucuaaagaugggaagcauauuauggauauuauugguuauguaaaaacugcaucauauucgucuguauauacuaagcuuuacacaacugguccaacaacaggggugaauacaaagcacgaugaauuaugcacagguccguguccuaaacagauugaacauaaaaauggcuggauaacuuuuucaaaggaaaggacaagcucaugggguugugaagaguucggaugucuagcaauaagugaugggugcguauuuggaucuugccaagacauuauuaaagaugaaaugucuguuuacaggaaagaaacagaggaaacuacaauuguugaacugugccuaacauuuucugauaaaacuuauugugucgaauuaaacccgguuacacccauaauaacagaucuuuucgaaguccaauucaaaacaguagagucauauacacuaccuagaaucguugcaguaaaaaaucacgaggugaugguaggccaaaucaaugaucuagggguuuauucaaaaggcuguggcaauguucaaaaagugaacgggacuguauaugguaaugguguaccaaaauuugauuaccuaugccaucuagccagccggaaagaaguuauaaucaggaaguguuuugacaaugacuaucaagcuuguaaguucuuacagagcccauccaguuacagacuagaggaggaugcuucuacaguaucaauaauugauuauaaaaaaauucuuggaacaauaaagaugaaggcuaucuugggagauguuagguacaagacauuuucagagucuauagacauuucugcagaggggacauguacaggaugugucaauugcuuugagaauauacauugcgaauuuaccauacauucaacaguagaagcuagcuguccuguuguuaguacauguacucuuuuccaugacagaaucuuaauagggccagauaaucacaaguaugcaaugaaaguuauauguacagaggcaccuaaaacaagcuuaaguuucaaaauauguaauacaaaaguagaugcugcuaucaccauaguugacucgaaaccuauaguugaguuagcaccaguggaucagacugcauauauuagggaaaaagaugauaggugcaaaacauggaugugcagaguuagagaugaagguaugcaagucuuguuagagccauucaaaaauuuauucggauccuauauaggaauauucuacacuggacuagcuguguugauaauugccuugauagcagucuacauagucaugcccauuugcuuuaagguaaaagauauauuaaagaaacaugaugaugccuacaggcgggaguuaaagauuagguaa

SEQ ID NO: 4217 - RNA, 4329 nt, Artificial Sequence
  derived and/or modified CDS sequence (wt) from SDNV__AF123490.1__GP
augauaugcauauuacucuugauagcacuugcuucagcaagcccugucuaucaaaggugcuuccaagauggagcaauugucaaacaauacccagcgaaagaugccguaacugaaguuugucuaaaagaugacgucaguaugauaaagacacaggcuaauuauaugaaaaauaccacagggacauucuccaacaauguagcuaugaggaaauggcuuguugcugauuggcaugauuguagaccacaaaagucaucugguggccacauaaauguaauagaaguuggagaugauuuaucauuacacacugaggcauauauuuguagcgcagauuguguuauaagcauugacaaagagacagcacagaucaggcugcaaacugauagcacaaaccauuuugaaguuucaggcacaacuguaaaaucaggaugguuuaaaaguacaacauauaucacauuagaucagacuugugagcauuugaaaguuucaugugguccaaaaucaauacaauuccaugcaugcuucaaccagcauauguccuguguaagauucuuacauagaaccauauuaccugguuccauggcgaacucaauaugccaaaauauugaaaucauaauauuaguaacacuuacuuuaaugaucuucauauuauuaacuauaauaagcaaaacuuauaucugcuacaucuuaaugccaauauuuauaccuauagcuuauaucuaugguuggauuuauaauaaaucauguaaaaaguguaaauuauguggucucguauaucacccuuuuacugaaugcggcacccauuguguuuguggugcaagguaugagaccucagacagaaugaaauuacauagauccucuggcuuauguccugguuauaaaaguuuacgagcagcuagaguuauguguaaaucaagagguccugcaucaauacuuucuauacuaacugcuguacuaauauuaacuuuuguuacuccuaugagugcacuaguuauaggcucaucagaagaauuguacaaauuagaugaguugccggaugauaugauugauauggcagaaaaaguaaaccuauauuauuuagugauuguguuaaauuacagugcuacaugggguuuguuauuacuuauggguauucuagcacuguuauucaaaaaguaucaacauauauucuuaaacuauuaugcaauguacugcacagaaugcgauauguaucaugauaaaaaagaauuaacuuacaauggggauucaccaacaaaugccuggcaauguacaugcggacaguaugaagaugccacaggccuuaucguacaucagaagucuuacaauuguuuaguuaaauacaagguuaaauggaucaaaaacauauugauaauguauaucguucuaacuuuaaucaaagauucuguguuaauugcuucagcugagggcccagauuuugcaacuuguauugaagaaaaaacuauaacauggaauugcacagggccguuuuuaaaucuagguagaugugauaaaacacaaaaaaagacagauuaugcaacaauagcuagucaacucaaaggcauugaugcaaucucuauuuuagaugucccaaugauuucuaaaauaccagaagauauaucaggagcauugaaauauauugaaaguuuaaaaaccuaccaugaacaguuaacagcugaguaugcaauguuuacuagauauugugauuauuacacacaauucucagauaauucuggauauagccaaacuacauggaggacauauuugcgaucucaugauuuugagguauguauugccuauccuaaucaacauuuuugcagaugcgugaaaaauggcgaaaaguguaguagugcacagugggacuuugcuacagaaauuaaaggcuauuauacuggaagacaaaauaaauucaauaaagauuuaaaucuagcauuaaugacauuccacacagcauuucgagguacugcaacaucauauguaacagagcuaauaucaaagggaaaaaauagcucuuuauuaauguaugcaucagcuauuaagaguaaauucaauggcaaugcauuauugaaagcauuacuugacuucaugauguaucuucagucacuaggggaaauuucuggcuucaaacugacagaugaaugggaggauuuuaaauaugaagaggaaccuacagaacagacacuaaugccuagaggacaucgaggugggcaauacaauuucaaaaaugcagcaagcaaugguaaaacaaaaguaugcaaaaaugugaagaaggugcugugcuuaucaccuagaucuagagccacuuuugaugaugucauagcaugcggcgaacaugcaaacccaucaguguacaugauuccaaacacaacaaucuaccagucgaauacagaaagaagucacuauuguauugcugauucacauugucuagaagaauaugagcugguuaaaccagaauuauuaacugcacuuaagaaaucuagauguugggcuggugacauagacacuauaguuuuacacaagcaaagugaugggcuaaggaguugucgcauaaaagauacuggcagcugcaaugugaugggaaaugacuggacaauaguauuaugugaagauaauaaauacuauuacucagaaguacaucaagauuaugacaaagaucaagauguuggacauuuuugcuugaguccaagguguaacacaauuagauacccuaucaguccgcgacauaucaacucauguaaauggcaaaucucacauucuacaauugguaagauaucagugcaugaauuagcugauauagaacaauacaaaaaagcuauaucucagaaacugcaaacuaguuuaucuaucuucaaauaugcaaaaacaaaaaaucuaccacauauaaaaccagucuauaaauacauugcaauagaagguacagaaacaguugaaggaguugaaaaugcauuuauagaaucugaaauuccagcucuagcugguacugccauuggauuuaaaauaaauucaaaggagggcuaucauuugauggauauuauagguuaugucaaaagcgcaucuuacucuucaacauacacaaaacuauacacaacaggaccaaccauagggauaaauacaaagcaugaugaaaaaugcacuggaagcuguccaggaacuauucaucauaaaacugggugguuaacauuuucuaaagaacgaacaagcacaugggguugcgaagaauuugggugcuuagcuguaagcgauggauguguuuacgggucaugccaagauauaauaaaagaugaauuaacuguauauagaaaaaucucagaugaaguuacugaaguugaguuauguuuaacauuuucagacaaaacauauuguacuaauuuaaaugcagugacuccaauuauuacagauaaauuugagguacaauucaagacaguugagucauauucacugccuagaauagugggagugcgaaaccacaaaauucagauagggcaaaucaaugauauaggaguuuauucuaaagguuguggcaauguccagaaaguaaauggcacuaauuaugguaauggggugccuaaauuugauuauuuaugccauuuagcuaguagaaaagaagucauuauuagaaaauguuuugacaaugauuaucaagcuuguaaauuucuacaaacaccugccaguuauagauuagaagaacaucaaggaacugugacuaucauaaauuauaaaaagauuuuggguuccauaaaaaugaagccauauugggugauguuaagauacaaaaauuaugcaaauagucuagauaucaaugcagagggaacauguucaggguguguagguugcuuugaaaauauucauugugaauucacaauucacaccacuauagaagcuaguugucagauagaaagugacuguacaacauuccacgauaggauauuaguaacuccaaaugagcacaaauaugcccucaaggugaucugucaugacaaacccaaaacaauauucaacuucaaaauauguaacaccgaaauugaagcagccauagcuauuguggaugcaaaaccuauuauagaauuagcaccuguggaucagacagcuuauauaagagaaaaagaugaacgcuguaagacauggaugugccgaguuagagaugaaggcauucaaguucuucuagaaccauuuaaaaauuuauuuggauccuauauuggaauauuuuauacuauuuuaauuguaaucuucaucuugguaauuauuauuuauauaauucuuccuauaugcuucaaacuucaagacacauuaaaacagcaugaagaugcauauaagagagagaugaagaucagguaa

SEQ ID NO: 4218 - RNA, 4329 nt, Artificial Sequence
  derived and/or modified CDS sequence (wt) from SDNV(BeAr103645)__KX817334.1__GP
augauaugcauauuacucuugauagcacuugcuucagcaagcccugucuaucaaaggugcuuccaagauggagcaauugucaaacaauacccagcgaaagaugccguaacugaaguuugucuaaaagaugacgucaguaugauaaagacacaggcuaauuauaugaaaaauaccacagggacauucuccaacaauguagcuaugaggaaauggcuuguugcugauuggcaugauuguagaccacaaaagucaucugguggccacauaaauguaauagaaguuggagaugauuuaucauuacacacugaggcauauauuuguagcgcagauuguguuauaagcauugacaaagagacagcacagaucaggcugcaaacugauagcacaaaccauuuugaaguuucaggcacaacuguaaaaucaggaugguuuaaaaguacaacauauaucacauuagaucagacuugugagcauuugaaaguuucaugugguccaaaaucaauacaauuccaugcaugcuucaaccagcauauguccuguguaagauucuuacauagaaccauauuaccugguuccauggcgaacucaauaugccaaaauauugaaaucauaauauuaguaacacuuacuuuaaugaucuucauauuauuaacuauaauaagcaaaacuuauaucugcuacaucuuaaugccaauauuuauaccuauagcuuauaucuaugguuggauuuauaauaaaucauguaaaaaguguaaauuauguggucucguauaucacccuuuuacugaaugcggcacccauuguguuuguggugcaagguaugagaccucagacagaaugaaauuacauagauccucuggcuuauguccugguuauaaaaguuuacgagcagcuagaguuauguguaaaucaagagguccugcaucaauacuuucuauacuaacugcuguacuaauauuaacuuuuguuacuccuaugagugcacuaguuauaggcucaucagaagaauuguacaaauuagaugaguugccggaugauaugauugauauggcagaaaaaguaaaccuauauuauuuagugauuguguuaaauuacagugcuacaugggguuuguuauuacuuauggguauucuagcacuguuauucaaaaaguaucaacauauauucuuaaacuauuaugcaauguacugcacagaaugcgauauguaucaugauaaaaaagaauuaacuuacaauggggauuucaccaacaaaugcaggcaauguacaugcggacaguaugaagaugccacaggccuuaucguacaucagaagucuuacaauuguuuaguuaaauacaagguuaaauggaucaaaaacauauugauaauguauauuauucuaacuuuaaucaaagauucuguguuaauugcuucagcugagggcccagauuuugcaacuuguauugaagaaaaaacuauaacauggaauugcacagggccguuuuuaaaucuagguagaugugauaaaacacaaaaaaagacagauuaugcaacaauagcuagucaacucaaaggcauugaugcaaucucuauuuuagaugucccaaugauuucuaaaauaccagaagauauaucaggagcauugaaauauauugaaaguuuaaaaaccuaccaugaacaguuaacagcugaguaugcaauguuuacuagauauugugauuauuacacacaauucucagauaauucuggauauagccaaacuacauggaggacauauuugcgaucucaugauuuugagguauguauugccuauccuaaucaacauuuuugcagaugcgugaaaaauggcgaaaaguguaguagugcacagugggacuuugcuacagaaauuaaaggcuauuauacuggaaaacaaaauaaauucaauaaagauuuaaaucuagcauuaaugacauuccacacagcauuucgagguacugcaacaucauauguaacagagcuaauaucaaagggaaaaaauagcucuuuauuaauguaugcaucagcuauuaagaguaaauucaauggcaaugcauuauugaaagcauuacuugacuucaugauguaucuucagucacuaggggaaauuucuggcuucaaacugacagaugaaugggaggauuuuaaauaugaagaggaaccuacagaacagacacuaaugccuagaggacaucgaggugggcaauacaauuucaaaaaugcagcaagcaauaguaaaacaaaaguaugcaaaaaugugaagaaggugcugugcuuaucaccuagaucuagagccacuuuugaugaugucauagcaugcggcgaacaugcaaacccaucaguguacaugauuccaaacacaacaaucuaccagucgaauacagaaagaagucacuauuguauugcugauucacauugucuagaagaauaugagcugguuaaaccagaauuauuaacugcacuuaagaaaucuagauguugggcuggugauauagacacuauaguuuuacacaagcaaagugaugggcuaaggaguugucgcauaaaagauacuggcagcugcaaugugaugggaaaugacuggacaauaguauuaugugaagauaauaaauacuauuacucagaaguacaucaagauuaugacaaagaucaagauguuggacauuuuugcuugaguccaagguguaacacaauuagauacccuaucaguccgcgacauaucaacucauguaaauggcaaaucucacauucuacaauugguaagauaucagugcaugaauuagcugauauagaacaauacaaaaaagcuauaucucagaaacugcaaacuaguuuaucuaucuucaaauaugcaaaaacaaaaaaucuaccacauauaaaaccagucuauaaauacauugcaauagaagguacagaaacaguugaaggaguugaaaaugcauuuauagaaucugaaauuccagcucuagcugguacugccauuggauuuaaaauaaauucaaaggaaggcaaucauuugauggauauuauagguuaugucaaaagcgcaucuuacucuucaacauacacaaaacuauacacaacaggaccaaccauagggauaaauacaaagcaugaugaaaaaugcacuggaagcuguccaggaacuauucaucauaaaacugggugguuaacauuuucuaaagaacgaacaagcacaugggguugcgaagaauuugggugcuuagcuguaagcgauggauguguuuacgggucaugccaagauauaauaaaagaugaauuaacuguauauagaaaaaucucagaugaaguuacugaaguugaguuauguuuaacauuuucagacaaaacauauuguacuaauuuaaaugcagugacuccaauuauuacagauaaauuugagguacaauucaagacaguugagucauauucacugccuagaauagugggagugcgaaaccacaaaauucagauagggcaaaucaaugauauaggaguuuauucuaaagguuguggcaauguccagaaaguaaauggcacuaauuaugguaauggggugccuaaauuugauuauuuaugccauuuagcuaguagaaaagaagucauuauuagaaaauguuuugacaaugauuaucaagcuuguaaauuucuacaaacaccugccaguuauagauuagaagaacaucaaggaacugugacuaucauagauuauaaaaagauuuuggguuccauaaaaaugaaggccauauugggugauguaagauacaaaaauuaugcaaauagucuagauaucaaugcagagggaacaugugcaggguguguagguugcuuugaaaauauucauugugaauucacaauucacaccacuauagaagcuaguugucagauagaaagugacuguacaacauuccacgauaggauauuaguaacuccaaaugagcacaaauaugcccucaaggugaucugucaugacaaacccaaaacaauacuaaacuucaaaauauguaacaccaaaauugaagcagccauaacuauuguggaugcaaaaccuauuauagaauuagcaccuguggaucagacagcuuauauaagagaaaaagaugaacgcuguaagacauggaugugccgaguuagagaugaaggcauucaaguucuucuagaaccauuuaaaaauuuauuuggaucuuauauuggaauauuuuauacuauuuuaauuguaaucuucaucuugguaauuauuauuuauauaauucuuccuauaugcuucaaacuucaagacacauuaaaacagcaugaagaugcauauaagagagagaugaagaucagguaa

SEQ ID NO: 4219 - RNA, 4326 nt, Artificial Sequence
  derived and/or modified CDS sequence (wt) from SSHV__EU262553.1__GP
augauuugcauauugauacuguuugcagucacagcugcaaguccaguguaucagagguguuuccaagauggggcuauagugaagcaaaacccaucuaaggaagcuguuacugaaguaugccuaaaggaugacguuagcaugaucaaaacggaggccagauacauaaagaaugcaacugggguuuucuccaauaauguugcaauucgaaaauggcuggugucugauuggcaugauugcagaccaaagaaaauaacagguggucauauuaaugucauugaaguuggcgaugaccuaucauugcacacagaaucguauguaugcagugcugauuguaccauaggaguugacaaagaaacagcucagguucggcuucagacggacacaacuaaccauuucgagauagcagggaccacaguuaaaucugggugguuuaagaguacaacauauauaacccuugaccagacaugugagcaucuaaaagucucuugugggccuaagucgauucaguuccaugcaugcuucaaucagcauauguccugugucagauuuuuacauaggacaauauugccugguucuauugccaauucaauaugccagaauauagaaauuauaauauuaguuacgcuuacucuguuaauauucauacucuuaaguguacuaaguaagacauauauauguuaccuauuaaugccuguauuuaucccuauagcguaugcguauggcauuauauauaauaagucuuguaaaaaaugcaaacuguguggauuaguuuaucacccauucacagaaugugggacacauugugucugcggugcucguuaugacacuucugauagaaugaaguuacauagggccucugggcuauguccugguuacaagagcuugagggcugccagaguuaugugcaaaucaaaggguccugcuucaauacuaucugugaucacagcaauauugaucuuaacauuuguuacuccaaucaauucaaugguagugggagagaguaaagaagucuucgagcuggaacaacuuccagaugacaugcuggauauggcacuaaggauuaauuucuauuacuuugucugcaucaugaauuaugcagugaccugggggcucauaauuaucggccuacuaauuggauugcuuuucaagaaauaccagcauagauuuucgaaucucuaugcuauguacugcgaagagugugacauguaucaugauagaucugggcugaaaaggaauggggacuucacaaacaagugcaggcaguguacaugugggcaguaugaggaugcaacaggacuaaugacccauaggaaaaccuauaauugcuugguacgguauaaggcgaaguggguuaugaacuucuugauagcuuauaugcuuuuaacauugauaaaagacucagcuauaguagugcaagcugcuggaacagacuucacaacuuguuuagaaacagaaaauauaaacuggaauugcacaggccccuuuuuaaaccuuggaaauugucaaaaacaacagaaaaaggaacccuacgcaaacauagccacucagcuaaaagguuugcaagcaauuucagugcucgauaugcccaugauagcaagcaucccagaggauauagcaggggcacuaagauacaucgaagaaaaagaaacauuccauguucagcuaacugcagaauaugccaugcuaucuagauacugcgacuauuacgcccaguuuucagauaacuccggauacagucagacgacauggagaguuuaucuaagaucccaugacuuugaugcuugcauacucuauccaaaucagcauuucuguagauguguaaagcauggagauaaauguaguaguucuaauagggacuuugccaacgagaugaaaaacuacuacucaggaaagcaaaacaaguuugacaaagaucuaaauuuggccuuaauggcauuacaucaugcauuccggggcacaucgucugcauauauugcaacaaugcucucaaagaagucaaacgaugaucuaauugcauauacuaauaagauuaaagaaaaguucccagggaaugcgcuacucaaggccauuguggauuauauagcguacaugaaaaguuugucagaaaugucaaguuucaaguacgaugaauuuugggaugaucuuuuguacaaaucagcuccaacaaaagcuccaucuuugucuagagguagugagccaucauauaauuucaaguuaguggucucaucaagaucaauaaaaaguugcaaaaauguuaaaagcguuguuugucuaucucccagaucuggggugucauaugauucaaucauagcauguggugauccuaauggcccaaguguauauaggaaacccucagacgguguauuucaaucaaaugcagaucaaucaacauacugcuuagcagacagccauugccuugaagauuuugaaguagucagccaagaagagcuggacgcaauaaagaaauccaaauguugggaagcagaauauccagaugucaaacuaucaaaguugacagaugggguuaaaagcugcagaaugaaagauucuggaaauugcaauguugcagcuaacagauggccuauaauacaaugcgaaaaugauaaauucuauuauucagagcugcaaaaggauuacgauaagacacaagacauuggucacuuuugccuaaguccuggaugcucuacaguucgcuucccgaucaacccaaagcauauuucaaacugcaacuggcagguaagucgaucuagcauagcaaagauugaugugcacaauauugaagauauugaucaauacaggaaggccauaacucagaaacugcaaacaagcuuaucucuuuuuaaguaugcaaaaacaaaaaacuugccucacaucaaaccaauuuacaaauacauaaccauagagggaacugaaacugcagagggaauagaaagugccuauauugagucugaaauaccugcacuagcuggaacuuccauugguuucaagaucaccuccaaagaaggcaagcauuuauuagaugucauaggcuauguaaaaagugcuucauacucuucuauauauacgaagcuuuacacaacaggcccaacaucgggaauaaacacaaaacaugaugaguuauguacaggaccuugcccagcuaaaaucaaccaccagacuggaugguugaccuuugcgaaagagaggacgaguucauggggcugcgaggaguucgggugcuuagccauaagugacggaugugucuucggaucaugucaagacauaauaagagaugaguuaacuguguacaggaaggaaacagaugaaguaacugauguagaguuaugucugacauuuucagauaagacauauugcacaaauuugaacccaauuacaccgauuauaacagauuuguucgaagugcaauuuaaaacugucgaaacuuacagccugccaaggaucguugccauccagaaucacgaaauaaagauuggccaagugaaugauuuaggagucuacucuaagggaugcggaaauguccaaaagguaaaugggacaguauauggcaaugggguucccaaauucgauuauuugugucaccuagcuaguagaaaggaaguuauuguucgaaagugcuucgauaaugauuaucaagcaugcaaauuucuacaaagcccagcuagcuacagacuagaagaagacagcggaacuguuacugugauugauuacaagaagauacuagguacgaucaagaugaaggcuaucuuaggagaugucaaauacaaaacauuugcugauaauguugauaugacugcagaagggucuuguacuggaugcauaaauugcuuugaaaauauccauugcgaauugacgcuccacacaaccauugaagcuagcugcccaauaguaagcacauguacgguauuccaugauagaauacuuguaacuccgaacgagcauaaauaugcauuaaaaguuguaugcacagagaaaccagggaauacauugaccauuaggauauguaauacaaaaguugaagcuucauuagcucuuguugaugcuaaaccuauacuagaguuggcaccaguagaucaaacugcuuacauaagagagaaagaugaaaggugcaaaacuuggaugugcagagugagggaugaaggguuacagguuauauuagagccguuuaagaaccuuuuuggcucuuacauagggauauuuuauacauuuauaauauccauaauugcgcugcugauuauaauuuauauugugcuacccauaugcuucaagcugagagauacucucaggaagcaugaagaugcauacaagagagagaugaagauuagguaa

SEQ ID NO: 4220 - RNA, 4326 nt, Artificial Sequence
  derived and/or modified CDS sequence (wt) from SSHV__K02539.1__GP
augauuugcauauugauacuguuugcagucacagcugcaaguccaguguaucagagguguuuccaagauggggcuauagugaagcaaaacccaucuaaggaagcuguuacugaaguaugccuaaaggaugacguuagcaugaucaaaacggaggccagauacauaaagaaugcaacugggguuuucuccaauaauguugcaauucgaaaauggcuggugucugauuggcaugauugcagaccaaagaaaauaacagguggucauauuaaugucauugaaguuggcgaugaccuaucauugcacacagaaucguauguaugcagugcugauuguaccauaggaguugacaaagaaacagcucagguucggcuucagacggacacaacuaaccauuucgagauagcagggaccauaguuaaaucugggugguuuaagaguacaacauauauaacccuugaccagacaugugagcaucuaaaagucucuugugggccuaagucgauucaguuccaugcaugcuucaaucagcauauguccugugucagauuuuuacauaggacaauauugccugguucuauugccaauucaauaugccagaauauagaaauuauaauauuaguuacgcuuacucuguuaauauucauacucuuaaguguacuaaguaagacauauauauguuaccuauuaaugccuguauuuaucccuauagcguaugcguauggcauuauauauaauaagucuuguaaaaaaugcaaacuguguggauuaguuuaucacccauucacagaaugugggacacauugugucugcggugcucguuaugacacuucugauagaaugaaguuacauagggccucugggcuauguccugguuacaagagcuugagggcugccagaguuaugugcaaaucaaaggguccugcuucaauacuaucugugaucacagcaauauugaucuuaacauuuguuacuccaaucaauucaaugguagugggagagaguaaagaagucuucgagcuggaacaacuuccagaugacaugcuggauauggcacuaaggauuaauuucuauuacuuugucugcaucaugaauuaugcagugaccugggggcucauaauuaucggccuacuaauuggauugcuuuucaagaaauaccagcauagauuuucgaaucucuaugcuauguacugcgaagagugugacauguaucaugauagaucugggcugaaaaggaauggggacuucacaaacaagugcaggcaguguacaugugggcaguaugaggaugcaacaggacuaaugacccauaggaaaaccuauaauugcuugguacgguauaaggcgaaguggguuaugaacuucuugauagcuuauaugcuuuuaacauugauaaaagacucagcuauaguagugcaagcugcuggaacagacuucacaacuuguuuagaaacagaaaauauaaacuggaauugcacaggccccuuuuuaaaccuuggaaauugucaaaaacaacagaaaaaggaacccuacgcaaacauagccacucagcuaaaagguuugcaagcaauuucagugcucgauaugcccaugauagcaagcaucccagaggauauagcaggggcacuaagauacaucgaagaaaaagaaacauuccauguucagcuaacugcagaauaugccaugcuaucuagauacugcgacuauuacgcccaguuuucagauaacuccggauacagucagacgacauggagaguuuaucuaaggucccaugacuuugaugcuugcauacucuauccaaaucagcauuucuguagauguguaaagcguggagauaaauguaguaguucuaauggggacuuugccaacgagaugaaaaacuacuacucaggaaagcaaaacaaguuugacaaagaucuaaauuuggccuuaauggcauuacaucaugcauuccggggcacaucgucugcauauauugcaacaaugcucucaaagaagucaaacgaugaucuaauugcauauacuaauaagauuaaagaaaaguucccagggaaugcgcuacucaaggccauuguggauuauauagcguacaugaaaaguuugucagaaaugucaaguuucaaguacgaugaauuuugggaugaucuuuuguacaaaucagcuccaacaaaagcuccaucuuugucuagagguagugagccaucauauaauuucaaguuaguggucucaucaagaucaauaaaaaguugcaaaaauguuaaaagcguuguuugucuaucucccagaucuggggugucauaugauucaaucauagcauguggugauccuaauggcccaaguguauauaggaaacccucagacgguguauuucaaucaaaugcagaucaaucaacauacugcuuagcagacagccauugccuugaagauuuugaaguagucagccaagaagagcuggacgcaauaaagaaauccaaauguugggaagcagaauauccagaugucaaacuaucaaaguugacagaugggguuaaaagcugcagaaugaaagauucuggaaauugcaauguugcagcuaacagauggccuauaauacaaugcgaaaaugauaaauucuauuauucagagcugcaaaaggauuacgauaagacacaagacauuggucacuuuugccuaaguccuggaugcucuacaguucgcuucccgaucaacccaaagcauauuucaaacugcaacuggcagguaagucgaucuagcauagcaaagauugaugugcacaauauugaagauauugaucaauacaggaaggccauaacucagaaacugcaaacaagcuuaucucuuuuuaaguaugcaaaaacaaaaaacuugccucacaucaaaccaauuuacaaauacauaaccauagagggaacugaaacugcagagggaauagaaagugccuauauugagucugaaauaccugcacuagcuggaacuuccauugguuucaagaucaccuccaaagaaggcaagcauuuauuagaugucauaggcuauguaaaaagugcuucaugcucuucuauauauacgaagcuuuacacaacaggcccaacaucgggaauaaacacaaaacaugaugaguuauguacaggaccuugcccagcuaaaaucaaccaccagacuggaugguugaccuuugcgaaagagaggacgaguucauggggcugcgaggaguucgggugcuuagccauaagugacggaugugucuucggaucaugucaagacauaauaagagaugaguuaacuguguacaggaaggaaacagaugaaguaacugauguagaguuaugucugacauuuucagauaagacauauugcacaaauuugaacccaauuacaccgauuauaacagauuuguucgaagugcaauuuaaaacugucgaaacuuacagccugccaaggaucguugccauccagaaucacgaaauaaagauuggccaagugaaugauuuaggagucuacucuaagggaugcggaaauguccaaaagguaaaugggacaguauauggcaaugggguucccaaauucgauuauuugugucaccuagcuaguagaaaggaaguuauuguucgaaagugcuucgauaaugauuaucaagcaugcaaauuucuacaaagcccagcuagcuacagacuagaagaagacagcggaacuguuacugugauugauuacaagaagauacuagguacgaucaagaugaaggcuaucuuaggagaugucaaauacaaaacauuugcugauaauguugauaugacugcagaagggucuuguacuggaugcauaaauugcuuugaaaauauccauugcgaauugacgcuccacacaaccauugaagcuagcugcccaauaguaagcacauguacgguauuccaugauagaauacuuguaacuccgaacgagcauaaauaugcauuaaaaguuguaugcacagagaaaccagggaauacauugaccauuaggauauguaauacaaaaguugaagcuucauuagcucuuguugaugcuaaaccuauacuagaguuggcaccaguagaucaaacugcuuacauaagagagaaagaugaaaggugcaaaacuuggaugugcagagugagggaugaaggguuacagguuauauuagagccguuuaagaaccuuuuuggcucuuacauagggauauuuuauacauuuauaauauccauaauugcgcugcugauuauaauuuauauugugcuacccauaugcuucaagcugagagauacucucaggaagcaugaagaugcauacaagagagagaugaagauuagguaa

SEQ ID NO: 4221 - RNA, 4335 nt, Artificial Sequence
  derived and/or modified CDS sequence (wt) from SORV__AF123488.1__GP
auggaaguccuaagcuugaucugguugcugacauuaugcucggcuaguccaguauuccaaagguguuuccaagauggagcuauagugaagcaaaauccaucaaaggaagcagugacagaaguuugccuuaaagaugauguaaguaugauuaagacugagacaaaauaugugaaaaacacaacugguacauuugccaacaacauugcaaugaggaaaugguuaguugcagauuggcaugauugcagaccucagaaaucaucugguggccauaucaauguuaucgaaguaggagaugaucuaucacugcauacagaaucguacauuuguagugcagauugugugaucacaguggacaaagaaacagcucagauccguuugcagacagacaacacaaaccacuuugagguugcugggacaacugugaaaucuggaugguuuaaaagcacaacguauauaacauuggaucaaacuugugagcauuuaaaaguaucauguggcccuaagucaauacaguuccaugcaugcuuuaaccaacauaugucuuguguacgauucuugcauaggacaauacucccagggucaauugcaaauucuauaugccaaaauauagaaauaauaaucuuaguuacgcugucauuaguaauauucauauucuugacuauaguaaguaagacauauaucuguuacuuauuaaugcccauauuuaucccaauagcuuuuaucuacggauggaucuauaauaagucauguaaaaaauguaaacuuugugguuuagucuaucacccguuuacugaaugcggcacacacuguguuuguggugcaagauaugaaacaucggacagaaugaaacugcauagagcaucugguuuauguccaggauacaaaagucucagagcugcuagaguaaugugcaaaucuaaaggcccagcaucaauuuuauccauuuuaacagcaauauuaauacuaacauuugucacaccuaucagugcaauggucguuggugaaucaaaugagaucuacaccuuagacgacuuaccugaugacaugguucagauggcagaaaggauaaacauuuacuaccagauacucauaauuaauuauggggugacaugggcuuucuuauugcuugguuuaguuuuagcauacuucuucaaaaaauaucaacauaaauucuuagauuauuaugcaauguacugugaggagugugacauguaccaugaaaaaucagguaugacauauuggggggauuuuacaaauaaguguaggcaaugcacaugugggcaauuugaagaugccacuggcuugauggugcauaaaaaaucuuacaacugucuuguaaaauauaaggcaaaauggauaagaaacauuuuaauugcauauuugaugauaauguugguuaaagauucgcuauuauuuguuggugcaacaagagcugacuuugcaucauguguggaugagaaaacuguaacguggaauugcacugggccauuucugaaucugggucgaugugacaaaacucaaaaaaagacaggcuauaaagacauagcuaaucaauugaagggucugggugugauuucuauacuggauauuccgaugauugagaagaugccagaugaaaucucaggaucuuuaaaauauauugacaguuuagaaacauaucaugagcagcugaccgcagaauaugcauuccucaccagguauugugauuacuacacacaauauacugacaauucagguuauagccaaacaguauggcgaaccuauuuacgaucacaugauuuuggugcauguguuguguauccaaaccaacauuuuugcagauguguaaaauaugaugauaaauguaacagugcuaaaugggauuuugcuaacgagaugaagacauuuuacacuggccggaaaguaaaauucaauaaagauuuaaauuuagcauuacuagugcuacauaaggcauuuagggguacaggaacugcauauauugcagaagcuauggcccgaaaagacaaugguucaauggcacauuuugcuuuagaaauuaggaagaaguucccaacaaaugcucuacuggcagcuuuaauagacuauauuguauauuuacagucacuugcagagauaucaacauucgagcuggaagaagauugggaagacuuuaaauacaaaccugaaccaacagaaucuacucuacaaccuagaucucacagaagugaucaauauaauuuuaaaaaugcagauagcaauagcaaugucaaagucuguaaaaaugucaaaaaaguauugugugucucaccuagaucuagagcuaaauuugagaauauaauagcuuguggagagcaugccaauccaucuguauauaugaugccuaauaucaguaucuaucaauccaauucugaaaggagucauuacuguauugcagacucacacugucuugaggaguaugaaauugugaacacagagcucuugacagcacuaaagaaaucuagaugcugggcuaaggagauggaugaugucguacuacauaaacagagugauggguuaagaaguugcagaauuaaagauacugggaguuguaauguauugggcaaugacuggaccauaguuuuaugugaaaaugggaauuacuauuauucggaaauucauaaagauuacgacaaagaucaagaugucgggcauuucugucuaaguccuagaugcaguacaauacgcuauccaauuaauaggagacauauuaggaaaugugacuggcagaucucacauucaacaaucgacaaaauuucggugcaagagcuagcugauauagaacaauacaaaaaagcuauaucacaaaaauugcagacaaguuugucgauauuuaaguaugucaaaacuaaaaaccuuccacauauuaaaccugcuuauaaguauauuaccguagaggggacugagaccaucgaagggauagaaaaugccuuuauagagucugagauuccugcacuugcuggaacagcuauuggauuuaaaauaaauucaagagaggguaauuacuuaauggauguuauugguuauguuaaaagugcaucuuauucagcaacauauacaaaauuguauacaaccgggccaacuauaggaauaaauacuagacaugaugaaaaaugcacagguccuuguccuguuacuauagaccacaaagauggcugguuaacauuuucaaaggagaggaccagcacaugggguugugaagaauuuggaugcuuggcaguaagugacggauguguauuugggucuugucaagauauuaucaaagaugaauuagcuguauauagaaagaccacggaagaauugacuacuguugaauugugucuaacauuuucagacaagacuuauugcacuaacuuaaaugcuauaaccccuauaauaacagacaaguuugaaguucaauuuaaaacagucgaaucauacacauugccaagaauaauagcugugaaaaaucaugaaauuaaaguugggcaaauuaacgaucuagguguuuauucgaaaggaugugggaauguucaaaaaguaaauggaacaaauuauggcaaugggguaccaaaauucgacuaccuaugccauuuagcaaguagaaaggaaguuauuuugaggaagugcuuugauaaugauuaucaggccugcaaauuccuacaaaguccugcaagcuaucguuuagaagaacaccaagggacaguuacaguaauagauuacaaaaaaauauugggcagcauaaagaugaaagccauauuaggugauguaaaauauaaaaauuaucaaagcaauauagaaaucaaugcagaaggaacuugugcuggauguguaaauugcuuugagaauauucauugugaauuuacuauacauacuacaguugaaacaaguuguccuauaguaacagauuguguaucauuucaugauaggauacugaucacuccagaugagcacaaguacgcauugaaaauuguaugccaagauaaaccuaaagugucucuaaaauucaaaauuugcaacacaaauauugaugcuucuaugacaauaguggacucaaaaccaauuuuagaacuugcaccaguugaucaaacugcauacauuaaagaaaaagaugaaagauguaaaacuuggaugugcagagugagagaugaaggcuuccaaguuauauuagaaccauucaagaaucuguuugguucuuacaucggaauauuuuauacuggcauacuaucaguuauaugccuucucaucgucauuuauauuguauuacccauuugcuuuaaauugagggauacuuuaaagcaacaugaagaugcuuauaagaaggaaaugaaaauaagguaa

SEQ ID NO: 4222 - RNA, 4335 nt, Artificial Sequence
  derived and/or modified CDS sequence (wt) from SORV(SORV-252)__JN815081.1__GP
auggaaguccugagcuuaaucuggcuauuggcagugugcucagcuaauccaguauuccaaaggugcuuccaagauggagcuauagugaagcagaauccaucuaaggaagcagugacagaaguuugucucaaggaugauguaaguaugaucaaaacugaagcaaaguauguuaaaaacacaacuggaacauuuucuaauaauguagcaaugaggaaauggcuaguugcagacuggcaugauugcaggccucagaagucuucugguggucauauuaauguuauugagguaggagaugaccuaucauuacauacggaaucauauauuugcagugcagacuguguaaucacaguggauaaagagacagcacaaauccgccuacaaacugauagcacuaaccacuuugaaguugcuggaacaacagugaagucugggugguucaaaagcacaacauauauaacauuagaucaaacuugugagcacuugaaaguaucauguggucccaaaucaauacaauuccaugccuguuuuaaccagcauaugucuuguguccgcuuuuuacauaggacaauacuuccagguucaauugcaaacucuauaugucaaaauauagaaauaauuauccuggucacacuuucacuaauaauauuuauauuuuuaacuauaguaaguaaaacauauaucuguuacuuguuaaugcccauauuuauaccaauagcuuucauuuauggguggauuuauaauaagucaugcaaaaaauguaaacucugugguuuaguuuaccacccauucacagaauguggaacacacuguguuuguggugcacgauaugagacaucugacagaaugaaacuacauagagcaucuggauuaugcccaggauauaagagccucagagcugcuagagugaugugcaaauccaaagguccagcaucuauuuuaucaauacugacagcaguauugauacuaacauucgugacaccuauuagcgccauaauuauugaugagucaaaagaaaucuauacccuagacgauuugccugaugauaugguccagauggcagaaaggauaaauaucuacuaucaaauacucuugauuaauuauggaguaacaugggccuucuuauuauugggcuuaaucuuagcauauuuuuuuaagaaauaucaacauaaauuucuagauuauuaugcaauguauugugaagagugugauauguaccaugaaaaaucuggcaugacauacuggggagauuucacaaauaaguguagacaguguacaugcggacaauacgaagacgcugcugggcugaugguacauaaaaagucuuacaauugucuuauaaaguauaaggcaaaauggauaaaaaauauuuugauucuauauuuaauuaugauauuaguuaaagauuccuuguuauuugucggugcaacaggaaccgauuuugcagcaugcauugaugagaagagugugacauggaauugcacaggaccauucuugaaucugggccgaugcgacaaaccucagaagaaggcaagcuuuaaagauauagcuaaucaauuaaaagguuuagguguuaucucuguguuggauaucccaaugauugagaagaugccugaugacauuucaggcucuuuaaaguacauugacaguuuaagaacauaucacgagcaauugacugcagaguaugcauuucucacuagauacugugauuauuaugcucaguacacugauaauucggguuauagccaaacaguauggcggacauauuugcggucacaugauuuuggugcauguguuguauacccuaaccagcacuucuguagaugugugaaauauggugauaaauguaauagugcaaaaugggacuuugcuaaugagaugaaaucauucuauacuggucaaaaagcuaaguuuaauaaagacuugaauuuagcacuauuaguauugcacaaggcauucagagguacagggacugcauauauugcagaaacuuuagcucggaaagauaaugguucaaugguacacuuugcauuagagauuaggaaaaaauucccaacuaaugccuuacuugcagcuuuaauagauuauauuguauacuuacaaucacuugcugagauaucuacauucgaaccagaggaggauugggaagauucuaaauaucaaccagagccuacagaaucuguucuacaaccuagggcucacagaagugaucaauauaauuuuaaaaaugcagauaguaauaguaauguuaaaguguguaaaaauauaaaaaagguuuuauguauuucaccuagauccagagcuaaauuugaaaauauaauugcuugcggagagcaugccaacccaucuguguacaugaugcccaauacuaguaucuaccaaucaaacucagagaggagucauuauuguauugcagauucacauugccuugaagaauaugaaauuguaaacacagagcuucuaacagcauucaagaaauccagauguugggcaaaagagauagaugauauuguguuacacaagcaaagugaugguuuaagaagcugcagaaucaaggacacuggaagcugcaauguguuggguaaugacuggacuauaguccugugcgaaaauggcaauuauuauuauucagaaguccauaaagauuaugauaaggaucaagauguuggacauuuuugcuuaagccccaggugcaacacaauacgauauccaauuaguaggagacauauuggagaguguaauuggcaaauuacacauuccacaauugauaagauuucgguucaagagcuagcugauauagagcaauauaaaaaagccauaucacaaaaauugcaaacuaguuugucaauauucaaguaugucaaaacaaagaaucuuccucauauuaaaccagccuacagauauauuacuguaggagguacugaaacuauagaagggguggaaaaugccuucauagaaucugaaauuccugcacuugcuggaacagcuauuggauuuaaaauaaacucaagagaaggcaauuauuugauggauguuauagguuauguuaaaagugcaucuuauucagcaacauacacaaaauuauauacaacugguccaacuauaggaauaaacacuaagcaugaugagaaauguacagguucuugcccaguuacuauaaaucauaaagaugguuggcugacauuuucaaaagaaagaaccagcacaugggguugugaagaauuuggcugucuagcaguuagcgauggguguguguuugguucuugucaagauauuauaaaagaugaguuagccguauacaggaaaaccacagaagaauuaacuacuguugaguuguguuugacguuuucagauaagacuuauuguaccgauuuaaaugcuauaaccccuauaauaacagauaaguuugagguucaauuuaagacaguagaaucauauacauugccaaggauaauagcuguaaagaaccaugaaauaagaacugggcagaucaaugaccuagguguuuauucaaaagguugcggaaauguucagaaaguaaauggaacaaguuaugguaauggugugccaaaauuugauuaucuaugccauuuggcaaguagaaaagaggucauuuugagaaagugcuuugauaaugauuaccaagccugcaaauucuuacaaaguccugcaaguuaucgccuagaagaacaucaagggacagucacaguaauagauuauaaaaaaauacuagguaguauaaagaugaaagccauguuaggugauguaaaauacaaaaauuaucaaagcaauauagagauaaaugcagaagggacuugugcaggauguauagauuguuuugagaauauccauugugaauuuacaauacauaccacuguugaagcaagcuguccuauaacgacagauuguguuucauuccaugauagaauacuaauaaccccagaagaacauaaauaugcauuaaagauaguaugucaagauaagcccaaaguaucguuaaaauucaagauuugcaacacaaacguugaagcaucaaugacaauaauagauucaaaaccgauucuagaacuugcaccaguugaucagacuacguauauuaaagaaaaagaugaaagauguaagaccuggauguguagggugagggaugaagguuuccaaguuauacuagaaccuuucaaaaauuuguuuggcucuuacaucggaauauucuauacaggaguauuaucaauuauaugucuccucauugucaucuauauaauauuaccuauuugcuacaaguugagagauacacuaaaacagcaugaagaugcuuauaaaaaagaaaugaaaauaagauag

SEQ ID NO: 4223 - RNA, 4335 nt, Artificial Sequence
  derived and/or modified CDS sequence (wt) from SORV(NJO-94F)__KX817337.1__GP
auggaaguccuaagcuugaucugguugcugacauuaugcucggcuaguccaguauuccaaagguguuuccaagauggagcuauagugaagcaaaauccaucaaaggaagcagugacagaaguuugccuuaaagaugauguaaguaugauuaagacugagacaaaauaugugaaaaacacaacugguacauuugccaacaacauugcaaugaggaaaugguuaguugcagauuggcaugauugcagaccucagaaaucaucugguggccauaucaauguuaucgaaguaggagaugaucuaucacugcauacagaaucguacauuuguagugcagauugugugaucacaguggacaaagaaacagcucagauccguuugcagacagacaacacaaaccacuuugagguugcugggacaacugugaaaucuggaugguuuaaaagcacaacguauauaacauuggaucaaacuugugagcauuuaaaaguaucauguggcccuaagucaauacaguuccaugcaugcuuuaaccaacauaugucuuguguacgauucuugcauaggacaauacucccagggucaauugcaaauucuauaugccaaaauauagaaauaauaaucuuaguuacgcugucauuaguaauauucauauucuugacuauaguaaguaagacauauaucuguuacuuauuaaugcccauauuuaucccaauagcuuuuaucuacggauggaucuauaauaagucauguaaaaaauguaaacuuugugguuuagucuaucacccguuuacugaaugcggcacacacuguguuuguggugcaagauaugaaacaucggacagaaugaaacugcauagagcaucugguuuauguccaggauacaaaagucucagagcugcuagaguaaugugcaaaucuaaaggcccagcaucaauuuuauccauuuuaacagcaauauuaauacuaacauuugucacaccuaucagugcaauggucguuggugaaucaaaugagaucuacaccuuagacgacuuaccugaugacaugguucagauggcagaaaggauaaacauuuacuaccagauacucauaauuaauuauggggugacaugggcuuucuuauugcuugguuuaguuuuagcauacuucuucaaaaaauaucaacauaaauucuuagauuauuaugcaauguacugugaggagugugacauguaccaugaaaaaucagguaugacauauuggggggauuuuacaaauaaguguaggcaaugcacaugugggcaauuugaagaugccacuggcuugauggugcauaaaaaaucuuacaacugucuuguaaaauauaaggcaaaauggauaagaaacauuuuaauugcauauuugaugauaauguugguuaaagauucgcuauuauuuguuggugcaacaagagcugacuuugcaucauguguggaugagaaaacuguaacguggaauugcacugggccauuucugaaucugggucgaugugacaaaacucaaaaaaagacaggcuauaaagacauagcuaaucaauugaagggucugggugugauuucuauacuggauauuccgaugauugagaagaugccagaugaaaucucaggaucuuuaaaauauauugacaguuuagaaacauaucaugagcagcugaccgcagaauaugcauuccucaccagguauugugauuacuacacacaauauacugacaauucagguuauagccaaacaguauggcgaaccuauuuacgaucacaugauuuuggugcauguguuguguauccaaaccaacauuuuugcagauguguaaaauauggugauaaauguaacagugcuaaaugggauuuugcuaacgagaugaagacauuuuacacuggccggaaaguaaaauucaauaaagauuuaaauuuagcauuacuagugcuacauaaggcauuuagggguacaggaacugcauauauugcagaagcuauggcccgaaaagacaaugguucaauggcacauuuugcuuuagaaauuaggaagaaguucccaacaaaugcucuacuggcagcuuuaauagacuauauuguauauuuacagucacuugcagagauaucaacauucgagcuggaagaagauugggaagacuuuaaauacaaaccugaaccaacagaaucuacucuacaaccuagaucucacagaagugaucaauauaauuuuaaaaaugcagauagcaauagcaaugucaaagucuguaaaaaugucaaaaaaguauugugugucucaccuagaucuagagcuaaauuugagaauauaauagcuuguggagagcaugccaauccaucuguauauaugaugccuaauaucaguaucuaucaauccaauucugaaaggagucauuacuguauugcagacucacacugucuugaggaguaugaaauugugaacacagagcucuugacagcacuaaagaaaucuagaugcugggcuaaggagauggaugaugucguacuacauaaacagagugauggguuaagaaguugcagaauuaaagauacugggaguuguaauguauugggcaaugacuggaccauaguuuuaugugaaaaugggaauuacuauuauucggaaauucauaaagauuacgacaaagaucaagaugucgggcauuucugucuaaguccuagaugcaguacaauacgcuauccaauuaauaggagacauauuaggaaaugugacuggcagaucucacauucaacaaucgacaaaauuucggugcaagagcuagcugauauagaacaauacaaaaaagcuauaucacaaaaauugcagacaaguuugucgauauuuaaguaugucaaaacuaaaaaccuuccacauauuaaaccugcuuauaaguauauuaccguagaggggacugagaccaucgaagggauagaaaaugccuuuauagagucugagauuccugcacuugcuggaacagcuauuggauuuaaaauaaauucaagagaggguaauuacuuaauggauguuauugguuauguuaaaagugcaucuuauucagcaacauauacaaaauuguauacaaccgggccaacuauaggaauaaauacuagacaugaugaaaaaugcacagguccuuguccuguuacuauagaccacaaagauggcugguuaacauuuucaaaggagaggaccagcacaugggguugugaagaauuuggaugcuuggcaguaagugacggauguguauuugggucuugucaagauauuaucaaagaugaauuagcuguauauagaaagaccacggaagaauugacuacuguugaauugugucuaacauuuucagacaagacuuauugcacuaacuuaaaugcuauaaccccuauaauaacagacaaguuugaaguucaauuuaaaacagucgaaucauacacauugccaagaauaauagcugugaaaaaucaugaaauuaaaguugggcaaauuaacgaucuagguguuuauucgaaaggaugugggaauguucaaaaaguaaauggaacaaauuauggcaaugggguaccaaaauucgacuaccuaugccauuuagcaaguagaaaggaaguuauuuugaggaagugcuuugauaaugauuaucaggccugcaaauuccuacaaaguccugcaagcuaucguuuagaagaacaccaagggacaguuacaguaauagauuacaaaaaaauauugggcagcauaaagaugaaagccauauuaggugauguaaaauauaaaaauuaucaaagcaauauagaaaucaaugcagaaggaacuugugcuggauguguaaauugcuuugagaauauucauugugaauuuacuauacauacuacaguugaaacaaguuguccuauaguaacagauuguguaucauuucaugauaggauacugaucacuccagaugagcacaaguacgcauugaaaauuguaugccaagauaaaccuaaagugucucuaaaauucaaaauuugcaacacaaauauugaugcuucuaugacaauaguggacucaaaaccaauuuuagaacuugcaccaguugaucaaacugcauacauuaaagaaaaagaugaaagauguaaaacuuggaugugcagagugagagaugaaggcuuccaaguuauauuagaaccauucaagaaucuguuugguucuuacaucggaauauuuuauacuggcauacuaucaguuauaugccuucucaucgucauuuauauuguauuacccauuugcuuuaaauugagggauacuuuaaagcaacaugaagaugcuuauaagaaggaaaugaaaauaagguaa

SEQ ID NO: 4224 - RNA, 4323 nt, Artificial Sequence
  derived and/or modified CDS sequence (wt) from TAHV__AF123485.1__GP
augauguucguauuguuuuucauugcacuaagugcugcaagcccaguuuaucagagguguuuccaggauggugcaaucgucaagcaaaacccauccaaacaggcuguaacagagguaugccuaaaggaugacguuaguaugauaaaaacagaagcuagauauuucagaaaugcuaccggaacauaugccaacaauguugccauuagaaaguggcuagucucagauuggcaugacugcagaccaaaaaaagucucagggggucacauaaauguuauagaaguuggagaugacuuaacgcugcauacagaggcauauguaugcaaugcagacugcacaauagguguagauaaagaaaccgcacaaguaagauugcaaacagauacaacaaaucauuuugagauagcaggaacaacaguuaagucagggugguucaaaagcacaacuuauaucacccuugaucaaacuugcgagcauuugaaaguuucuugugggccuaaaucuauacaguuccaugcguguuucaaucaacacaugucuuguguuagauucuuacauaggacaauccuaccugggucuauugccagcuccauaugccaaaauguagagauaauaauauuaacagugcuaacccuccuuauauuuauacuauuaagcauacugagcaaaacuuacauauguuauauacucaugccaauauuuaucccgcuugcuuauauauaugguguaauauauaauaaaucguguaaaaaauguaaacuaugcggauuaguuuaccaucccuucacugagugcggcacccauugcguauguggugcuagauacgagacaucggauaggaugaaauugcacagggcaucuggguugugcccagguuauaaaagucucagggcugcaagagucaugugcaaauccaaagggccagcuucuauuuuaucuauaaucacugcaguguuaauccuuacuuuugucacucccauaaaugccaugguagcuggggacacccaagaaacauuuaagcuugaggaccuaccagaugacaugcuaagcauggcaaugaaaguaaauauguacuacauuauguguaugauaaauuaugcugugacuuggucauuuauuuuaugcgcccuauuaauugcuuuacucuucaagaaguaucagcauagauucuuaaacuuuuaugccauguacugccacgagugcgauauguaccaugauagaucuggccuaaaauauaauggagacuucacaaacaaauguagacagugcacaugcgggcaguacgaagaugccgcaggucuacuaacccacagaaaaacauacaacugccucgugcaguacaaaucaaaauggcugacuaauuucuuaauuguauacauaaucuugaugcuuauuaaagauucuguacuaauagugcaugcugauggcacagacuuugaaaaaugcaguggugagguggauauaacauggaauuguacaggaccauucuugaaucuagguaauugugagaagaagcaaaagaaggagucauauaauaauauagcaacucaauuaaaagggcuagaugccauaucgguuuuagauauccccaugauaucuaaaauaccagaggauauagcuggagcccuaagauucauugaagagcaaagaucauaccauguccaacugacugcagaauaugcuaugcuaacuagauacugcgauuauuacacccaauucacugacaauucuggauacagucaaaccacauggaggguuuacuugagaucccacgauuuuaaggcauguauuuuauaucccaaucagcauuuuugcagaugugucaagcauggggacaaaugcucaagcuccaauugggauuucgccaaugagaugaagaacuacuacaguggaaaacaguccaaauuugauaaagauuuaaauuuagcauugauguccuuacaccacgcauuuagaggaacaucuaguuuuuauauugcuaaacuccugaaggaaaagaaaaaugaagaccuuguaacuuaugcagaaaagauuaaaggcaaauauccaggcaaugcccugcuaaaggcaauaauugacuacauaaaguauauggaggauuuaaccgagaugaacaauuucaaacaugaugagaugugggaugacuucauauuugaaguuccuccuacaaagagcccaucaauaagaagauuagagucuucauaugauuuuaaaacuaauguaaauucaaacccaucacacauuugcaagaauaucaaaacuguggucugcuugucaccaaagucaggagugucauaugauucaauaauugccuguggggagccaagccagccaagcauuuacagaaagccagacagccaaguuuuccaaucaaaugcugaccagacacauuuuuguuuaucagauacacacugccuggaaaauuaugagacaguuggagaggaaaucauugaugcaauuaaaaaaucgaaaugcugggaaacagaauuuacugaguacauccaauuuaaacagagugaugggguaaggaguugcaggaugaaagacucaggagaauguacagucaccaccaauagauggccuauaauacucugcgauaacgauaaauucuacuacucugaguugcagaaagauuaugauaaggaccaggauauaggucacuucugucucagcccaagaugcaacacaauuaggcacccuauaaaucggaaacauauaucaaauuguacguggcagguuagucacaacaauauagacaagauugagguacaugaacuggaggaucuugaacaguauaagaaggccauaacacagaaguugcagacaagccuaacucuauuuaaauacucaaagacaaaaaacuugccccauaucaagccuauguacaaauauauaacaauugaaggaacagagacugcugaggguuuagaaagugcuuauauagaaucagagauacccgcucuagcaggaacaucaauagguuucaagaucacauccaagucuggaaagcauuuauuagaugucauugguuauguuaagagcgcaucuuauucggccguuuauacaaaauuguauacaacaggaccuacuauagguguuaacacuaaacaugaugaauuaugcacagggccauguccugucaaugugccucauggcacagguuggcucacauuugcuaaggagaggacaagcuccugggggugugaagaauuuggcugccuggcaauuagcgauggguguguuuuugguuccugucaagauauuauaaaagaugaaauaacugucuauaggaaggagacugaggagaccacagauguggaauugugccugacauuugcagacaaaacauauugcacuaaccucaaugcaauuaccccuauaaucaccgaccaguuugaaguccaauuuaaaacuguagaggcuuacagucugccuagaaucauugcagugcggaaucaugagauuaugguugggcaaauaaaugacauagguguuuacucaaaaggcuguggaaauguacagaaaguaaacaacacaaauuauggaaauggugugccuaaguuugauuaccugugucauuuagcaaguagaaaagaagugauagugaggaaaugcuuugauaaugacuaccaggccugcaaauuucuacaaacaccagcaaguuauaggcuagaagaggagggagguucaguuacagucauagacuacaagaaaauccuuggcacuauaaagaugaaggcuauccuuggagaugugaaauauaaaacauuugcagacaauguggaccuaaccguugaggggguaugcacuggcugcaucaauuguuuugaaaauauacauugugaguuaacaauacacaguacaguugaagccagcugcccgguaguaaguucguguacaguauuucaugauagaauuuuaauaaccccaaaugagcacaaguaugcuauaaaggugaucugcaaugaaaagccagguccuacauugccguucaagaucugcagugcaaagacagaugcugcaaugacacuggcagaugcuaagccaauauuagagcuagcaccuguagaccaaacaacauauauuaaggagaaagaugaaaggugcaagacuuggaugugcagaguaagagaugaagguuuucaaguaauuuuugaaccauucaaaaacuuauuugguucuuauauugggauauuuuauacauuuauaauaucuuuaauggcaauauuuauaguuauauauauuguguugccuauauguuucaaacucagagacacacugaggcagcaugaagacgcuuauaagagagagaugaaaauuagguaa

SEQ ID NO: 4225 - RNA, 4323 nt, Artificial Sequence
  derived and/or modified CDS sequence (wt) from TAHV__AF229129.1__GP
augauguucguauuguuuuucauugcacuaagugcugcaagcccaguuuaucagagguguuuccaggauggugcaaucgucaagcaaaacccauccaaacaggcuguaacagagguaugccuaaaggaugacguuaguaugauaaaaacagaagcuagauauuucagaaaugcuaccggaacauaugccaacaauguugccauuagaaaguggcuugucucagauuggcaugacugcagaccaaaaaaagucucagggggucauauaaauguuauagaaguuggagaugacuuaacgcugcauacagaggcauauguaugcaaugcagacugcacaauagguguagauaaagaaaccgcacaaguaagauugcaaacagauacaacaaaucauuuugagauugcaggaacaacaguuaagucagggugguucaaaagcacaacuuauaucacccuugaucaaacuugcgagcauuugaaaguuucuugugggccuaaaucuauacaguuccaugcguguuucaaucaacauaugucuuguguuagauucuuacauaggacaauccuaccugggucuauugccagcuccauaugccaaaauguagagauaauaauauuaacagugcuaacccuccuuauauuuauacuauuaagcauacugaguaaaacuuacauauguuauauacucaugccaauauuuaucccgcuugcuuauauauaugguguaauauauaauaaaucguguaaaaaauguaaacuaugcggauuaguuuaccaucccuucacugagugcggcacccauugcguauguggugcuagauacgagacaucggauaggaugaaauugcacagggcaucuggguuguguccagguuauaaaagucucagggcugcaagagucaugugcaaauccaaagggccagcuucuauuuuaucuauaaucacugcaguguuaauccuuacuuuugucacucccauaaaugccaugguagcuggggacacacaagaaacauuuaagcuugaggaccuaccagaugacaugcugagcauggcaaugaaaguaaauauguacuacauuauguguaugauaaauuaugcuguaacuuggucauuuauuuuaugcgcccuauuaauugcuuuacucuucaagaaguaucagcauagauucuuaaacuuuuaugccauguacugccacgagugcgauauguaccaugauagaucuggccuaaaauauaauggagacuucacaaacaaauguagacagugcacaugcgggcaguacggagaugccgcaggucuacuaacccacagaaaaacauacaacugccucgugcaguacaaaucaaaauggcugacuaauuucuuaauuggauacauaaucuugaugcuuauuaaagauucuguacuacuagugcaugcugauggcacagacuuugaaaaaugcaguggugaggcggauauaacauggaauuguacaggaccauucuugagucuagguaauugugagaagaagcaaaagaaggagucauauaauaauauagcaacucaacuaaaagggcuagaugccauaucgguuuuagauauccccaugauaucuaaaauaccagaggauauagcuggagcccuaagauucauugaagagcaaagaucauaccauguccaacugacugcagaauaugcuaugcuaacuagauacugcgauuauuauacccaauucacugacaauucuggauacagucagaccacauggaggguuuacuugagaucccacgauuuugaggcauguauuuuauaucccaaucggcauuuuugcagaugugucaagcauggggacaaaugcucaagcuccaauugggauuucgccaaugagaugaagaacuauuacaguggaaaacaguccaaauuuaauaaggauuuaaauuuagcauugauguccuuacaccacgcauuuagaggaacaucuaguuuuuauauugcuaaacuccugaaggaaaagaaaaaugaagaccuuguaacuuaugcagaaaagauuaaaggcaaauauccaggcaaugcccugcuaaaggcaauaauugacuacauaaaguauaugaaggguuuaaccgagaugaacaauuucaaacaugaugagaugugggaugacuucauauuugaaguuccuccuacaaagagcccaucaguaagaagauuagagucuucauaugauuuuaaaacuaauguaaauucaaacccaucacacauuugcaagaauaucaaaacuguggucugcuugucaccaaagucaggagugucauaugauucaauaauugccuguggggagccaagccagccaagcaucuacagaaagccagacagucaaguuuuccaaucaaaugcugaccagacacauuuuuguuuaucagauacacacugccuggaaaauuaugagacaguuggagaggaaaucauugaugcaauuaaaaaaucgaaaugcugggaaacagaauuuacugaguacacccaacuuaaacagagugaugggguaaggaguugcaggaugaaagacucaggagaauguacagucaccaccaauagauggccuauaauacucugcgauaacgauaaauucuacuacucugaguugcagaaagauuaugauaaggaccaggauauaggucacuucugucucagcccaagaugcaacacaauuaggcacccuauaaaucggaaacauauaucaaauuguacguggcagguuaaucacaacaauauagacaagauugagguacaugaacuggaggaucuugaacaguauaagaaggccauaacacagaaguugcagacaagccuaacccuauuuaaauacucaaagacaaaaaacuugccccauaucaagccuauguacaaauauauaacaauugaaggaacagagacugcugaggguauagaaagugcuuauauagaaucagagauacccgcucuagcaggaacaucaauagguuucaagaucacauccaagucuggaaagcauuuauuagaugucauugguuauguuaagagcgcaucuuauucggccguuuauacaaaauuguauacaacaggaccuacuauagguguuaacacuaaacaugaugaauuaugcacagggccauguccugucaaugugccucauggcacagguuggcucacauuugcuaaggagaggacaagcuccugggggugugaagaauuuggcugccuggcaauuagcgauggguguguuuuugguuccugucaagauauuauaaaagaugaaauaacugucuauaggaaggagacugaggagaccacagauguggaauugugccugacauuugcagacaaaacauauugcacuaaccucaaugcaauuaccccuauaaucaccgaccaguuugaaguccaauuuaaaacuguagaggcuuacagucugccuagaaucauugcagugcggaaucaugagauuaugguugggcaaauaaaugacauagguguuuacucaaaaggcuguggaaauguacagaaaguaaacaacacaaauuauggaaauggugcaccuaaguuugauuaccugugucauuuagcaaguagaaaagaagugauagugaggaaaugcuuugauaaugacuaccaggccugcaaauuucuacaaacaccagcaaguuauaggcuagaagaagagggagguucaguuacagucauagacuacaagaaaauccuuggcacuauaaagaugaaggcuauccuuggagaugugaaauauaaaacauuugcagacaauguggacuuaaccguugaggggguaugcacuggcugcgucaauuguuuugaaaauauacauugugagucaacaauacacaguacaguugaagccagcugcccgguaauaaguucguguacaguauuucaugauagaauuuuaauaaccccaaaugagcacaaguaugcuauaaaggugaucugcaaugaaaagccagguccuacauugccguucaagaucugcagugcaaagacagaugcugcaaugacacuggcagaugcuaagccaauauuagagcuagcaccuguagaccaaacaacauauauuaaggagaaaguugaaaggugcaagacuuggaugugcagaguaagagaugaagguuuucaaguaauuuuugaaccauucaaaaacuuauuugguucuuauauugggauauuuuauacauuuauaauaucuuuaauggcaauauuuauaguuauauauauuguguugccuauauguuucaaacuuagagacacacugaggcagcaugaagacgcuuauaagagagagaugaaaauuagguaa

SEQ ID NO: 4226 - RNA, 4323 nt, Artificial Sequence
  derived and/or modified CDS sequence (wt) from TAHV(22595-6)__HM036218.1__GP
augauguucguauuguuuuucauugcacuaagugcugcaagcccaguuuaucagagguguuuccaggauggugcaaucgucaagcaaaacccauccaaacaggcuguaacagagguaugccuaaaggaugacguuaguaugauaaaaacagaagcuagauauuucagaaaugcuaccggaacauaugccaacaauguugccauuagaaaguggcuagucucagauuggcaugacugcagaccaaaaaaagucucagggggucacauaaauguuauagaaguuggagaugacuuaacgcugcauacagaggcauauguaugcaaugcagacugcacaauagguguagauaaagaaaccgcacaaguaagauugcaaacagauacaacaaaucauuuugagauagcaggaacaacaguuaagucagggugguucaaaagcacaacuuauaucacccuugaucaaacuugcgagcauuugaaaguuucuugugggccuaaaucuauacaguuccaugcguguuucaaucaacacaugucuuguguuagauucuuacauaggacaauccuaccugggucuauugccagcuccauaugccaaaauguagagauaauaauauuaacagugcuaacccuccuuauauuuauacuauuaagcauacugaguaaaacuuacauauguuauauacucaugccaauauuuaucccgcuugcuuauauauaugguguaauauauaauaaaucguguaaaaaauguaaacuaugcggauuaguuuaccaucccuucacugagugcggcacccauugcguauguggugcuagauacgagacaucggauaggaugaaauugcacagggcaucuggguugugcccagguuauaaaagucucagggcugcaagagucaugugcaaauccaaagggccagcuucuauuuuaucuauaaucacugcaguguuaauccuuacuuuugucacucccauaaaugccaugguagcuggggacacccaagaaacauuuaagcuugaggaccuaccagaugacaugcuaagcauggcaaugaaaguaaauauguacuacauuauguguaugauaaauuaugcugugacuuggucauuuauuuuaugcgcccuauuaauugcuuuacucuucaagaaguaucagcauagauucuuaaacuuuuaugccauguacugccacgagugcgauauguaccaugauagaucuggccuaaaauauaauggagacuucacaaacaaauguagacagugcacaugcgggcaguacgaagaugccgcaggucuacuaacccacagaaaaacauacaacugccucgugcaguacaaaucaaaauggcugacuaauuucuuaauuguauacauaaucuugaugcuuauuaaagauucuguacuaauagugcaugcugauggcacagacuuugaaaaaugcaguggugaggcggauauaacauggaauuguacaggaccauucuugaaucuagguaauugugagaagaagcaaaagaaggagucauauaauaauauagcaacucaauuaaaagggcuagaugccauaucgguuuuagauauccccaugauaucuaaaauaccagaggauauagcuggagcccuaagauucauugaagagcaaagaucauaccauguccaacugacugcagaauaugcuaugcuaacuagauacugcgauuauuacacccaauucacugacaauucuggauacagucaaaccacauugaggguuuacuugagaucccacgauuuuaaggcauguauuuuauaucccaaucagcauuuuugcagaugugucaagcauggggacaaaugcucaagcuccaauugggauuucgccaaugagaugaagaacuacuacaguggaaaacaguccaaauuugauaaagauuuaaauuuagcauugauguccuuacaccacgcauuuagaggaacaucuaguuuuuauauugcuaaacuccugaaggaaaagaaaaaugaagaccuuguaacuuaugcagaaaagauuaaaggcaaauauccaggcaaugcccugcuaaaggcaauaauugacuacauaaaguauauggaggauuuaaccgagaugaacaauuucaaacaugaugagaugugggaugacuucauauuugaaguuccuccuacaaagagcccaucaauaagaagauuagagucuucauaugauuuuaaaacuaauguaaauucaaacccaucacacauuugcaagaauaucaaaacuguggucugcuugucaccaaagucaggagugucauaugauucaauaauugccuguggggagccaagccagccaagcaucuacagaaagccagacagccaaguuuuccaaucaaaugcugaccagacacauuuuuguuuaucagauacacacugccuggaaaauuaugagacaguuggagaggaaaucauugaugcaauuaaaaaaucggaaugcugggaaacagaauuuacugaguacauccaauuuaaacagagugaugggguaaggaguugcaggaugaaagacucaggagaauguacagucaccaccaauagauggccuauaauacucugcgauaacgauaaauucuacuacucugaguugcagaaagauuaugauaaggaccaggauauaggucacuucugucucagcccaagaugcaacacaauuaggcacccuauaaaucggaaacauauaucaaauuguacguggcagguuagucacaacaauauagacaagauugagguacaugaacuggaggaucuugaacaguauaagaaggccauaacacagaaguugcagacaagccuaacucuauuuaaauacucaaagacaaaaaacuugccccauaucaagccuauguacaaauauauaacaauugaaggaacagagacugcugaggguauagaaagugcuuauauagaaucagagauacccgcucuagcaggaacaucaauagguuucaagaucacauccaagucuggaaagcauuuauuagaugucauugguuauguuaagagcgcaucuuauucggccguuuauacaaaauuguauacaacaggaccuacuauagguguuaacacuaaacaugaugaauuaugcacagggccauguccugucaaugugccucauggcacagguuggcucacauuugcuaaggagaggacaagcuccugggggugugaagaauuuggcugccuggcaauuagcgauggguguguuuuugguuccugucaagauauuauaaaagaugaaauaacugucuauaggaaggagacugaggagaccacagauguggaauugugccugacauuugcagacaaaacauauugcacuaaccucaaugcaauuaccccuauaaucaccgaccaguuugaaguccaauuuaaaacuguagaggcuuacagucugccuagaaucauugcagugcggaaucaugagauuaugguugggcaaauaaaugacauagguguuuacucaaaaggcuguggaaauguacagaaaguaaacaacacaaauuauggaaauggugugccuaaguuugauuaccugugucauuuagcaaguagaaaagaagugauagugaggaaaugcuuugauaaugacuaccaggccugcaaauuucuacaaacaccagcaaguuauaggcuagaagaggagggagguucaguuacagucauagacuacaagaaaauccuuggcacuauaaagaugaaggcuauccuuggagaugugaaauauaaaacauuugcagacaauguggaccuaaccguugaggggguaugcacuggcugcaucaauuguuuugaaaauauacauugugaguuaacaauacacaguacaguugaagccagcugcccgguaguaaguucguguacaguauuucaugauagaauuuuaauaaccccaaaugagcacaaguaugcuauaaaggugaucugcaaugaaaagccagguccuacauugccguucaagaucugcagugcaaagacagaugcugcaaugacacuggcagaugcuaagccaauauuagagcuagcaccuguagaccaaacaacauauauuaaggagaaagaugaaaggugcaagacuuggaugugcagaguaagagaugaagguuuucaaguaauuuuugaaccauucaaaaacuuauuugguucuuauauugggauauuuuauacauuuauaauaucuuuaauggcaauauuuauaguuauauauauuguguugccuauauguuucaaacucagagacacacugaggcagcaugaagacgcuuauaagagagagaugaaaauuagguaa

SEQ ID NO: 4227 - RNA, 4323 nt, Artificial Sequence
  derived and/or modified CDS sequence (wt) from TAHV(92' Bardos)__HM036209.1__GP
augauguucguauuguuuuucauugcacuaagugcugcaagcccaguuuaucagagguguuuccaggauggugcaaucgucaagcaaaacccauccaaacaggcuguaacagagguaugccuaaaggaugacguuaguaugauaaaaacagaagcuagauauuucagaaaugcuaccggaacauaugccaacaauguugccauuagaaaguggcuagucucagauuggcaugacugcagaccaaaaaaagucucagggggucacauaaauguuauagaaguuggagaugacuuaacgcugcauacagaggcauauguaugcaaugcagacugcacaauagguguagauaaagaaaccgcacaaguaagauugcaaacagauacaacaaaucauuuugagauagcaggaacaacaguuaagucagggugguucaaaagcacaacuuauaucacccuugaucaaacuugcgagcauuugaaaguuucuugugggccuaaaucuauacaguuccaugcguguuucaaucaacacaugucuuguguuagauucuuacauaggacaauccuaccugggucuauugccagcuccauaugccaaaauguagagauaauaauauuaacagugcuaacccuccuuauauuuauacuauuaagcauacugaguaaaacuuacauauguuauauacucaugccaauauuuaucccgcuugcuuauauauaugguguaauauauaauaaaucguguaaaaaauguaaacuaugcggauuaguuuaccaucccuucacugagugcggcacccauugcguauguggugcuagauacgagacaucggauaggaugaaauugcacagggcaucuggguugugcccagguuauaaaagucucagggcugcaagagucaugugcaaauccaaagggccagcuucuauuuuaucuauaaucacugcaguguuaauccuuacuuuugucacucccauaaaugccaugguagcuggggacacccaagaaacauuuaagcuugaggaccuaccagauaacaugcuaagcauggcaaugaaaguaaauauguacuacauuauguguaugauaaauuaugcugugacuuggucauuuauuuuaugcgcccuauuaauugcuuuacucuucaagaaguaucagcauagauucuuaaacuuuuaugccauguacugccacgagugcgauauguaccaugauagaucuggccuaaaauauaaugaagacuucacaaacaaauguagacagugcacaugcgggcaguacgaagaugccgcaggucuacuaacccacagaaaaacauacaacugccucgugcaguacaaaucaaaauggcugacuaauuucuuaauuguauacauaaucuugaugcuuauuaaagauucuguacuaauagugcaugcugauggcacagacuuugaaaaaugcaguggugaggcggauauaacauggaauuguacaggaccauucuugaaucuagguaauugugagaagaagcaaaagaaggagucauauaauaauauagcaacucaauuaaaagggcuagaugccauaucgguuuuagauaucuccaugauaucuaaaauaccagaggauauagcuggagcccuaagauucauugaagagcaaagaucauaccauguccaacugacugcagaauaugcuaugcuaacuagauacugcgauuauuacacccaauucacugacaauucuggauacagucaaaccacauggaggguuuacuugagaucccacgauuuugaggcaugcauuuuauaucccaaucagcauuuuugcagaugugucaagcauggggacaaaugcucaagcuccaauugggauuucgccaaugagaugaagaacuucuacaguggaaaacaguccaaauuugauaaagauuuaaauuuagcauugauguccuuacaccacgcauuuagaggaacaucuaguuuuuauauugcuaaacuccugaaggaaaagaaaaaugaagaccuuguaacuuaugcagaaaagauuaaaggcaaauauccaggcaaugcccugcuaaaggcaauaauugacuacauaaaguauauggaggauuuaaccgagaugaacaauuucaaauaugaugagaugugggaugacuucauauuugaaguuccuccuacaaagagcccaucaauaagaagauuagagucuucauaugauuuuaaaacuaauguaaauucaaacccaucacacauuugcaagaauaucaaaacuguggucugcuugucaccaaagucaggagugucauaugauucaauaauugccuguggggagccaagccagccaagcaucuacagaaagccagacagccaaguuuuccaaucaaaugcugaccagacacauuuuuguuuaucagauacacacugccuagaaaauuaugagacaguuggagaggaaaucauugaugcaauuaaaaaaucgaaaugcugggaaacagaauuuacugaguacauccaauuuaaacagagugaugggguaaggaguugcaggaugaaagacucaggagaauguacagucaccaccaauagauggccuauaauacucugcgauaacgauaaauucuacuacucugaguugcagaaagauuaugauaaggaccaggauauaggucacuucugucucagcccaagaugcaacacaauuaggcacccuauaaaucggaaacauauaucaaauuguacguggcagguuagucacaacaauauagacaagauugagguacaugaacuggaggaucuugaacaguauaagaaggccauaacacagaaguugcagacaagccuaacucuauuuaaauacucaaagacaaaaaacuugccccauaucaagccuauguacaaauauauaacaauugaaggaacagagacugcugaggguauagaaagugcuuauauagaaucagagauacccgcucuagcaggaacaucaauagguuucaagaucacauccaagucuggaaagcauuuauuagaugucauugguuauguuaagagcgcaucuuauucggccguuuauacaaaauuguauacaacaggaccuacuauagguguuaacacuaaacaugaugaauuaugcacagggccauguccugucaaugugccucauggcacagguuggcucacauuugcuaaggagaggacaagcuccugggggugugaagaauuuggcugccuggcaauuagcgauggguguguuuuugguuccugucaagauauuauaaaagaugaaauaacugucuauaggaaggagacugaggagaccacagauguggaauugugccugacauuugcagacaaaacauauugcacuaaccucaaugcaauuaccccuauaaucaccgaccaguuugaaguccaauuuaaaacuguagaggcuuacagucugccuagaaucauugcagugcggaaucaugagauuaugguugggcaaauaaaugacauagguguuuacucaaaaggcuguggaaauguacagaaaguaaacaacacaaauuauggaaauggugugccuaaguuugauuaccugugucauuuagcaaguagaaaagaagugauagugaggaaaugcuuugauaaugacuaccaggccugcaaauuucuacaaacaccagcaaguuauaggcuagaagaggagggagguucaguuacagucauagacuacaagaaaauccuuggcacuauaaagaugaaggcuauccuuggagaugugaaauauaaaacauuugcagacaauguggaccuaaccguugaggggguaugcacuggcugcaucaauuguuuugaaaauauacauugugaguuaacaauacacaguacaguugaagccagcugcccgguaguaaguucguguacaguauuucaugauagaauuuuaauaaccccaaaugagcacaaguaugcuauaaaggugaucugcaaugaaaagccagguccuacauugccguucaagaucugcagugcaaagacagaugcugcaaugacacuggcagaugcuaagccaauauuagagcuagcaccuguagaccaaacaacauauauuaaggagaaagaugaaaggugcaagacuuggaugugcagaguaagagaugaagguuuucaaguaauuuuugaaccauucaaaaacuuauuugguucuuauauugggauauuuuauacauuuauaauaucuuuaauggcaauauuuauaguuauauauauuguguugccuauauguuucaaacucagagacacacugaggcagcaugaagacgcuuauaagagagagaugaaaauuagguaa

SEQ ID NO: 4228 - RNA, 4323 nt, Artificial Sequence
  derived and/or modified CDS sequence (wt) from TAHV(92' Bardos)__HM036212.1__GP
augauguucguauuguuuuucauugcacuaagugcugcaagcccaguuuaucagagguguuuccaggauggugcaaucgucaagcaaaacccauccaaacaggcuguaacagagguaugccuaaaggaugacguuaguaugauaaaaacagaagcuagauauuucagaaaugcuaccggaacauaugccaacaauguugccauuagaaaguggcuagucucagauuggcaugacugcagaccaaaaaaagucucagggggucacauaaauguuauagaaguuggagaugacuuaacgcugcauacagaggcauauguaugcaaugcagacugcacaauagguguagauaaagaaaccgcacaaguaagauugcaaacagauacaacaaaucauuuugagauagcaggaacaacaguuaagucagggugguucaaaagcacaacuuauaucacccuugaucaaacuugcgagcauuugaaaguuucuugugggccuaaaucuauacaguuccaugcguguuucaaucaacacaugucuuguguuagauucuuacauaggacaauccuaccugggucuauugccagcuccauaugccaaaauguagagauaauaauauuaacagugcuaacccuccuuauauuuauacuauuaagcauacugaguaaaacuuacauauguuauauacucaugccaauauuuaucccgcuugcuuauauauaugguguaauauauaauaaaucguguaaaaaauguaaacuaugcggauuaguuuaccaucccuucacugagugcggcacccauugcguauguggugcuagauacgagacaucggauaggaugaaauugcacagggcaucuggguugugcccagguuauaaaagucucagggcugcaagagucaugugcaaauccaaagggccagcuucuauuuuaucuauaaucacugcaguguuaauccuuacuuuugucacucccauaaaugccaugguagcuggggacacccaagaaacaauuaagcuugaggaccuaccagaugacaugcuaagcacggcaaugaaaguaaauauguacuacauuauguguaugauaaauuaugcugugacuuggucauuuauuuuaugcgcccuauuaauugcuuuacucuucaagaaguaucagcauagauucuuaaacuuuuaugccauguacugccacgagugcgauauguaccaugauagaucuggccuaaaauauaaugaagacuucacaaacaaauguagacagugcacaugcgggcaguacgaagaugccgcaggucuacuaacccacagaaaaacauacaacugccucgugcaguacaaaucaaaauggcugacuaauuucuuaauuguauacauaaucuugaugcuuauuaaagauucuguacuaauagugcaugcugauggcacagacuuugaaaaaugcaguggugaggcggauauaacauggaauuguacaggaccauucuugaaucuagguaauugugagaagaagcaaaagaaggagucauauaauaauauagcaacucaauuaaaagggcuagaugccauaucgguuuuagauaucuccaugauaucuaaaauaccagaggauauagcuggagcccuaagauucauugaagagcaaagaucauaccauguccaacugacugcagaauaugcuaugcuaacuagauacugcgauuauuacacccaauucacugacaauucuggauacagucaaaccacauggaggguuuacuugagaucccacgauuuuaaggcauguauuuuauaucccaaucagcauuuuugcagaugugucaagcauggggacaaaugcucaagcuccaauugggauuccgccaaugagaugaagaacuucuacaguggaaaccaguccaaauuugauaaagauuuaaauuuagcauugauguccuuacaccacgcauuuagaggaacaucuaguuuuuauauugcuaaacuccugaaggaaaagaaaaaugaagaccuuguaacuuaugcagaaaagauuaaaggcaaauauccaggcaaugcccugcuaaaggcaauaauugacuacauaaaguauauggaggauuuaaccgagaugaacaauuucaaauaugaugagaugugggaugacuucauauuugaaguuccuccuacaaagagcccaucaauaagaagauuagagucuucauaugauuuuaaaacuaauguaaauucaaacccaucacacauuugcaagaauaucaaaacuguggucugcuugucaccaaagucaggagugucauaugauucaauaauugccuguggggagccaagccagccaagcaucuacagaaagccagacagccaaguuuuccaaucaaaugcugaccagacacauuuuuguuuaucagauacacacugccuagaaaauuaugagacaguuggagaggaaaucauugaugcaauuaaaaaaucgaaaugcugggaaacagaauuuacugaguacauccaauuuaaacagagugaugggguaaggaguugcaggaugaaagacucaggagaauguacagucaccaccaauagauggccuauaauacucugcgauaacgauaaauucuacuacucugaguugcagaaagauuaugauaaggaccaggauauaggucacuucugucucagcccaagaugcaacacaauuaggcacccuauaaaucggaaacauauaucaaauuguacguggcagguuagucacaacaauauagacaagauugagguacaugaacuggaggaucuugaacaguauaagaaggccauaacacagaaguugcagacaagccuaacucuauuuaaauacucaaagacaaaaaacuugccccauaucaagccuauguacaaauauauaacaauugaaggaacagagacugcugaggguauagaaagugccuauauagaaucagagauacccgcucuagcaggaacaucaauagguuucaagaucacauccaagucuggaaagcauuuauuagaugucauugguuauguuaagagcgcaucuuauucggccguuuauacaaaauuguauacaacaggaccuacuauagguguuaacacuaaacaugaugaauuaugcacagggccauguccugucaaugugccucauggcacagguuggcucacauuugcuaaggagaggacaagcuccugggggugugaagaauuuggcugccuggcaauuagcgauggguguguuuuugguuccugucaagauauuauaaaagaugaaauaacugucuauaggaaggagacugaggagaccacagauguggaauugugccugacauuugcagacaaaacauauugcacuaaccucaaugcaauuaccccuauaaucaccgaccaguuugaaguccaauuuaaaacuguagaggcuuacagucugccuagaaucauugcagugcggaaucaugagauuaugguugggcaaauaaaugacauagguguuuacucaaaaggcuguggaaauguacagaaaguaaacaacacaaauuauggaaauggugugccuaaguuugauuaccugugucauuuagcaaguagaaaagaagugauagugaggaaaugcuuugauaaugacuaccaggccugcaaauuucuacaaacaccagcaaguuauaggcuagaagaggagggagguucaguuacagucauagacuacaagaaaauccuuggcacuauaaagaugaaggcuauccuuggagaugugaaauauaaaacauuugcagacaauguggaccuaaccguugaggggguaugcacuggcugcaucaauuguuuugaaaauauacauugugaguuaacaauacacaguacaguugaagccagcugcccgguaguaaguucguguacaguauuucaugauagaauuuuaauaaccccaaaugagcacaaguaugcuauaaaggugaucugcaaugaaaagccagguccuacauugccguucaagaucugcagugcaaagacagaugcugcaaugacacuggcagaugcuaagccaauauuagagcuagcaccuguagaccaaacaacauauauuaaggagaaagaugaaaggugcaagacuuggaugugcagaguaagagaugaagguuuucaaguaauuuuugaaccauucaaaaacuuauuugguucuuauauugggauauuuuauacauuuauaauaucuuuaauggcaauauuuauaguuauauauauuguguugccuauauguuucaaacucagagacacacugaggcagcaugaagacgcuuauaagagagagaugaaaauuagguaa

SEQ ID NO: 4229 - RNA, 4323 nt, Artificial Sequence
  derived and/or modified CDS sequence (wt) from TAHV(Souche D C14019-29)__HM036215.1__GP
augauguucguauuguuuuucauugcacuaagugcugcaaguccaguuuaucagagguguuuccaggauggugcaauugucaagcaaaacccauccaaacaggcuguaacagagguaugccuaaaggaugacguuaguaugauaaaaacagaagcuagauauuucaaaaaugcuaccggaacauaugccaacaauguugccauuagaaaguggcuugucucagauuggcaugacugcagaccaaaaaaagucucagggggucauauaaauguuauagaaguuggagaugacuuaacgcugcauacagaggcauauguaugcaaugcagacugcacaauagguguagauaaagaaaccgcacaaguaagauugcaaacagauacaacaaaucauuuugagauugcaggaacaacaguuaagucagggugguucaaaagcacaacuuauaucacccuugaucaaacuugcgagcauuugaaaguuucuugugggccuaaaucuauacaguuccaugcguguuucaaucaacacaugucuuguguuagauucuuacauaggacaauccuaccugggucuauugccagcuccauaugccaaaauguagagauaauaauauugacaguguuaacccuccuuauauuuauacuauuaagcauacugaguaaaacuuacauauguuauauacucaugccaauauuuaucccgcuugcuuauauauaugguguaauauauaauaaaucguguaaaaaauguaagcuauguggguuaguuuaccaucccuucacugagugcggcacucauugcguauguggugcuagauacgagacaucagauaggaugaaguugcacagggcaucuggguuguguccagguuauaaaagucucagggccgcaagagucaugugcaaauccaaagggccagcuucuauuuuaucuauaaucacugcaguguuaauccuuacuuuugucacucccauaaaugccaugguagcuggggacacacaagaaacauuuaagcuugaggaccuaccagaugacaugcugagcauggcaaugaaaguaaauauguacuacauuauguguaugauaaacuaugcugugacuuggucauuuauuuuaugcgcccuauuaauugccuuacucuucaagaaguaucagcauagauucuugaacuuuuaugccauguacugccacgagugcgauauguaccaugauagaucuggccuaaaauauaauggagacuucacaaacaaauguagacagugcacaugcgggcaguacgaagaugcugcaggucuacuaacccacagaaaaacauacaacugucucgugcaguacaaaucaaaaugguugacuaauuucuuaauuguguacauaaucuugaugcuuauugaagauucuguacuaauagugcaugcugauggcacagacuuugaaaaaugcaguggugaggcggauauaacauggaauuguacaggaccauucuugaaucuagguaacugugagaagaagcaaaagaaggagucauauaauaauauagcaacucaacuaaaagggcuagaugccauaucgguuuuagauauccccaugauaucuaaaauaccagaggauauagcuggagcccuaagauucauugaagaacaaagaucguaccauguucaacugacugcagaauaugcuaugcuaacuagauacugcgacuauuauacccaauucacugacaauucuggauacagucagacuacauggaggguuuacuugaggucccacgauuuugaggcauguauuuuauaucccaaucggcauuuuugcagaugugucaagcauggggacaaaugcucaagcuccaauugggauuucgccaaugagaugaagaacuauuacaguggaaagcaguccaaauuuaauaaagauuuaaauuuagcauugauguccuuacaccacgcauuuagaggaacaucuaguuuuuauauugcuaaacuccugaaggaaaagaaaaaugaggaccuuguaacuuaugcagaaaagauuaaaggcaaauacccaggcaaugccuugcuaaaggcaauaauugacuacauaaaguauaugaaggauuuaaccgagaugaacaauuucaaacaugaugagaugugggaggacuucauauuugaaguuccuccuacaaagagcccaucagugagaagauuagagucuucauaugauuuuaaaacuaauguaaauucaaacccaucacauauuugcaagaauaucaaaacuguggucugcuugucaccaaagucaggagugucauaugauucaauaauugccuguggggagccaagucagccaagcaucuacagaaagccagacagucaaguuuuucaaucaaaugcugaccaaacacauuuuuguuuaucagauacacacugccuagaaaauuaugagacaguuggagaggaaaucauugaugcaauuaaaaaaucaaaaugcugggaaacagaauuuaccgaguacauccaauuuaaacagagugaugggguaaggaguugcaggaugaaagacucaggagaauguacagucgccaccaauagauggccuauaauacucugugauaacaacaaauucuacuacucugaguugcaggaagauuaugauaaagaccaggauauaggucacuucugucucagcccaagaugcaacacaauuaggcacccuauaaaucggaaacauauaucaaauuguacauggcagguuagucacaacaauauagauaagauugagguacaugaacuggaggaucuugaacaguauaagaaggccauaacacagaaguugcagacaagccuaaccuuauuuaaauacucaaagacaaaaaacuugccccauaucaagccuauguacaaauauauaacaauugaaggaacagagacugcugaggguauagaaagugcuuauauagaaucagagauacccgcucuagcaggaacaucaauagguuucaagaucacauccaagucuggaaagcauuuauuagaugucauugguuauguuaagagcgcaucuuauucagccguuuauacaaaauuguauacaacaggaccuacuauagguguuaacacuaaacaugaugaauuaugcacagggccauguccugucaaugugccucacggcacagguuggcucacauuugcuaaggagaggacaagcuccugggggugugaagaauuuggcugccuggcaauuagcgauggguguguuuuugguuccugucaagauauuauaaaagaugaaauaacugucuauaggaaggagacugaggagaccacagauguggaauugugccugacauuugcagacaaaacauauugcaccaaccucaaugcaauuaccccuauaaucaccgaccaguuugaaguccaauuuaaaacuguagaggcuuacagucugccuagaaucaucgcagugcggaaucaugagauuaugguugggcaaauaaaugacauagguguuuacucaaaaggcuguggaaauguacagaaaguaaacaacacaaauuauggaaauggugugccuaaguuugauuaccugugucauuuagcaaguagaaaagaagugauaguuaggaaaugcuuugauaaugacuaccaggccugcaaauuucuacaaacaccagcgaguuauaggcuagaagaggagggaggcucaguuacagucauagacuacaagaaaauccuuggcacuauaaagaugaaggcuauccuuggagaugugaaauauaaaacauuugcagacaauguagacuuaaccguugaggggguaugcacuggcugcaucaauuguuuugaaaauauacauugugaguuaacaauacacaguacaguugaagccagcuguccgguaguaaguucguguacaguauuucaugauagaauuuuaauaaccccaaaugagcacaaguaugcuauaaaggugaucugcaaugaaaagccagggccuauauugccguucaagaucugcagugcaaagacagaugcugcaaugacacuggcagaugcuaagccaauauuagagcuagcaccuguagaccaaacaacauauauuaaggagaaagaugaaaggugcaaaacuuggaugugcagaguaagagaugaggguuuccaaguaauuuuugaaccauucaaaaacuuauuugguucuuauauugggauauuuuauacauuuauaauaucuuuaauggcaauauuuauaguuauauauauuguguugccuauauguuucaaaauuagagacacacugaggcagcaugaagacgcuuauaagagagagaugaaaauuagguaa

SEQ ID NO: 4230 - RNA, 4323 nt, Artificial Sequence
  derived and/or modified CDS sequence (wt) from TAHV(1014)__GQ386833.1__GP
augauguucguauuguuuuucauugcacuaagugcugcaagcccaguuuaucagagguguuuccaggauggugcaauuguuaagcaaaacccauccaaacaggcuguaacagagguaugccuaaaggaugacguuaguaugauaaaaacagaagcuagauauuucagaaaugcuaccggaacauaugccaacaauguugccauuagaaaguggcuugucucagauuggcaugacugcagaccaaaaaaagucucagggggucauauaaauguuauagaaguuggagaugacuuaacgcugcauacagaggcauauguaugcaaugcagacugcacaauagguguagauaaagaaaccgcacaaguaagauugcaaacagauacaacaaaucauuuugagauugcaggaacaacaguuaagucagggugguucaaaagcacaacuuauaucacccuugaucaaacuugcgagcauuugaaaguuucuugugggccuaaaucuauacaguuccaugcguguuucaaucaacacaugucuuguguuagauucuuacauaggacaauccuaccugggucuauugccagcuccauaugccaaaauguagagauaauaauauuaacagugcuaacccuccuuauauuuauacuauuaagcauacugaguaaaacuuacauauguuauauacucaugccaauauuuaucccgcuugcuuauauauaugguguaauauauaauaaaucguguaaaaaauguaaacuaugcggauuaguuuaccaucccuucacugaaugcggcacccauugcguauguggugcuagauacgagacaucggauaggaugaaauugcacagggcaucuggguuguguccagguuauaaaagucucagggcugcaagagucaugugcaaauccaaagggccagcuucuauuuuaucuauaaucacagcaguguuaauccuuacuuuugucacucccauaaaugccaugguagcuggggacacacaagaaacauuuaagcuugaggaccuaccagaugacaugcugagcauggcaaugaaaguaaauauguacuacauuauguguaugauaaauuaugcuguaacuuggucauuuauuuuaugcgcccuauuaauugcuuuacucuucaagaaguaucagcauagauucuuaaacuuuuaugccauguacugccacgagugcgauauguaccaugauagaucuggccuaaaauauaauggagacuucacaaacaaauguagacagugcacaugcgggaaguacgaagaugccgcaggucuacuaacucacagaaaaacauacaacugccucgugcaguacaaaucaaaauggcugacuaauuucuuaauuguauacauaaucuugaugcuuauuaaagauucuguacuaauagugcaugcugauggcacagacuuugaaaaaugcaguggugaggcggauauaacauggaauuguacaggaccauucuugaaucuagguaauugugagaagaagcaaaagaaggagucauauaauaauauagcaacucaacuaaaagggcuagaugccauaucgguuuuagauauccccaugauaucuaaaauaccagaggauauagcuggagcccuaagauucauugaagagcaaagaucauaccauguccaacugacugcagaauaugcuaugcuaacuagauacugcgauuauuauacccaauucacugacaauucuggauacagucagaccacauggaggguuuacuugagaucccacgauuuugaggcauguauuuuauaucccaaucagcauuuuugcagaugugucaagcauggggacaaaugcucaagcuccaauugggauuucgccaaugagaugaagaacuauuacaguggaaaacaguccaaauuugauaaagauuuaaauuuagcauugauguccuuacaccacgcauuuagaggaacaucuaguuuuuauauugcuaaacuccugagggaaaagaaaaaugaagaccuuguaacuuauguagaaaagauuaaaggcaaauacccaggcaaugcccugcuaaaggcaauaauugacuacauaaaguauaugaaggguuuaaccgagaugaacaauuccaaacaugaugagaugugggaugacuucauauuugaaguuccuccuacaaagagcccaucaguaagaagauuagagucuucauaugauuuuaaaacuaauguaaauucaaacccaucacacauuugcaagaauaucaaaacuguggucugcuugucaccaaagucaggagugucauaugauucaauaauugccuguggggagccaagccagccaagcaucuacagaaagccagacagucaaguuuuccaaucaaaugcugaccagacacauuuuuguuuaucagauacacacugccuggaaaauuuugagacaguuggagaggaaaucauugaugcaauuaaaaaaucgaaaugcugggaaacagaauuuacugaguacauccaauuuaaacagagugaugggguaaggaguugcaggaugaaagacucaggagaauguacagucaccaccaauagauggccuauaauacucugcgauaacgauaaauucuacuacucugaguugcagaaagauuaugauaagggccaggauauaggucacuucugucucagcccaagaugcaacacaauuaggcacccuauaaaucggaaacauauaucaaauuguacguggcagguuaaucacaacaauauagacaagauugagguacaugaacuggaggaucuugaacaguauaagaaggccauaacacagaaguugcagacaagccuaacccuauuuaaauacucaaagacaaaaaacuugccccauaucaagccuauguacaaauauauaacaauugaaggaacagagacugcugaggguauagaaagugcuuauauagaaucagagauacccgcucuagcaggaacaucaauagguuucaagaucacauccaagucuggaaagcauuuauuagaugucauugguuauguuaagagcgcaucuuauucggccguuuauacaaaauuguauacaacaggaccuacuauagguguuaacacuaaacaugaugaauuaugcacagggccauguccugucaaugugccucauggcacagguuggcucacauuugcuaaggagaggacaagcuccugggggugugaagaauuuggcugccuggcaauuagcgauggguguguuuuugguuccugucaagauauuauaaaagaugaaauaacugucuauaggaaggagacugaggagaccacagauguggaauugugccugacauuugcagacaaaacauauugcacuaaccucaaugcaauuaccccuauaaucaccgaccaguuugaaguccaauuuaaaacuguagaggcuuacagucugccuagaaucauugcagugcggaaucaugagauuaugguugggcaaauaaaugacauagguguuuacucaaaaggcuguggaaauguacagaaaguaaacaacacaaauuauggaaauggugugccuaaguuugauuaccugugucauuuagcaaguagaaaagaagugauagugagaaaaugcauugauaaugacuaccaggccugcaaauuucuacaaacaccagcaaguuauaggcuagaagaagagggagguucaguuacagucauagacuacaagaaaauccuuggcacuauaaagaugaaggcuauccuuggagaugugaaauauaaaacauuugcagacaauguggacuuaaccguugaggggguaugcacuggcugcaucaauuguuuugaaaauauacauugugaguuaacaauacacaguacaguugaagccagcugcccgguaguaaguucguguacaguauuucaugauagaauuuuaauaaccccaaaugagcacaaguaugcuauaaaggugaucugcaaugaaaagccagguccuacauugccguucaagaucugcagugcaaagacagaugcugcaaugacacuggcagaugcuaagccaauauuagagcuagcaccuguagaccaaacaacauauauuaaggagaaagaugaaaggugcaagacuuggaugugcagaguaagagaugaagguuuucaaguaauuuuugaaccauucaaaaacuuauuugguucuuauauugggauauuuuauacauuuauaauaucuuuaauggcaauauuuauaguuauauauauuguguugccuauauguuucaaacuuagagacacacugaggcagcaugaagacgcuuauaagagagagaugaaaauuagguaa

SEQ ID NO: 4231 - RNA, 4323 nt, Artificial Sequence
  derived and/or modified CDS sequence (wt) from TAHV(105)__GQ386829.1__GP
augauguucguauuguuuuucauugcacuaagugcugcaagcccaguuuaucagagguguuuccaggauggugcaauugucaagcaaaacccauccaaacaggcuguaacagagguaugccuaaaggaugacguuaguaugauaaaaacagaagcuagauauuucagaaaugcuaccggaacauaugccaacaauguugccauuagaaaguggcuugucucagauuggcaugacugcagaccaaaaaaagucucagggggucauauaaauguuauagaaguuggagaugacuuaacgcugcauacagaggcauauguaugcaaugcagacugcacaauagguguagauaaagaaaccgcacagguaagauugcaaacagauacaacaaaucauuuugagauugcaggaacaacaguuaagucagggugguucaaaagcacaacuuauaucacccuugaucaaacuugcgagcauuugaaaguuucuugugggccuaaaucuauacaguuccaugcguguuucaaucaacacaugucuuguguuagauucuuacauaggacaauccuaccugggucuauugccagcuccauaugccaaaauguagagauaauaauauuaacagugcuaacccuccuuauauuuauacuauuaagcauacugaguaaaacuuacauauguuauauacucaugccaauauuuaucccgcuugcuuauauauaugguguaauauauaauaaaucguguaaaaaauguaaacuaugcggauuaguuuaccaucccuucacugagugcggcacccauugcguauguggugcuagauacgagacaucggauaggaugaaauugcacagggcaucuggguuguguccagguuauaaaagucucagggcugcaagagucaugugcaaauccaaagggccagcuucuauuuuaucuauaaucacugcaguguuaauccuuacuuuugucacucccauaaaugccaugguagcuggggacacacaagaaacauuuaagcuugaggaccuaccagaugacaugcugagcauggcaaugaaaguaaauauguacuacauuauguguaugauaaauuaugcuguaacuuggucauuuauuuuaugcgcccuauuaauugcuuuacucuucaagaaguaucagcauagauucuuaaacuuuuaugccauguacugccacgagugcgauauguaccaugauagaucuggccuaaaauauaauggagacuucacaaacaaauguagacagugcacaugcgggcaguacgaagaugccgcaggucuacuaacccacagaaaaacauacaacugccucgugcaguacaaaucaaaauggcugacuaauuucuuaauuguauacauaaucuugaugcuuauuaaagauucuguacuaauagugcaugcugauggcacagacuuugaaaaaugcaguggugaggcggauauaacauggaauuguacaggaccauucuugaaucuagguaauugugagaagaagcaaaagaaggagucauauaauaauauagcaacucaacuaaaagggcuagaugccauaucgguuuuagauauccccaugauaucuaaaauaccagaggauauagcuggagcccuaagauucauugaagagcaaagaucauaccauguccaacugacugcagaauaugcuaugcuaacuagauacugcgauuauuauacccaauucacugacaauucuggauacagucagaccacauggaggguuuacuugagaucccacgauuuugaggcaugcauuuuauaucccaaucagcauuuuugcagaugugucaagcauggggacaaaugcucaagcuccaauugggauuucgccaaugagaugaagaacuauuacaguggaaaacaguccaaauuugauaaagauuuaaauuuagcauugauguccuuacaccacgcauuuagaggaacaucuaguuuuuauauugcuaaacuccugaaggaaaagaaaaaugaagaccuuguaacuuaugcagaaaagauuaaaggcaaauacccaggcaaugcccugcuaaaggcaauaauugacuacauaaaguauaugaaggauuuaaccgagaugaacaauuucaaacaugaugagaugugggaugacuucauauuugaaguuccuccuacaaagagcccaucaguaagaagauuagagucuucauaugauuuuaaaacuaauguaaauucaaacccaucacacauuugcaagaauaucaaaacuguggucugcuugucaccaaagucaggagugucauaugauucaauaauugccuguggggagccaagccagccaagcaucuacagaaagccagacagucaaguuuuccaaucaaaugcugaccagacacauuuuuguuuaucagauacacacugccuggaaaauuaugagacaguuggagaggaaaucauugaugcaauuaaaaaaucgaaaugcugggaaacagaauuuacugaguacauccaauuuaaacagagugaugggguaaggaguugcaggaugaaagacucaggagaauguacagucaccaccaauagauggccuauaauacucugcgauaacgauaaauucuacuacucugaguugcagaaagauuaugauaaggaccaggauauaggucacuucugucucagcccaagaugcaacacaauuaggcacccuauaaaucggaaacauauaucaaauuguacguggcagguuagucacaacaauauagacaagauugagguacaugaacuggaggaucuugaacaguauaagaaggccauaacacagaaguugcagacaagccuaacccuauuuaaauacucaaagacaaaaaacuugccccauaucaagccuauguacaaauauauaacaauugaaggaacagagacugcugaggguauagaaagugcuuauauagaaucagagauacccgcucuagcaggaacaucaauagguuucaagaucacauccaagucuggaaagcauuuauuagaugucauugguuauguuaagagcgcaucuuauucggccguuuauacaaaauuguauacaacaggaccuacuauagguguuaacacuaaacaugaugaauuaugcacagggccauguccugucaaugugccucauggcacagguuggcucacauuugcuaaggagaggacaagcuccugggggugugaagaauuuggcugccuggcaauuagcgauggguguguuuuugguuccugucaagauauuauaaaagaugaaauaacugucuauaggaaggagacugaggagaccacagauguggaauugugccugacauuugcagacaaaacauauugcacuaaccucaaugcaauuaccccuauaaucaccgaccaguuugaaguccaauuuaaaacuguagaggcuuacagucugccuagaaucauugcagugcggaaucaugagauuaugguugggcaaauaaaugacauagguguuuacucaaaaggcuguggaaauguacagaaaguaaacaacacaaauuauggaaauggugugccuaaguuugauuaccugugucauuuagcaaguagaaaagaagugauagugaggaaaugcuuugauaaugacuaccaggccugcaaauuucuacaaacaccagcaaguuauaggcuagaagaagagggagguucaguuacagucauagacuacaagaaaauccuuggcacuauaaagaugaaggcuauccuuggagaugugaaauauaaaacauuugcagacaauguggacuuaaccguugaggggguaugcacuggcugcaucaauuguuuugaaaauauacauugugaguuaacaauacacaguacaguugaagccagcugcccgguaguaaguucguguacaguauuucaugauagaauuuuaauaaccccaaaugagcacaaguaugcuauaaaggugaucugcaaugaaaagccagguccuacauugccguucaagaucugcagugcaaagacagaugcugcaaugacacuggcagaugcuaagccaauauuagagcuagcaccuguagaccaaacaacauauauuaaggagaaagaugaaaggugcaagacuuggaugugcagaguaagagaugaagguuuucaaguaauuuuugaaccauucaaaaacuuauuugguucuuauauugggauauuuuauacauuuauaauaucuuuaauggcaauauuuauaguuauauauauuguguugccuauauguuucaaacuuagagacacacugaggcagcaugaagacgcuuauaagagagagaugaaaauuagguaa

SEQ ID NO: 4232 - RNA, 4323 nt, Artificial Sequence
  derived and/or modified CDS sequence (wt) from TAHV(106)__GQ386830.1__GP
augauguucguauuguuuuucauugcacuaagugcugcaagcccaguuuaucagagguguuuccaggauggugcaauugucaagcaaaacccauccaaacaggcuguaacagagguaugccuaaaggaugacguuaguaugauaaaaacagaagcuagauauuucagaaaugcuaccggaacauaugccaacaauguugccauuagaaaguggcuugucucagauuggcaugacugcagaccaaaaaaagucucagggggucauauaaauguuauagaaguuggagaugacuuaacgcugcauacagaggcauauguaugcaaugcagacugcacaauagguguagauaaagaaaccgcacaaguaagauugcaaacagauacaacaaaucauuuugagauugcaggaacaacaguuaagucagggugguucaaaagcacaacuuauaucacccuugaucaaacuugcgaacauuugaaaguuucuugugggccuaaaucuauacaguuccaugcguguuucaaucaacacaugucuuguguuagauucuuacauaggacaauccuacccgggucuauugccagcuccauaugccaaaauguagagauaauaauauuaacagugcuaacccuccuuauauuuauacuauuaagcauacugaguaaaacuuacauauguuauauacucaugccaauauuuaucccgcuugcuuauauauaugguguaauauauaauaaaucguguaaaaaauguaaacuaugcggauuaguuuaccaucccuucacugagugcggcacccauugcguauguggugcuagauacgagacaucggauaggaugaaauugcacagggcaucuggguuguguccagguuauaaaagucucagggcugcaagagucaugugcaaauccaaagggccagcuucuauuuuaucuauaaucacugcaguguuaauccuuacuuuugucacuccuauaaaugccaugguagcuggggacacacaagaaacauuuaagcuugaggaccuaccagaugacaugcugagcauggcaaugaaaguaaauauguacuacauuauguguaugauaaauuaugcuguaacuuggucauuuauuuuaugcgcccuauuaauugcuuuacucuucaagaaguaucagcauagauucuuaaacuuuuaugccauguacugccacgagugcgauauguaccaugauagaucuggccuaaaauauaauggagacuucacaaauaaauguagacagugcacaugcgggcaguacgaagaugccgcaggucuacuaacccacagaaaaacauacaacugccucgugcaguacaaaucaaaauggcugacuaauuucuuaauuguauacauaaucuugaugcuuauuaaagauucuguacuaauagugcaugcugauggcacagacuuugaaaaaugcaguggugaggcggauauaacauggaauuguacaggaccauucuugaaucuagguaauugugagaagaagcaaaagaaggagucauauaacaauauagcaacucaacuaaaagggcuagaugccauaucgguuuuagauauccccaugauaucuaaaauaccagaggauauagcuggagcccuaagauucauugaagagcaaagaucauaccauguccagcugacugcagaauaugcuaugcuaacuagguacugcgauuauuauacccaauucacugacaauucuggauacagucagaccacauggaggguuuacuugagaucccacgauuuugaggcauguauuuuauaucccaaucagcauuuuugcagaugugucaagcauggggacaaaugcucaagcuccaauugggauuucgccaaugagaugaagaacuauuacaguggaaaacaguccaaauuugauaaagauuuaaauuuagcauugauguccuuacaccacgcauuuagaggaacaucuaguuuuuauauugcuaaacuccugaaggaaaagaaaaaugaagaccuuguaacuuaugcagaaaagauuaaaggcaaauacccaggcaaugcccugcuaaaggcaauaauugacuacauaaaguauaugaaggguuuaaccgagaugaacaauuucaaacaugaugagaugugggaugacuucauaucugaaguuccuccuacaaagagcccaucaguaagaagauuagagucuucauaugauuuuaaaacuaauguaaauucaaacccaucacacaucugcaagaauaucaaaacuguggucugcuugucaccaaagucaggagugucauaugauucaauaauugccuguggggagccaagccagccaagcaucuacagaaagccagacagucaaguuuuccaaucaaaugcugaccagacacauuuuuguuuaucagauacacacugccuggaaaauuaugagacaguuggagaggaaaucauugaugcaauuaaaaaaucgaaaugcugggaaacagaauuuacugaguacauucaauuuaaacagagugaugggguaaggaguugcaggaugaaagacucaggagaauguacagucaccaccaauagauggccuauaauacucugcgauaacgauaaauucuacuacucugaguugcagaaagauuaugauaaggaccaggauauaggucacuucugucucagcccaagaugcaacacaauuaggcacccuauaaaucggaaacauauaucaaauuguacguggcagguuagucacaacaauauagacaagauugagguacaugaacuggaggaucuugaacaguauaagaaggccauaacacagaaguugcagacaagccuaacccuauuuaaauacucaaagacaaaaaacuugccccauaucaagccuauguacaaauauauaacaauugaaggaacagagacugcugaggguauagaaagugcuuauauagaaucagagauacccgcuuuagcaggaacaucaauagguuucaagaucacguccaagucuggaaagcauuuauuagaugucauugguuauguuaagagcgcaucuuauucagccguuuauacaaaauuguauacaacaggaccuacuauagauguuaacacuaaacaugaugaauuaugcacagggccauguccugucaaugugccucauggcacagguuggcucacauuugcuaaggagaggacaagcuccugggggugugaagaauuuggcugcuuggcaauuagcgauggguguguuuuugguuccugucaagauauuauaaaagaugaaauaacugucuauaggaaggagacugaggagaccacagauguggaauugugccugacauuugcagacaaaacauauugcacuaaccucaaugcaauuaccccuauaaucaccgaccaguuugaaguccaauuuaaaacuguagaggcuuacagucugccuagaaucauugcagugcggaaucaugagauuaugguugggcaaauaaaugacauagguguuuacucaaaaggcuguggaaauguacagaaaguaaacaacacaaauuauggaaauggugugccuaaguuugauuaccugugucauuuagcaaguagaaaagaagugauagugaggaaaugcuuugauaaugacuaccaggccugcaaauuucuacaaacaccagcaaguuacaggcuagaagaggagggagguucaguuacagucauagacuacaagaaaauccuuggcacuauaaagaugaaggcuauccuuggagaugugaaauauaaaacauuugcagacaauguggacuuaaccguugaggggguaugcacuggcugcaucaauuguuuugaaaauauacauugugaguuaacaauacacaguacaguugaagccagcugcccgguaguaaguucguguacaguauuucaugauagaauuuuaauaaccccaaaugagcacaaguaugcuauaaaggugaucugcaaugaaaagccagguccuacauugccguucaagaucugcagugcaaagacagaugcugcaaugacacuggcagaugcuaagccaauauuagagcuagcaccuguagaccaaacaacauauauuaaggagaaagaugaaaggugcaagacuuggaugugcagaguaagagaugaagguuuucaaguaauuuuugaaccauucaaaaacuuauuugguucuuauauugggauauuuuauacauuuauaauaucuuuaauggcaauauuuauaguuauauauauuguguugccuauauguuucaaacuuagagacacacugaggcagcaugaagacgcuuauaagagagagaugaaaauuagguaa

SEQ ID NO: 4233 - RNA, 4323 nt, Artificial Sequence
  derived and/or modified CDS sequence (wt) from TAHV(181)__GQ386831.1__GP
augauguucguauuguuuuucauugcacuaagugcugcaagcccaguuuaucagagguguuuccaggauggugcaauugucaagcaaaacccauccaaacaggcuguaacagagguaugccuaaaggaugacguuaguaugauaaaaacagaagcuagauauuucagaaaugcuaccggaacauaugccaacaauguugccauuagaaaguggcuugucucagauuggcaugacugcagaccaaaaaaagucucagggggucauauaaauguuauagaaguuggagaugacuuaacgcugcauacagaggcauauguaugcaaugcagacugcacaauagguguagauaaagaaaccgcacaaguaagauugcaaacagauacaacaaaucauuuugagauugcaggaacaacaguuaagucagggugguucaaaagcacaacuuauaucacccuugaucaaacuugcgagcauuugaaaguuucuugugggccuaaaucuauacaguuccaugcguguuucaaucaacauaugucuuguguuagauucuuacauaggacaauccuaccugggucuauugccagcuccauaugccaaaauguagagauaauaauauuaacagugcuaacccuccuuauauuuauacuauuaagcauacugaguaaaacuuacauauguuauauacucaugccaauauuuaucccgcuugcuuauauauaugguguaauauauaauaaaucguguaaaaaauguaaacuaugcggauuaguuuaccaucccuucacugagugcggcacccauugcguauguggugcuagauacgagacaucggauaggaugaaauugcacagggcaucuggguuguguccagguuauaaaagucucagggcugcaagagucaugugcaaauccaaagggccagcuucuauuuuaucuauaaucacugcaguguuaauccuuacuuuugucacucccauaaaugccaugguagcuggggacacacaagaaacauuuaagcuugaggaccuaccagaugacaugcugagcauggcaaugaaaguaaauauguacuacauuauguguaugauaaauuaugcuguaacuuggucauuuauuuuaugcgcccuauuaauugcuuuacucuucaagaaguaucagcauagauucuuaaacuuuuaugccauguacugccacgagugcgauauguaccaugauagaucuggccuaaaauauaauggagacuucacaaacaaauguagacagugcacaugcgggcaguacggagaugccgcaggucuacuaacccacagaaaaacauacaacugccucgugcaguacaaaucaaaauggcugacuaauuucuuaauuggauacauaaucuugaugcuuauuaaagauucuguacuaauagugcaugcugauggcacagacuuugaaaaaugcaguggugaggcggauauaacauggaauuguacaggaccauucuugaaucuagguaauugugagaagaagcaaaagaaggagucauauaauaauauagcaacucaacuaaaagggcuagaugccauaucgguuuuagauauccccaugauaucuaaaauaccagaggauauagcuggagcccuaagauucauugaagagcaaagaucauaccauguccaacugacugcagaauaugcuaugcuaacuagauacugcgauuauuauacccaauucacugacaauucuggauacagucagaccacauggaggguuuacuugagaucccacgauuuugaggcauguauuuuauaucccaaucggcauuuuugcagaugugucaagcauggggacaaaugcucaagcuccaauugggauuucgccaaugagaugaagaacuauuacaguggaaaacaguccaaauuugauaaagauuuaaauuuagcauugauguccuuacaccacgcauuuagaggaacaucuaguuuuuauauugcuaaacuccugaaggaaaagaaaaaugaagaccuuguaacuuaugcagaaaagauuaaaggcaaauauccaggcaaugcccugcuaaaggcaauaauugacuacauaaaguauaugaaggguuuaaccgagaugaacaauuucaaacaugaugagaugugggaugacuucauauuugaaguuccuccuacaaagagcccaucaguaagaagauuagagucuucauaugauuuuaaaacuaauguaaauucaaacccaucacacauuugcaagaauaucaaaacuguggucugcuugucaccaaagucaggagugucauaugauucaauaauugccuguggggagccaagccagccaagcaucuacagaaagccagacagucaaguuuuccaaucaaaugcugaccagacacauuuuuguuuaucagauacacacugccuggaaaauuaugagacaguuggagaggaaaucauugaugcaauuaaaaaaucgaaaugcugggaaacagaauuuacugaguacauccaauuuaaacagagugaugggguaaggaguugcaggaugaaagacucaggagaauguacagucaccaccaauagauggccuauaauacucugcgauaacgauaaauucuacuacucugaguugcagaaagauuaugauaaggaccaggauauaggucacuucugucucagcccaagaugcaacacaauuaggcacccuauaaaucggaaacauauaucaaauuguacguggcagguuaaucacaacaauauagacaagauugagguacaugaacuggaggaucuugaacaguauaagaaggccauaacacagaaguugcagacaagccuaacccuauuuaaauacucaaagacaaaaaacuugccccauaucaagccuauguacaaauauauaacaauugaaggaacagagacugcugaggguauagaaagugcuuauauagaaucagagauacccgcucuagcaggaacaucaauagguuucaagaucacauccaagucuggaaagcauuuauuagaugucauugguuauguuaagagcgcaucuuauucggccguuuauacaaaauuguauacaacaggaccuacuauagguguuaacacuaaacaugaugaauuaugcacagggccauguccugucaaugugccucauggcacagguuggcucacauuugcuaaggagaggacaagcuccugggggugugaagaauuuggcugccuggcaauuagcgauggguguguuuuugguuccugucaagauauuauaaaagaugaaauaacugucuauaggaaggagacugaggagaccacagauguggaauugugccugacauuugcagacaaaacauauugcacuaaccucaaugcaauuaccccuauaaucaccgaccaguuugaaguccaauuuaaaacuguagaggcuuacagucugccuagaaucauugcagugcggaaucaugagauuaugguugggcaaauaaaugacauagguguuuacucaaaaggcuguggaaauguacagaaaguaaacaacacaaauuauggaaaugguguaccuaaguuugauuaccugugucauuuagcaaguagaaaagaagugauagugaggaaaugcuuugauaaugacuaccaggccugcaaauuucuacaaacaccagcaaguuauaggcuagaagaagagggagguucaguuacagucauagacuacaagaaaauccuuggcacuauaaagaugaaggcuauccuuggagaugugaaauauaaaacauuugcagacaauguggacuuaaccguugaggggguaugcacuggcugcaucaauuguuuugaaaauauacauugugaguuaacaauacacaguacaguugaagccagcugcccgguaguaaguucguguacaguauuucaugauagaauuuuaauaaccccaaaugagcacaaguaugcuauaaaggugaucugcaaugaaaagccagguccuacauugccguucaagaucugcagugcaaagacagaugcugcaaugacacuggcagaugcuaagccaauauuagagcuagcaccuguagaccaaacaacauauauuaaggagaaagaugaaaggugcaagacuuggaugugcagaguaagagaugaagguuuucaaguaauuuuugaaccauucaaaaacuuauuugguucuuauauugggauauuuuauacauuuauaauaucuuuaauggcaauauuuauaguuauauauauuguguugccuauauguuucaaacuuagagacacacugaggcagcaugaagacgcuuauaagagagagaugaaaauuagguaa

SEQ ID NO: 4234 - RNA, 4323 nt, Artificial Sequence
  derived and/or modified CDS sequence (wt) from TAHV(236)__GQ386832.1__GP
augauguucguauuguuuuucauugcacuaagugcugcaagcccaguuuaucagagguguuuccaggauggugcaauugucaagcaaaacccauccaaacaggcuguaacagagguaugccuaaaggaugacguuaguaugauaaaaacagaagcuagauauuucagaaaugcuaccggaacauaugccaacaauguugccauuagaaaguggcuugucucagauuggcaugacugcagaccaaaaaaagucucagggggucauauaaauguuauagaaguuggagaugacuuaacgcugcauacagaggcauauguaugcaaugcagacugcacaauagguguagauaaagaaaccgcacaaguaagauugcaaacagauacaacaaaucauuuugagauugcaggaacaacaguuaagucagggugguucaaaagcacaacuuauaucacccuugaucaaacuugcgagcauuugaaaguuucuugugggccuaaaucuauacaguuccaugcguguuucaaucaacacaugucuuguguuagauucuuacauaggacaauccuaccugggucuauugccagcuccauaugccaaaauguagagauaauaauauuaacagugcuaacccuccuuauauuuauacuauuaagcauacugaguaaaacuuacauauguuauauacucaugccaauauuuaucccgcuugcuuauauauaugguguaauauauaauaaaucguguaaaaaauguaaacuaugcggauuaguuuaccaucccuucacugagugcggcacccauugcguauguggugcuagauacgagacaucagauaggaugaaauugcacagggcaucuggguuguguccagguuauaaaagucucagggcugcaagagucaugugcaaauccaaagggccagcuucuauuuuaucuauaaucacugcgguguuaauccuuacuuuugucacucccauaaaugccaugguagcuggggacacacaagaaacauuuaagcuugaggaccuaccagaugacaugcugagcauggcaaugaaaguaaauauguacuacauuauguguaugauaaauuaugcuauaacuuggucauuuauuuuaugcgcccuauuaauugcuuuacucuucaagaaguaucagcauagauucuuaaacuuuuaugccauguacugccacgagugcgauauguaccaugauagaucuggccuaaaauauaauggagacuucacaaacaaauguagacagugcacaugcgggcaguacgaagaugccgcaggucuacuaacccacagaaaaacauacaacugccucgugcaguacaaaucaaaauggcugacuaauuucuuaauuguauacauaaucuugaugcuuauuaaagauucuguacuaauagugcaugcugauggcacagacuuugaaaaaugcaguggugaggcggauauaacauggaauuguacaggaccauucuugaaucuagguaauugugagaagaagcaaaagaaggagucauauaauaauauagcaacucaauuaaaagggcuagaugccauaucgguuuuagauaugcccaugauaucuaaaauaccagaggauauagcuggagcccuaagauucauugaagagcaaagaucauaccauguccaacugacugcagaauaugcuaugcuaacuagauacugcgauuauuacacccaauucacugacaauucuggauacagucaaaccacauggaggguuuacuugagaucccacgauuuugaggcauguauuuuauaucccaaucagcauuuuugcagaugugucaagcauggggacaaaugcucaagcuccaauugggauuucgccaaugagaugaagaacuacuacaguggaaaacaguccaaauuugauaaagauuuaaauuuagcauugauguccuuacaccacgcauuuagaggaacaucuaguuuuuauauugcuaaacuccugaaggaaaagaaaaaugaagaccuuguaacuuaugcagaaaagauuaaaggcaaauacccaggcaaugcccugcuaaaggcaauaauugacuacauaaaguauaugaaggauuuaaccgagaugaacaauuucaaacaugaugagaugugggaugacuucauauuugaaguuccuccuacaaagagcccaucaguaagaagauuagaaucuucauaugauuuuaaaacuaauguaaauucaaacccaucacacauuugcaagaauaucaaaacugugaucugcuugucaccaaagucaggagugucauaugauucaauaauugccuguggggagccaagccagccaagcaucuacagaaagccagacagccaaguuuuccaaucaaaugcugaccagacacauuuuuguuuaucagauacacacugccuggaaaauuaugagacaguuggagaggaaaucauugaugcaauuaaaaaaucgaaaugcugggaaacagaacuuacugaguacauccaauuuaaacagagugaugggguaaggaguugcaggaugaaagacucaggagaauguacagucaccaccaauagauggccuauaauacucugcgauaacgauaaauucuacuacucugaguugcagaaagauuaugauaaggaccaggauauaggucacuucugucucagcccaagaugcaacacaauuaggcacccuauaaaucggaaacauauaucaaauuguacguggcagguuagucacaacaauauagacaagauugagguacaugaacuggaggaucuugaacaguauaagaaggccauaacacagaaguugcagacaagccuaacccuauuuaaauacucaaagacaaaaaacuugccccauaucaagccuauguacaaauauauaacaauugaaggaacagagacugccgaggguauagaaagugcuuauauagaaucagagauacccgcucuagcaggaacaucaauagguuucaagaucacauccaagucuggaaagcauuuauuagaugucauugguuauguuaagagcgcaucuuauucggcuguuuauacaaaauuguauacaacaggaccuacuauagguguuaacacuaaacaugaugaauuaugcacagggccauguccugucaaugugccucauggcacagguuggcucacauuugcuaaggagaggacaagcuccugggggugugaagaauuuggcugccuggcaauuagcgauggguguguuuuuggcuccugucaagauauuauaaaagaugaaauaacugucuauaggaaggagacugaggagaccacagauguggaauugugccugacauuugcagacaaaacauauugcacuaaccucaaugcaauuaccccuauaaucaccgaccaguuugaaguccaauuuaaaacuguagaggcuuacagucugccuagaaucauugcagugcggaaucaugagauuaugguugggcaaauaaaugacauagguguuuacucaaaaggcuguggaaauguacagaaaguaaacaacacaaauuauggaaauggugugccuaaguuugauuaccugugucauuuagcaaguagaaaagaagugauagugaggaaaugcuuugauaaugacuaccaggccugcaaauuucuacaaacaccagcaaguuauaggcuagaagaggagggaaguucaguuacagucauagacuacaagaaaauccuuggcacuauaaagaugaaggcuauccuuggagaugugaaauauaaaacauuugcagacaauguggacuuaaccguugaggggguaugcacuggcugcaucaauuguuuugaaaauauacauugugaguuaacaauacacaguacaguugaagccagcugcccgguaguaaguucguguacaguauuucaugauagaauuuuaauaaccccaaaugagcacaaguaugcuauaaaggugaucugcaaugaaaagccagguccuacauugccguucaagaucugcagugcaaagacagaugcugcaaugacacuggcagaugcuaagccaauauuagagcuagcaccuguagaccaaacaacauauauuaaggagaaagaugaaaggugcaagacuuggaugugcagaguaagagaugaagguuuccaaguaauuuuugaaccauucaaaaacuuauuugguucuuauauugggauauuuuauacauuuauaauaucuuuaauggcaauauuuauaguuauauauauuguguugccuauauguuucaaacucagagacgcacugaggcagcaugaagacgcuuauaagagagagaugaaaauuagguaa

SEQ ID NO: 4235 - RNA, 4323 nt, Artificial Sequence
  derived and/or modified CDS sequence (wt) from TAHV(29)__GQ386823.1__GP
augauguucguauuguuuuucauugcacuaagugcugcaagcccaguuuaucagagguguuuccaggauggugcaauugucaagcaaaacccauccaaacaggcuguaacagagguaugccuaaaggaugacguuaguaugauaaaaacagaagcuagauauuucagaaaugcuaccggaacauaugccaacaauguugccauuagaaaguggcuugucucagauuggcaugacugcagaccaaaaaaagucucagggggucauauaaaugucauagaaguuggagaugacuuaacgcuacauacagaggcauauguaugcaaugcagacugcacaauagguguagauaaagaaaccgcacaaguaagauugcaaacagauacaacaaaucauuuugagauugcaggaacaacaguuaagucagggugguucaaaagcacaacuuauaucacccuugaucaaacuugcgagcauuugaaaguuucuugugggcccaaaucuauacaguuccaugcguguuucaaucaacacaugucuuguguuagauucuuacauaggacaauccuaccugggucuauugccagcuccauaugccaaaauguagagauaauaauauuaacagugcuaacccuccuuauauuuauacuauuaagcauacugaguaaaacuuacauauguuauauacucaugccaauauuuaucccgcuugcuuauauauaugguguaauauauaauaaaucguguaaaaaauguaaacuaugcggauuaguuuaccauccuuucacugagugcggcacccauugcguauguggugcuagauacgagacaucggauaggaugaaauugcacagggcaucuggguuguguccagguuauaaaagucucagggcugcaagagucaugugcaaauccaaagggccagcuucuauuuuaucuauaaucacugcaguguuaauccuuacuuuugucacucccauaaaugccaugguagcuggggacacacaagaaacauuuaagcuugaggaccuaccagaugacaugcugagcauggcaaugaaaguaaauauguacuacauuauguguaugauaaauuaugcuguaacuuggucauuuauuuuaugcgcccuauuaauugcuuuacucuucaagaaguaucagcauagauucuuaaacuuuuaugccauguacugccacgagugcgauauguaccaugauagaucuggccuaaaauauaauggagacuucacaaacaaauguagacagugcacaugcggacaguacgaagaugccgcaggucuacuaacccacagaaaaacauacaacugccucgugcaguacaaaucaaaauggcugacuaauuucuuaauuguauacauaaucuugaugcuuauuaaagauucuguacuaauagugcaugcugauggcacagacuuugaaaaaugcaguggugaggcggauauaacauggaauuguacaggaccauucuugaaucuagguaauugugagaagaagcaaaagaaggagucauaugauaauauagcaacucaacuaaaagggcuagaugccauaucgguuuuagauauccccaugauaucuaaaauaccagaggauauagcuggagcccuaagauucauugaagagcaaagaucauaccauguccaacugacugcagaauaugcuaugcuaacuagauacugcgauuauuauacccaauucacugacaauucuggauacagucagaccacauggaggguuuacuugagaucccacgauuuugaggcauguauuuuauaucccaaucagcauuuuugcagaugugucaagcauggggacaaaugcucaagcuccaauugggauuucgccaaugagaugaagaacuauuacaguggaaaacaguccaaauuugauaaagauuuaaauuuagcauugauguccuuacaccacgcauuuagaggaacaucuaguuuuuauauugcuaaacuccugaaggaaaagaaaaaugaagaccuuguaacuuaugcagaaaagauuaaaggcaaauacccaggcaaugccuugcuaaaggcaauaauugacuacauaaaguauaugaaggauuuaaccgagaugaacaauuucaaacaugaugagaugugggaugacuucauauuugaaguuccuccuacaaagagcccaucaguaagaagauuagagucuucauaugauuuuaaaacuaauguaaauucaaacccaucacacauuugcaagaauaucaaaacuguggucugcuugucaccaaagucaggagugucauaugauucaauaauugccuguggggagccaagccagccaagcaucuacagaaagccagacagucaaguuuuccaaucaaaugcagaccagacacauuuuuguuuaucagauacacacugccuggaaaauuaugagacaguuggagaggaaaucauugaugcaauuaaaaaaucgaaaugcugggaaacagaauuuacugaguacauccaauuuaaacagagugaugggguaaggaguugcaggaugaaagauucaggagaauguacagucaccaccaauagauggccuauaauacucugcgauaacgauaaauucuacuacucugaguugcagaaagauuaugauaaggaccaggauauaggucacuucugucucagcccaagaugcaacacaauuaggcacccuauaaaucggaaacauauaucaaauuguacguggcagguuagucacaacaauauagacaagauugagguacaugaacuggaggaucuugaacaguauaagaaggccauaacacagaaguugcagacaagccuaacccuauuuaaauacucaaagacaaaaaacuugccccauaucaagccuauguacaaauauauaacaauugaaggaacagagacugcugaggguauagaaagugcuuauauagaaucagagauacccgcucuagcaggaacaucaauagguuucaagaucacauccaagucuggaaagcauuuauuagaugucauugguuauguuaagagcgcaucuuauucagccguuuauacaaaauuguauacaacaggaccuacuauagguguuaacacuaaacaugaugaauuaugcacagggccauguccugucaauaugccucauggcacagguuggcucacauuugcuaaggagaggacaagcuccugggggugugaagaauuuggcugccuggcaauuagcgauggguguguuuuugguuccugucaagauauuauaaaagaugaaauaacugucuauaggaaggagacugaggagaccacagauguggaauugugccugacauuugcagauaaaacauauugcacuaaccucaaugcaauuaccccuauaaucaccgaccaguuugaaguccaauuuaaaacuguagaggcuuacagucugccuagaaucauugcagugcggaaucaugagauuaugguugggcaaauaaaugacauagguguuuacucaaaaggcuguggaaauguacagaaaguaaacaacacaaauuauggaaauggugugccuaaguuugauuaccugugucauuuagcaaguagaaaagaagugauagugaggaaaugcuuugauaaugacuaccaggccugcaaauuucuacaaacaccagcaaguuauaggcuagaagaggagggagguucaguuacagucauagacuacaagaaaauacuuggcacuauaaagaugaaggcuauccuuggagaugugaaauauaaaacauuugcagacaauguggacuuaaccguugaggggguaugcacuggcugcaucaauuguuuugaaaauauacauugugaguuaacaauacacaguacaguugaagccagcugcccgguaguaaguucguguacaguauuucaugauagaauuuuaauaaccccaaaugagcacaaguaugcuauaaaggugaucugcaaugaaaagccagguccuacauugccguucaagaucugcagugcaaagacagauguugcaaugacacuggcagaugcuaagccaauauuagagcuagcaccuguagaccaaacaacauauauuaaggagaaagaugaaaggugcaagacuuggaugugcagaguaaaagaugaagguuuucaaguaauuuuugaaccauucaaaaacuuauuugguucuuauauugggauauuuuauacauuuauaauaucuuuaauggcaauauuuauaguuauauauauuguguugccuauauguuucaaacuuagagacacacugaggcagcaugaagacgcuuauaagagagagaugaaaauuagguaa

SEQ ID NO: 4236 - RNA, 4323 nt, Artificial Sequence
  derived and/or modified CDS sequence (wt) from TAHV(4019)__GQ386834.1__GP
augauguucguauuguuuuuuauugcacuaagugcugcaagcccaguuuaucagagguguuuccaggauggugcaauugucaagcaaaacccauccaaacaggcuguaacagagguaugccuaaaggaugacguuaguaugauaaaaacagaagcuagauauuucagaaaugcuaccggaacauaugccaacaauguugccauuagaaaguggcuugucucagauuggcaugacugcagaccaaaaaaagucucagggggucauauaaauguuauagaaguuggagaugacuuaacgcugcauacagaggcauauguaugcaaugcagacugcacaauagguguagauaaagaaaccgcacaaguaagauugcaaacagauacaacaaaucauuuugagauugcaggaacaacaguuaagucagggugguucaaaagcacaacuuauaucacccuugaucaaacuugcgagcauuugaaaguuucuugugggccuaaaucuauacaguuccaugcguguuucaaucaacacaugucuuguguuagauucuuacauaggacaauccuaccagggucuauugccagcuccauaugccaaaauguagagauaauaauauuaacagugcuaacccuccuuauauuuauacuauuaagcauacugaguaaaacuuacauauguuauauacucaugccaauauuuaucccgcuugcuuauauauaugguguaauauauaauaaaucguguaaaaaauguaaacuaugcggauuaguuuaccaucccuucacugagugcggcacccauugcguauguggugcuagauacgagacaucggauaggaugaaauugcacagggcaucuggguuguguccagguuauaaaagucucagggcugcaagagucaugugcaaauccaaagggccagcuucuauuuuaucuauaaucacugcaguguuaauccuuacuuuugucacucccauaaaugcuaugguagcuggggacacacaagaaacauuuaagcuugaggaccuaccagaugacaugcugagcauggcaaugaaaguaaauauguacuacauuauguguaugauaaauuaugcuguaacuuggucauuuauuuuaugcgcccuauuaauugcuuuacucuucaagaaguaucagcauagauucuuaaacuuuuaugccauguacugccacgagugcgauauguaccaugauagaucuggccuaaaauauaauggagacuucacaaacaaauguagacagugcacaugcgggcaguacgaagaugccgcaggucuacuaacccacagaaaaacauacaacugccucgugcaguacaaaucaaaauggcugacuaauuucuuaauuguauacauaaucuugaugcuuauuaaagauucuguacuaauagugcaugcugauggcacagacuuugaaaaaugcaguggugaggcggauauaacauggaauuguacaggaccauucuugaaucuagguaauugugagaagaagcaaaagaaggagucauauaauaauauagcaacucaacuaaaagggcuagaugccauaucgguuuuagauauccccaugauaucuaaaauaccagaggauauagcuggagcccuaagauucauugaagagcaaagaucauaccauguccaacugacugcagaauaugcuaugcuaacuagauauugcgauuauuauacccaauucacugacaauucuggauacagucagaccacauggaggguuuacuugagaucccacgauuuugaggcauguauuuuauaucccaaucggcauuuuugcagaugugucaagcauggggacaaaugcucaagcuccaauugggauuucgcuaaugagaugaagaacuauuacaguggaaaacaguccaaauuugauaaagauuuaaauuuagcauugauguccuuacaccacgcauuuagaggaacaucuaguuuuuauauugccaaacuccugaaggaaaagaaaaaugaagaccuuguaacuuaugcagaaaagauuaaaggcaaauacccaggcaaugccuugcuaaaggcaauaauugacuacauaaaguauaugaaggauuuaaccgagaugaacaauuucaaacaugaugagaugugggaugacuccauauuugaaguuccuccuacaaagagcccaucaguaagaagauuagagucuucauaugauuuuaaaacuaauguaaauucaaacccaucacacauuugcaagaauaucaaaacuguggucugcuugucaccaaagucaggagugucauaugauucaauaauugccuguggggagccaagccagccaagcaucuacagaaagccagacagucaaguuuuccaaucaaaugcugaccagacacauuuuuguuuaucagauacacacugccuggaaaauuaugaggcaguuggagaggaaaucauugaugcaauuaaaaaaucgaaaugcugggaaacagaauuuacugaguacauccaauuuaaacagagugaugggguaaggaguugcaggaugaaagacucaggagaauguacagucaccaccaauagauggccuauaauacucugcgauaacgauaaauucuacuacucugaguugcagaaagauuaugauaaggaccaggauauaggucacuucugucucagcccaagaugcaacacaauuaggcacccuauaaaucggaaacauauaucaaauuguacauggcagguuagucacaacaauauagacaagauugagguacaugaacuggaggaucuugaacaguauaagaaggccauaacacagaaguugcagacaagccuaacccuauuuaaauacucaaagacaaaaaacuugccccauaucaagccuauguacaaauauauaacaauugaaggaacagagacugcugaggguauagaaagugcuuauauagaaucagagauacccgcucuagcaggaacaucaauagguuucaagaucacauccaagucuggaaagcauuuauuagaugucauuaguuauguuaagagcgcaucuuauucagccguuuauacaaaauuguauacaacaggaccuacuauagguguuaacacuaaacaugaugaauuaugcacagggccauguccuguuaaugugccucauggcacagguuggaucacauuugcuaaggagaggacaagcuccuggggaugugaagaauuuggcugccuggcaauuagcgauggguguguuuuugguuccugucaagauauuauaaaagaugaaauaacugucuauaggaaggagacugaagagaccacagauguggaauugugccugacauuugcagacaaaacauauugcacuaaccucaaugcaauuaccccuauaaucaccgaccaguuugaaguccaauuuaaaacuguagaggcuuacagucugccuagaaucauugcagugcggaaucaugagauuaugguugggcaaauaaaugacauagguguuuacucaaaaggcuguggaaauguacagaaaguaaacaacacaaauuauggaaauggugugccuaaguuugauuaccugugucauuuagcaaguagaaaagaagugauagugaggaaaugcuuugauaaugacuaccaggccugcaaauuucuacaaacaccagcgaguuauaggcuagaagaggagggagguucaguuacagucauagacuacaagaaaauccuuggcacuauaaagaugaaggcuauccuuggagaugugaaauauaaaacauuugcagacaauguggacuuaaccguugaggggguaugcacuggcugcaucaauuguuuugaaaauauacauugugaguuaacaauacacaguacaguugaagccagcugcccgguaguaaguucguguacaguauuucaugauagaauuuuaauaaccccaaaugagcacaaguaugcuauaaaggugaucugcaaugaaaagccagguccuacauugccguucaagaucugcagugcaaagacagaugcugcaaugacacuggcagaugcuaagccaauauuagagcuagcaccuguagaccaaacaacauauauuaaggagaaagaugaaaggugcaagacuuggaugugcagaguaagagaugaagguuuucaaguaauuuuugaaccauucaaaaacuuauuugguucuuauauugggauauuuuauacauuuauaauaucuuuaauggcaauauuuauaguuauauauauuguguugccuauauguuucaaacuuagagacacacugaggcagcaugaagacgcuuauaagagagagaugaaaauuagguaa

SEQ ID NO: 4237 - RNA, 4323 nt, Artificial Sequence
  derived and/or modified CDS sequence (wt) from TAHV(4020)__GQ386835.1__GP
augauguucguauuguuuuucauugcacuaagugcugcaagcccaguuuaucagagguguuuccaggauggugcaauugucaagcaaaacccauccaaacaggcuguaacagagguaugccuaaaggaugacguuaguaugauaaaaacagaagcuagauauuucagaaaugcuaccggaacauaugccaacaauguugccauuagaaaguggcuugucucagauuggcaugacugcagaccaaaaaaagucucagggggucauauaaauguuauagaaguuggagaugacuuaacgcugcauacagaggcauauguaugcaaugcagacugcacaauagguguagauaaagaaaccgcacaaguaagauugcaaacagauacaacaaaucauuuugagauugcaggaacaacaguuaagucagggugguucaaaagcacaacuuauaucacccuugaucaaacuugcgagcauuugaaaguuucuugugggccuaaaucuauacaguuccaugcguguuucaaucaacacaugucuuguguuagauucuuacauaggacaauccuaccugggucuauugccagcuccauaugccaaaauguagagauaauaauauuaacagugcuaacccuccuuauauuuauacuauuaagcauacugaguaaaacuuacauauguuauauacucaugccaauauuuaucccgcuugcuuauauauaugguguaauauauaauaaaucguguaaaaaauguaaacuaugcggauuaguuuaccaucccuucacugagugcggcacccauugcguauguggugcuagauacgagacaucggauaggaugaaauugcacagggcaucuggguuguguccagguuauaaaagucucagggcugcaagagucaugugcaaauccaaagggccagcuucuauuuuaucuauaaucacugcaguguuaauccuuacuuuugucacuccuauaaaugccaugguagcuggggacacacaagaaacauuuaagcuugaggaccuaccagaugacaugcugagcauggcaaugaaaguaaauauguacuacauuauguguaugauaaauuaugcuguaacuuggucauuuauuuuaugcgcccuauuaauugcuuuacucuucaagaaguaucagcauagauucuuaaacuuuuaugccauguacugccacgagugcgacauguaccaugauagaucuggccuaaaauauaauggagacuucacaaacaaauguagacagugcacaugcgggcaguacgaagaugccgcaggucuacuaacccacagaaaaacauacaacugccucgugcaguacaaaucaaaauggcugacuaauuucuuaauuguauacauaaucuugaugcuuauuaaagauucuguacuaauagugcaugcugauggcacagacuuugaaaaaugcaguggugaggcggauauaacauggaauuguacaggaccauucuugaaucuagguaauugugagaagaagcaaaagaaggagucauauaacaauauagcaacucaacuaaaagggcuagaugccauaucgguuuuagauauccccaugauaucuaaaauaccagaggauauagcuggagcccuaagauucauugaagagcaaagaucauaccauguccagcugacugcagaauaugcuaugcuaacuagauacugcgauuauuauacccaauucacugacaauucuggauacagucagaccacauggaggguuuacuugagaucccacgauuuugaggcauguauuuuauaucccaaucagcauuuuugcagaugugucaagcauggggacaaaugcucaagcuccaauugggacuucgccaaugagaugaagaacuauuacaguggaaaacaguccaaauuugauaaagauuuaaauuuagcauugauguccuuacaccacgcauuuagaggaacaucuaguuuuuauauugcuaaacuccugaaggaaaagaaaaaugaggaccuuguaacuuaugcagaaaagauuaaaggcaaauacucaggcaaugccuugcuaaaagcaauaauugacuacauaaaguauaugaaggguuuaaccgagaugaacaauuucaaacaugaugagaugugggaugauuucauauuugaaguuccuccuccaaagagcccaucaguaagaagauuagagucuucauaugauuuuaaaacuaauguaaauucaaacccaucacacaucugcaagaauaucaaaacuguggucugcuugucaccaaaaucaggagugucauaugauucaauaauugccuguggggagccaagccagccaagcaucuacagaaagccagacagucaaguuuuccaaucaaaugcugaccagacacauuuuuguuuaucagauacacacugccuggaaaauuaugagacaguuggagaggaaaucauugaugcaauuaaaaaaucgaaaugcugggaaacagaauuuacugaguacauccaauuuaaacagagugaugggguaaggaguugcaggaugaaagacucaggagaauguacagucaccaccaauagauggccuauaauacucugcgauaacgauaaauucuacuacucugaguugcagaaagauuaugauaaggaccaggauauaggucacuucugucucagcccaagaugcaacacaauuaggcacccuauaaaucggaaacauauaucaaauuguacguggcagguuagucacaacaauauagacaagauugagguacaugaacuggaggaucuugaacaguauaagaaggccauaacacagaaguugcagacaagccuaacccuauuuaaauacucaaagacaaaaaacuugccccauaucaagccuauguacaaauauauaacaauugaaggaacagagacugcugaggguauagaaagugcuuauauagaaucagagauacccgcucuagcaggaacaucaauagguuucaagaucacguccaagucuggaaagcauuuauuagaugucauugguuauguuaagagcgcaucuuauucagccguuuauacaaaauuguauacaacaggaccuacuauagguguuaacacuaaacaugaugaauuaugcacagggccauguccugucaaugugccucauggcacagguuggcucacauuugcuaaggagaggacaagcuccugggggugugaagaauuuggcugcuuggcaauuagcgauggguguguuuuugguuccugucaagauauuauaaaagaugaaauaacugucuauaggaaggagacugaggagaccacagauguggaauugugccugacauuugcagacaaaacauauugcacuaaccucaaugcaauuaccccuauaaucaccgaccaguuugaaguccaauuuaaaacuguagaggcuuacagucugccuagaaucauugcagugcggaaucaugagauuaugguugggcaaauaaaugacauagguguuuacucaaaaggcuguggaaauguacagaaaguaaacaacacaaauuauggaaauggugugccuaaguuugauuaccugugucauuuagcaaguagaaaagaagugauagugaggaaaugcuuugauaaugacuaccaggccugcaaauuucuacaaacaccagcgaguuacaggcuagaagaggagggagguucaguuacagucauagacuacaagaaaauccuuggcacuauaaagaugaaggcuauccuuggagaugugaaauauaaaacauuugcagacaauguggacuuaaccguugaggggguaugcacuggcugcaucaauuguuuugaaaauauacauugugaguuaacaauacacaguacaguugaagccagcugcccgguaguaaguucguguacaguauuucaugauagaauuuuaauaaccccaaaugagcacaaguaugcuauaaaggugaucugcaaugaaaagccagguccuacauugccguucaagaucugcagugcaaagacagaugcugcaaugacacuggcagaugcuaagccaauauuagagcuagcaccuguagaccaaacaacauauauuaaggagaaagaugaaaggugcaagacuuggaugugcagaguaagagaugaagguuuucaaguaauuuuugaaccauucaaaaacuuauuugguucuuauauugggauauuuuauacauuuauaauaucuuuaauggcaauauuuauaguuauauauauuguguugccuauauguuucaaacuuagagacacacugaggcagcaugaagacgcuuauaagagagagaugaaaauuagguaa

SEQ ID NO: 4238 - RNA, 4323 nt, Artificial Sequence
  derived and/or modified CDS sequence (wt) from TAHV(4030)__GQ386836.1__GP
augauguucguauuguuuuucauugcacuaagugcugcaagcccaguuuaucagagguguuuccaggauggugcaauugucaagcaaaacccauccaaacaagcuguaacagagguaugccuaaaggaugacguuaguaugauaaaaacagaagcuagauauuucagaaaugcuaccggaacauaugccaacaauguugccauuagaaaguggcuugucucagauuggcaugacugcagaccaaaaaaagucucagggggucauauaaauguuauagaaguuggagaugacuuaacgcugcauacagaggcauauguaugcaaugcagacugcacaauagguguagauaaagaaaccgcacaaguaagauugcaaacagauacaacaaaucauuuugagauugcaggaacaacaguuaagucagggugguucaaaagcacaacuuauaucacccuugaucaaacuugcgagcauuugaaaguuucuugugggccuaaaucuauacaguuccaugcguguuucaaucaacacaugucuuguguuagauucuuacauaggacaauccuaccugggucuauugccagcuccauaugccaaaauguagagauaauaauauuaacagugcuaacccuccuuauauuuauacuauuaagcauacugaguaaaacuuacauauguuauauacucaugccaauauuuaucccgcuugcuuauauauaugguguaauauauaauaaaucguguaaaaaauguaaacuaugcggauuaguuuaccaucccuucacugagugcggcacccauugcguauguggugcuagauacgagacaucggauaggaugaaauugcacagggcaucuggguuguguccagguuauaaaagucucagggcugcaagagucaugugcaaaucuaaagggccagcuucuauuuuaucuauaaucacugcaguguugauccuuacuuuugucacucccauaaaugccaugguagcuggggacacacaagaaacauuuaagcuugaggaccuaccagaugacaugcugagcauggcaaugaaaguaaauauguacuacauuauguguaugauaaauuaugcuguaacuuggucauuuauuuuaugcgcccuauuaauugcuuuacucuucaagaaguaucagcauagauucuuaaacuuuuaugccauguacugcaacgagugcgauauguaccaugauagaucuggccuaaaauauaauggagacuucacaaacaaauguagacagugcacaugcgggcaguacgaagaugccgcaggucuacuaacccacagaaaaacauacaacugccucgugcaguacaaaucaaaauggcugacuaauuucuuaauuguauacauaaucuugaugcuuauuaaagauucuguacuaauagugcaugcugauggcacagacuuugaaaaaugcaguggugaggcggauauaacauggaauuguacaggaccauucuugaauuuagguaauugugagaagaagcaaaagaaggagucauauaauaauauagcaacucaacuaaaagggcuagaugccauaucgguuuuagauauccccaugauaucuaaaauaccagaggauauagcuggagcccuaagauucauugaagagcaaagaucauaccauguccaacugacugcagaauaugcuaugcuaacuagauacugcgauuauuauacccaauucacugauaauucuggauacagucagaccacauggaggguuuacuugagaucccacgauuuugaggcauguauuuuauaucccaaucagcauuuuugcagaugugucaagcauggggacaaaugcucaagcuccaauugggauuucgccaaugagaugaagaacuauuacaguggaaaacaguccaaauuugauaaagauuuaaauuuagcauugauguccuuacaccacgcauuuagaggaacaucuaguuuuuauauugcuaaacuccugaaggaaaagaaaaaugaagaccuuauaacuuaugcagaaaagauuaaaggcaaauacccaggcaaugccuugcuaaaggcaauaauugacuacauaaaguauaugaaggauuuaacugagaugaacaauuucaaacaugaugagaugugggaugacuucauauuugaaguuccuccuacaaagagcccaucaguaagaagauuagagucuucauaugauuuuaaaacuaauguaaauucaaacccaucacacauuugcaagaauaucaaaacuguggucugcuugucaccaaagucaggagugucauaugauucaauaauugccuguggggagccaagccagccaagcaucuacagaaagccagacagucaaguuuuccaaucaaaugcugaccagacacauuuuuguuuaucagauacacacugccuggaaaauuaugagacaguuggagaggaaaucauugaugcaauuaaaaaaucgaaaugcugggaaacagaauuuacugaguacauccaauuuaaacagagugaugggguaaggaguugcaggaugaaagacucaggagaauguacagucaccaccaauagauggccuauaauacucugcgauaacgauaaauucuacuacucugaguugcagaaagauuaugauaaggaccaggauauaggucacuucugucucagcccaagaugcaacacaauuaggcacccuauaaaucggaaacauauaucaaauuguacguggcagguuagucacaacaauauagacaagauugagguacaugaacuggaggaucuugaacaguauaagaaggccauaacacagaaguugcagacaagccuaacccuauuuaaauacucaaagacaaaaaacuugccccauaucaagccuauguacaaauauauaacaauugaaggaacagagacugcugaggguauagaaagugcuuauauagaaucagagauacccgcucuagcaggaacaucaauagguuucaagaucacauccaagucuggaaagcauuuauuagaugucauugguuauguuaagagcgcaucuuauucagccguuuauacaaaauuguauacaacaggacccacuauagguguuaacacuaaacaugaugaauuaugcacagggccauguccugucaaugugccucauggcacaggcuggcucacauuugcuaaggagaggacaagcuccugggggugugaagaauuuggcugccuggcaauuagugauggguguguuuuugguuccugucaagauauuauaaaagaugaaauaauugucuauaggaaggagacugaggagaccacagauguggaauugugccugacauuugcagacaaaacauauugcacuaaccucaaugcaauuaccccuauaaucaccgaccaguuugaaguccaauuuaaaacuguggaggcuuacagucugccuagaaucauugcagugcggaaucaugagauuaugguugggcaaauaaaugacauagguguuuacucaaaaggcuguggaaauguacagaaaguaaacaacacgaauuauggaaauggugugccuaaguuugauuaccugugucauuuagcaaguagaaaagaagugauagugaggaaaugcuuugauaaugacuaccaggccugcaaauuucuacaaacaccagcgaguuauaggcuagaagaggagggagguucaguuacagucauagacuacaagaaaauccuuggcacuauaaagaugaaggcuauccuuggagaugugaaauauaaaacauuugcagacaauguggacuuaaccguugaggggguaugcacuggcugcgucaauuguuuugaaaauauacauugugaguuaacaauacacaguacaguugaagccagcugcucgguaguaaguucguguacaguauuucaugauagaauuuugauaaccccaaaugagcacaaguaugcuauaaaggugaucugcaaugaaaagccagguccuacauugccguucaagaucugcagugcaaagacagaugcugcaaugacacuggcagaugcuaagccaauauuagagcuagcaccuguagaccaaacaacauauauuaaggagaaagaugaaaggugcaagacuuggaugugcagaguaagagaugaagguuuucaaguaauuuuugaaccauucaaaaacuuauuugguucuuauauugggauauuuuauacauuuauaauaucuuuaauggcaauauuuauaguuauauauauuguguugccuauauguuucaaacuuagagacacacugaggcagcaugaagacgcuuauaagagagagaugaaaauuagguaa

SEQ ID NO: 4239 - RNA, 4323 nt, Artificial Sequence
  derived and/or modified CDS sequence (wt) from TAHV(4033)__GQ386837.1__GP
augauguucguauuguuuuucauugcacuaagugcugcaagcccaguuuaucagagguguuuccaggauggugcaauugucaagcaaaacccauccaaacaggcuguaacagagguaugccuaaaggaugacguuaguaugauaaaaacagaagcuagauauuucagaaaugcuaccggaacauaugccaacaauguugccauuagaaaguggcuugucucagauuggcaugacugcagaccaaaaaaagucucagggggucauauaaauguuauagaaguuggagaugacuuaacgcugcauacagaggcauauguaugcaaugcagacugcacaauagguguagauaaagaaaccgcacaaguaagauugcaaacagauacaacaaaucauuuugagauugcaggaacaacaguuaagucagggugguucaaaagcacaacuuauaucacccuugaucaaacuugcgagcauuugaaaguuucuugugggccuaaaucuauacaguuccaugcguguuucaaucaacacaugucuuguguuagauucuuacauaggacaauccuaccugggucuauugccagcuccauaugccaaaauguagagauaauaauauuaacagugcuaacccuccuuauauuuauacuauuaagcauacugaguaaaacuuacauauguuauauacucaugccaauauuuaucccgcuugcuuauauauaugguguaauauauaauaaaucguguaaaaaauguaaacuaugcggauuaguuuaccaucccuucacugagugcggcacccauugcguauguggugcuagauacgagacaucggauaggaugaaauugcacagggcaucuggguuguguccagguuauaaaagucucagggcugcaagagucaugugcaaauccaaagggccagcuucuauuuuaucuauaaucacugcgguguuaauccuuacuuuugucacucccauaaaugccaugguagcuggggacacacaagaaacauuuaagcuugaggaccuaccagaugacaugcugagcauggcaaugaaaguaaauauguacuacauuauguguaugauaaauuaugcuguaacuuggucauuuauuuuaugcgcccuauuaauugcuuuacucuucaagaaguaucagcauggauucuuaaacuuuuaugccauguacugccacgagugcgauauguaccaugauagaucuggccuaaaauauaauggagacuucacaaacaaauguagacagugcacaugcgggcaguacgaagaugccgcaggucuacuaacccacagaaaaacauacaacugccucgugcaguacaaaucaaaauggcugacuaauuucuuaauuguauacauaaucuugaugcuuauuaaagauucuguacuaauagugcaugcugauggcacagacuuugaaaaaugcaguggugaggcggauauaacauggaauuguacaggaccauucuugagucuagguaauugugagaagaagcaaaagaaggagucauauaauaauauagcaacucaauuaaaagggcuagaugccauaucgguuuuagauauccccaugauaucuaaaauaccagaggauauagcuggagcccuaagauucauugaagagcaaagaucauaccauguccaacugacugcagaauaugcuaugcuaacuagauacugcgauuauuacacccaauucacugacaauucuggauacagucaaaccacauggaggguuuacuugagaucccacgauuuugaggcauguauuuuauaucccaaucagcauuuuugcagaugugucaagcauggggacaaaugcucaagcuccaauugggauuucgccaaugagaugaagaacuacuacaguggaaaacaguccaaauuugauaaagauuuaaauuuagcauugauguccuuacaccacgcauuuagaggaacaucuaguuuuuauauugcuaaacuccugaaggaaaagaaaaaugaagaccuuguaacuuaugcagaaaagauuaaaggcaaauacccaggcaaugcccugcuaaaggcaauaauugacuacauaaaguauaugaaggauuuaaccgagaugaacaauuucaaacaugaugagaugugggaugacuucauauuugaaguuccuccuacaaagagcccaucaguaagaagauuagaaucuucauaugauuuuaaaacuaauguaaauucaaacccaucacacauuugcaagaauaucaaaacuguggucugcuugucaccaaagucaggagugucauaugauucaauaauugccuguggggagccaagccagccaagcaucuacagaaagccagacagucaaguuuuccaaucaaaugcugaccagacacauuuuuguuuaucagauacacacugccuggaaaauuaugagacaguuggagaggaaaucauugaugcaauuaaaaaaucgaaaugcugggaaacagaauuuacugaguacauccaauuuaaacagagugaugggguaaggaguugcaggaugaaagacucaggagaauguacagucaccaccaauagauggccuauaauacucugcgauaacgauaaauucuacuacucugaguugcagaaagauuaugauaaggaccaggauauaggucacuucugucucagcccaagaugcaacacaauuaggcacccuauaaaucggaaacauauaucaaauugcacguggcagguuagucacaacaauauagacaagauugagguacaugaacuggaggaucuugaacaguauaagaaggccauaacacagaaguugcagacaagccuaacccuauuuaaauacucaaagacaaaaaacuugccccauaucaagccuauguacaaauauauaacaauugaaggaacagagacugcugaggguauagaaagugcuuauauagagucagagauacccgcucuagcaggaacaucaauagguuucaagaucacauccaagucuggaaagcauuuauuagaugucauugguuauguuaagagcgcaucuuauucggccguuuauacaaaauuguauacaacaggaccuacuauagguguuaacacuaaacaugaugaauuaugcacagggccauguccugucaaugugccucauggcacagguuggcucacauuugcuaaggagaggacaagcuccugggggugugaagaauuuggcugccuggcaauuagcgauggguguguuuuuggcuccugucaagauauuauaaaagaugaaauaacugucuauaggaaggagacugaggagaccacagauguggaauugugccugacauuugcagacaaaacauauugcacuaaccucaaugcaauuaccccuauaaucaccgaccaguuugaaguccaauuuaaaacuguagaggcuuauagucugccuagaaucauugcagugcggaaucaugagauuaugguugggcaaauaaaugacauagguguuuacucaaaaggcuguggaaauguacagaaaguaaacaacacaaauuauggaaauggugugccuaaguuugauuaccuaugucauuuagcaaguagaaaagaagugauagugaggaaaugcuuugauaaugacuaccaggccugcaaauuucuacaaacaccagcaaguuauaggcuagaagaggagggagguucaguuacagucauagacuacaagaaaauccuuggcacuauaaagaugaaggcuauccuuggagaugugaaauauaaaacauuugcagacaauguggacuuaaccguugaggggguaugcacuggcugcaucaauuguuuugaaaauauacauugugaguuaacaauacacaguacaguugaagccagcugcccgguaguaaguucguguacaguauuucaugauagaauuuuaauaaccccaaaugagcacaaguaugcuauaaaggugaucugcaaugaaaagccagguccuacauugccguucaagaucugcagugcaaagacagaugcugcaaugacacuggcagaugcuaagccaauauuagagcuagcaccuguagaccaaacaacauauauuaaggagaaagaugaaaggugcaagacuuggaugugcagaguaagagaugaagguuuucaaguaauuuuugaaccauucaaaaacuuauuugguucuuauauugggauauuuuauacauuuauaauaucuuuaauggcaauauuuauaguuauauauauuguguugccuauauguuucaaacuuagagacacacugaggcagcaugaagacgcuuauaagagagagaugaaaauuagguaa

SEQ ID NO: 4240 - RNA, 4323 nt, Artificial Sequence
  derived and/or modified CDS sequence (wt) from TAHV(4034)__GQ386838.1__GP
augauguucguauuguuuuucauugcacuaagugcugcaagcccaguuuaucagagguguuuccaggauggugcaauugucaagcaaaacccauccaaacaggcuguaacagagguaugccuaaaggaugacguuaguaugauaaaaacagaagcuagauauuucagaaaugcuaccggaacauaugccaacaauguugccauuagaaaguggcuugucucagauuggcaugacugcagaccaaaaaaagucucagggggucauauaaauguuauagaaguuggagaugacuuaacgcugcauacagaggcauauguaugcaaugcagacugcacaauagguguagauaaagaaaccgcacaaguaagauugcaaacagauacaacaaaucauuuugagauugcaggaacaacaguuaagucagggugguucaaaagcacaacuuauaucacccuugaucaaacuugcgagcauuugaaaguuucuugugggccuaaaucuauacaguuccaugcguguuucaaucaacacaugucuuguguuagauucuuacauaggacaauccuaccugggucuauugccagcuccauaugccaaaauguagagauaauaauauuaacagugcuaacccuccuuauauuuauacuauuaagcauacugaguaaaacuuacauauguuauacacucaugccaauauuuaucccgcuugcuuauauauaugguguaauauauaauaaaucguguaaaaaauguaaacuaugcggauuaguuuaccaucccuucacugagugcggcacccauugcguauguggugcuagauacgagacaucggauaggaugaaauugcacagggcaucuggguuguguccagguuauaaaagucucagggcugcaagagucaugugcaaauccaaagggccagcuucuauuuuaucuauaaucacugcaguguuaauccuuacuuuugucacucccauaaaugcuaugguagcuggggacacacaagaaacauuuaagcuugaggaccuaccagaugacaugcugagcauggcaaugaaaguaaauauguacuacauuauguguaugauaaauuaugcuguaacuuggucauuuauuuuaugcgcucuauuaauugcuuuacucuucaagaaguaucagcauagauucuuaaacuuuuaugccauguacugccacgagugcgauauguaccaugauagaucuggccuaaaauauaauggagacuucacaaacaaauguagacagugcacaugcgggcaguaugaagaugccgcaggucuacuaacccacagaaaaacauacaacugccucgugcaguacaaaucaaaauggcugacuaauuucuuaauuguauacauaaucuugaugcuuauuaaagauucuauacuaauagugcaugcugauggcacagacuuugaaaaaugcaguggugaggcggauauaacauggaauuguacaggaccauucuugaaucuagguaauugugagaagaagcaaaagaaggagucauauaauaauauagcaacucaacuaaaagggcuagaugccauaucgguuuuagauauccccaugauaucuaaaauaccagaggauauagcuggagcccuaagauucauugaagagcaaagaucauaccauguccaacugacugcagaauaugcuaugcuaacuagaugcugcgauuauuauacccaauucacugacaauucuggauacagucagaccacauggaggguuuacuugagaucccacgauuuugaggcauguauuuuauaucccaaucagcauuuuugcagaugugucaagcaugggaacaaaugcucaagcuccaauugggauuucgcuaaugagaugaagaacuauuacaguggaaaacaguccaaauuugauaaagauuuaaauuuagcauugauguccuuacaccacgcauuuagaggaacaucuaguuuuuauauugccaaacuccugaaggaaaagaaaaaugaagaccuuguaacuuaugcagaaaagauuaaaggcaaauacccaggcaaugccuugcuaaaggcaauaauugacuacauaaaguauaugaaggauuuaaccgagaugaacaauuucaaacaugaugagaugugggaugacuucauauuugaaguuccuccuaccaagagcccaucaguaagaagauuagagucuucauaugauuuuaaaacuaauguaaauucaaacccaucacacauuugcaagaauaucaaaacuguggucugcuugucaccaaagucaggaguaucauaugauucaauaauugccuguggggagccaagccagccaagcaucuacagaaagccagacagucaaguuuuccaaucaaauacugaccagacacauuuuuguuuaucagauacacacugccuggaaaauuaugaggcaguuggagaggaaaucauugaugcaauuaaaaaaucgaaaugcugggaaacagaauuuacugaguacauccaauuuaaacagagugaugggguaaggaguugcaggaugaaagacucaggagaauguacagucaccaccaauagauggccuauaauacucugcgauaacgauaaauucuacuacucugaguugcagaaagauuacgauaaggaccaggauauaggucacuucugucucagcccaagaugcaacacaauuaggcacccuauaaaucggaaacauauaucaaauuguacauggcagguuaaucacaacaauauagacaagauugagguacaugaacuggaggaucuugaacaguauaagaaggccauaacacagaaguugcagacaagccuaacccuauuuaaauacucaaagacaaaaaacuugccccauaucaagccuauguacaaauauauaacaauugaaggaacagagacugcugaggguauagaaagugcuuauauagaaucagagauacccgcucuagcaggaacaucaauagguuucaagaucacauccaagucuggaaagcauuuauuagaugucauugguuauguuaagagcgcaucuuauucggccguuuauacaaaauuguauacaacaggaccuacuauagguguuaacacuaaacaugaugaauuaugcacagggccauguccuguuaaugugccucauggcacagguuggcucacauuugcuaaggagaggacaagcuccuggggaugugaagaauuuggcugccuggcaauuagcgauggguguguuuuugguuccugucaagauauuauaaaagaugaaauaacugucuauaggaaggagacugaggagaccacagauguggaauugugccugacauuugcagacaaaacauauugcacuaaccucaaugcaauuaccccuauaaucaccgaccaguuugaaguccaauuuaaaacuguagaggcuuacagucugccuagaaucauugcagugcggaaucaugagauuaugguugggcaaauaaaugacauagguguuuacucaaaaggcuguggaaauguacagaaaguaaacaacacaaauuauggaaauggugugccuaaguuugauuaccugugucauuuagcaaguagaaaagaagugauagugaggaaaugcuuugauaaugacuaccaggccugcaaauuucuacaaauaccagcgaguuauaggcuagaagaggagggagguucaguuacagucauagacuacaagaaaauccuuggcacuauaaagaugaaggcuauccuuggagaugugaaauauaaaacauuugcagacaauguggacuuaaccguugaggggguaugcacuggcugcaucaauuguuuugaaaauauacauugugaguuaacaauacacaguacaguugaagccagcugcccgguaguaaguucguguacaguauuucaugauagaauuuuaauaaccccaaaugagcacaaguaugcuauaaaggugaucugcaaugaaaagccagguccuacauugccguucaagaucugcagugcaaagacagaugcugcaaugacacuggcagaugcuaagccaauauuagagcuagcaccuguagaccaaacaacauauauuaaggagaaagaugaaaggugcaagacuuggaugugcagaguaagagaugaagguuuucaaguaauuuuugaaccauucaaaaacuuauuugguucuuauauugggauauuuuauacauuuauaauaucuuuaauggcaauauuuauaguuauauauauuguguugccuauauguuucaaacuuagagacacacugaggcagcaugaagacgcuuacaagagagagaugaaaauuagguaa

SEQ ID NO: 4241 - RNA, 4323 nt, Artificial Sequence
  derived and/or modified CDS sequence (wt) from TAHV(4057)__GQ386839.1__GP
augauguucguauuguuuuucauugcacuaagugcugcaagcccaguuuaucagagguguuuccaggauggugcaauugucaagcaaaacccauccaaacaggcuguaacagagguaugccuaaaggacgacguuaguaugauaaaaacagaagcuagauauuucagaaaugcuaccggaacauaugccaacaauguugccauuagaaaguggcuugucucagauuggcaugacugcagaccaaaaaaagucucagggggucauauaaauguuauagaaguuggagaugacuuaacgcugcauacagaggcauauguaugcaaugcagacugcacaauaggcguagauaaagaaaccgcacaaguaagauugcaaacagauacaacaaaucauuuugagauugcaggaacaacaguuaagucagggugguucaaaagcacaacuuauaucacccuugaucaaacuugcgagcauuugaaagguucuugugggccuaaaucuauacaguuccaugcguguuucaaucaacacaugucuuguguuagauucuuacauaggacaauccuaccugggucuauugccagcuccauaugccaaaauguagagauaauaauauuaacagugcuaacccuccuuauauuuauacuauuaagcauacugaguaaaacuuacauauguuauauacucaugccaauauuuaucccgcuugcuuauauauaugguguaauauauaauaaaucguguaaaaaauguaaacuaugcggauuaguuuaccaucccuucacugagugcggcacccauugcguauguggugcuagauacgagacaucggauaggaugaaauugcacagggcaucuggguuguguccagguuauaaaagucucagggcugcaagagucaugugcaaauccaaagggccagcuucuauuuuaucuauaaucacugcaguguuaauccuuacuuuugucacucccauaaaugccaugguagcuggggacacacaagaaacauuuaagcuugaggaccuaccagaugacaugcugagcauggcaaugaaaguaaauauguacuacauuauguguauaauaaauuaugcuguaacuuggucauuuauuuuaugcgcucuauuaauugcuuuacucuucaagaaguaucagcauagauucuuaaacuuuuaugccauguacugccacgagugcgauauguaccaugauagaucuggccuaaaauauaauggagacuucacaaacaaauguagacagugcacaugcgggcaguacgaagaugccgcaggucuacuaacccacagaaaaacauacaacugccucgugcaguacaaaucaaaauggcugacuaauuucuuaauuguauacauaaucuugaugcuuauuaaagauucuguacuaauagugcaugcugauggcacagacuuugaaaaaugcaguggugaggcggauauaacauggaauuguacaggaccauucuugaaucuagguaauugugagaagaagcaaaagaaggagucauauaauaauauagcaacucaacuaaaagggcuagaugccauaucgguuuuagauauccccaugauaucuaaaauaccagaggauauagcuggagcccuaagauucauugaagagcaaagaucauaccauguccaauugacugcagaauaugcuaugcuaacuagauacugcgauuauuauacccaauucacugacaauucuggauacagucagaccacauggaggguuuacuugagaucccaugauuuugaggcauguauuuuauaucccaaucagcauuuuugcagaugugucaagcauggggacaaaugcucaagcuccaauugggauuuugccaaugagaugaagaacuauuacaguggaaaacagucuaaauuugauaaagauuuaaauuuagcauugauguccuuacaccacgcauuuagaggaacaucuaguuuuuauauugcuaaacuccugaaggaaaagaaaaauggagaccuuguaacuuaugcagaaaagauuaaaggaaaauacccaggcaaugccuugcuaaaggcaauaauugacuacauaaaguauaugaaggauuuaaccgagaugaacaauuucaaacaugaugagaugugggaugacuucauauuugaaguuccuccuacaaagagcccaucaguaagaagauuggagucuucauaugauuuuaaaacuaauguaaauucaaacccaucacacauuugcaagaauaucaaaacuguggucugcuugucaccaaagucaggagugucauaugauucaauaauugccuguggggagccaagccagccaagcaucuacagaaagccagacagucaagucuuccaaucaaaugcugaccagacacauuuuuguuuaucagauacacacugccuggaaaauuaugagacaguuggagaggaaaucauugaugcaauuaaaaaaucgaaaugcugggaaacagaauuuacugaguacauccaauuuaaacagagugaugggguaaggaguugcaggaugaaagacucaggagaauguacagucaccaccaauaaauggccuauaauacucugcgauaacgauaaauucuacuacucugaguugcagaaagauuaugauaaggaccaggauauaggucacuucugucucagcccaagaugcaacacaauuaggcacccuauaaaucggaaacauauaucaaauuguacauggcagguuagucacaacaauauagacaagauugagguacaugaacuggaggaucuugaacaguauaagaaggccauaacacagaaguugcagacaagccuaacccuauuuaaauacucaaagacaaaaaacuugccccauaucaagccuauguacaaauauauaacaauugaaggaacagagacugcugaggguauagaaagugcuuauauagaaucagagauacccgcucuagcaggaacaucaauagguuucaagaucacauccaagucuggaaggcauuuauuagaugucauuggcuauguuaagagcgcaucuuauucagccguuuauacaaaauuguauacaacaggaccuacuauagguguuaacacuaaacaugaugaauuaugcacagggccauguccugucaaugugccucauggcacagguuggcucacauuugcuaaggagaggacaagcuccugggggugugaagaauuuggcugccuggcaauuagcgauggguguguuuuugguuccugucaagauauuauaaaagaugaaauaacugucuauaggaaggagacugaggagaccacagauguggaauugugccugacauuugcagacaaaacauauugcacuaaccucaaugcaauuaccccuauaauuaccgaccaguuugaaguccaauuuaaaacuguagaggcuuacagucugccuagaaucauugcagugcggaaccaugagauuaugguugggcaaauaaaugacauagguguuuacucaaaaggcuguggaaauguacagaaaguaaacaacacaaauuauggaaauggugugccuaaguuugauuaccugugucauuuagcaaguagaaaagaagugauagugaggaaaugcuuugauaaugacuaccaggccugcaaauuucuacaaacaccagcaaguuauaggcuagaagaggagggagguucaguuacagucauagacuacaagaaaauccuuggcacuauaaagaugaaggcuauccuuggagaugugaaauauaaaacauuugcagacaauguggauuuaaccguugaggggguaugcacuggcugcgucaauuguuuugaaaauauacauugugagucaacaauacacaguacaguugaagccagcugcccgguaguaaguucguguacaguauuucaugauagaauuuuaauaaccccaaaugagcacaaguaugcuauaaaggugaucugcaaugaaaagccagguccuacauugccguucaagaucugcagugcaaagacagaugcugcaaugacacuggcagaugcuaagccaauauuagagcuagcaccuguagaccaaacaacauauauuaaggagaaagaugaaaggugcaagacuuggaugugcagaguaagagaugaagguuuucaaguaauuuuugaaccauucaaaaacuuauuugguucuuauauugggauauuuuauacauuuauaauaucuuugauggcaauauuuauaguuauauauauuguguugccuauauguuucaaacuuagagacacacugaggcagcaugaagacgcuuauaagagagagaugaaaauuagguaa

SEQ ID NO: 4242 - RNA, 4323 nt, Artificial Sequence
  derived and/or modified CDS sequence (wt) from TAHV(4060)__GQ386840.1__GP
augauguucguauuguuuuucaucgcacuaagugcugcaagcccaguuuaucagagguguuuccaggauggugcaauugucaagcaaaacccauccaaacaggcuguaacagaaguaugccuaaaggaugacguuaguaugauaaaaacagaagcuagauauuucagaaaugcuaccggaacauaugccaacaauguugccauuaggaaguggcuugucucagauuggcaugacugcagaccaaaaaaagucucagggggucauauaaauguuauagaaguuggagaugacuuaacgcugcauacagaggcauauguaugcaaugcagacugcacaauagguguagauaaagaaaccgcacaaguaagauugcaaacagauacaacaaaucauuuugagauugcaggaacaacaguuaagucagggugguucaaaagcacaacuuauaucacccuugaucaaacuugcgagcauuugaaaguuucuugugggccuaaaucuauacaguuccaugcguguuucaaucaacacaugucuuguguuagauucuuacauaggacaauccuaccuggaucuauugccagcuccauaugccaaaauguagagauaauaauauuaacagugcuaacccuccuuauauuuauacuauuaagcauacugaguaaaacuuacauauguuauauacucaugccaauauuuaucccgcuugcuuauauauaugguguaauauauaauaaaucguguaaaaaauguaaacuaugcggauuaguuuaccaucccuucacugagugcggcacccauugcguauguggugcuagauacgagacaucggauaggaugaaauugcacagggcaucuggguuguguccagguuauaaaagucucagggcugcaagagucaugugcaaauccaaagggccagcuucuauuuuaucuauaaucacugcaauauuaauccuuacuuuugucacucccauaaaugccaugguagcuggggacacacaagaaacauuuaagcuugaggaccuaccagaugacaugcugagcauggcaaugaaaguaaauauguacuacauuauguguaugauaaauuaugcuguaacuuggucauuuauuuuaugcgcccuauuaauugccuuacucuucaagaaguaucagcauagauucuuaaacuuuuaugccauguacugccacgagugcgauauguaccaugauagaucuggccuaaaauauaauggagacuucacaaacaaauguagacagugcacaugcgggcaguacgaagaugccgcaggucuacaaacccacagaaaaacauacaacugccuugugcaguacaaaucaaaauggcugacuaauuucuuaauaguauauauaaucuugaugcuuauuaaagauucuguacuaauagugcaugccgauggcacagacuuugaaaaaugcaguggugaggcggauauaacauggaauuguacaggaccauucuugaaucuagguaacugugagaagaagcaaaagaaggagucauauaauaauauagcaacucaacuaaaagggcuagaugccauaucgguuuuagauauccccaugauaucuaaaauaccagaggauauagcuggagcucuaagauucauugaagagcaaagaucauaccauguccaacugacugcagaauaugcuaugcuaacuagauacugcgauuauuauacccaauucacugacaauucuggauacagucagaccacauggaggguuuacuugaggucccacgauuuugaggcauguauuuuauaucccaaucagcauuuuuguagaugugucaagcauggggacaaaugcucaagcuccaauugggauuucgccaaugagaugaagaacuauuacaguggaaagcaguccaaauuugauaaagauuuaaauuuagcauugauguccuuacaccacgcauucagaggaacaucuaguuuuuauauugcuaaacuccugaaggaaaagaaaaaugaggaucuuguaacuuaugcagaaaagauuaaaggcaaauacccaggcaaugccuugcuaaaggcaauaauugacuacauaaaguauaugaaggauuuaaccgagaugaacaauuucaaacaugaugagaugugggaugacuucauauuugaaguuccuccuacaaagagcccaucagugagaagauuagagucuucauaugauuuuaaaaccaauguaaauucaaacccaucacauauuugcaagaauaucaaaacuguggucugcuugucaccaaagucaggagugucauaugauucaauaauugccuguggggagccaagccagccaagcaucuacagaaagccagacagucaaguuuuucaaucaaaugcugaccagacacauuuuuguuuaucagauacacacugccuggaaaauuaugagacaguuggagaggaaaucauugaugcaauuaaaaaaucaaaaugcugggaaacagaauuuacugaguacacccaauuuaaacagagugaugggguaaggaguugcaggaugaaagacucaggagaauguacagucaccaccaauagauggccuauaauacucugcgauaacgauaaauucuacuacucugaguugcagaaagauuaugauaaggaccaggauauaggucacuucugucucagcccaagaugcaauacaauuaggcacccuauaaaucggaaacauauaucaaauuguacguggcagguuagucacaacaauauagacaagauugagguacaugaacuggaggaucuugaacaguauaagaaggccauaacacagaaauugcagacaagccuaacccuauuuaaauacucaaagacaaaaaacuugccccauaucaagccuauguacaaauauauaacaauugaaggaacagagacugcugaggguauagaaagugcuuauauagaaucagagauacccgcucuagcaggaacaucaauagguuucaagaucacauccaagucuggaaagcauuuauuagaugucauugguuauguuaagagcgcaucuuauucagccguuuauacaaaauuguauacaacaggaccuacuauagguguuaacacuaaacaugaugaauuaugcacagggccauguccugucaaugugccucauggcacagguuggcucacauuugcuaaggagaggacaagcuccugggggugcgaagaauuuggcugccuggcaauuagcgauggguguguuuuugguucuugucaagauauuauaaaagaugaaauaacugucuauaggaaggagacugaggagaccacagauguggaauugugccugacauuugcagacaaaacauacugcaccaaccucaaugcaauuaccccuauaaucaccgaccaguuugaaguccaauuuaaaacuguagaggcuuacagucugccuagaaucaucgcagugcggaaucaugagauuaugguugggcaaauaaaugacauagguguuuacucaaaaggcuguggaaauguacagaaaguaaacaacacaaauuauggaaauggugugccuaaauuugauuaccugugucauuuagcaaguagaaaagaagugauaguuaggaaaugcuuugauaaugacuaccaggccugcaaauuucuacaaacaccagcgaguuauaggcuagaagaggagggagguucaguuacagucauagacuacaagaaaauccuuggcacuauaaagaugaaggcuauccuuggagaugugaaauauaaaacauuugcagacaauguggacuuaaccguugaggggguaugcacuggcugcaucaauuguuuugaaaauauacauugugaguuaacaauacacaguacaguugaagccagcugcccgguaguuaguucguguacaguauuucaugauagaauuuuaauaaccccaaaugagcacaaguaugcuauaaaggugaucugcaaugaaaagccagggccuacauuaccguucaagaucugcagcgcaaagacagaugcugcaaugacacuggcagaugcuaagccaauauuagagcuagcaccuguagaccaaacaacauauauuaaggagaaagaugaaaggugcaagacuuggaugugcagaguaagagaugaagguuuucaagugauuuuugaaccauucaaaaacuuauuugguucuuauauugggauauuuuauacauuuauaauaucuuuaauagcaauauuuauaguuauauauauuguguugccuauauguuucaaacuuagagacacacugaggcagcaugaagacgccuauaagagagagaugaaaauuagguaa

SEQ ID NO: 4243 - RNA, 4323 nt, Artificial Sequence
  derived and/or modified CDS sequence (wt) from TAHV(5060)__GQ386841.1__GP
augauguucguauuguuuuucauugcacuaagugcugcaagcccaguuuaucagagguguuuccaggauggugcaauugucaagcaaaacccauccaaacaggcuguaacagagguaugccuaaaggacgacguuaguaugauaaaaacagaagcuagauauuucagaaaugcuaccggaacauaugccaacaauguugccauuagaaaguggcuugucucagauuggcaugacugcagaccaaaaaaagucucagggggucauauaaauguuauagaaguuggagaugacuuaacgcugcauacagaagcauauguaugcaaugcagacugcacaauagguguagauaaagaaacugcacaaguaagauugcaaacagauacaacaaaucauuuugagauugcaggaacaacaguuaagucagggugguucaaaagcacaacuuauaucacccuugaucaaacuugcgagcauuugaaaguuucuugugggccuaaaucuauacaguuccaugcguguuucaaucaacacaugucuuguguuagauucuuacauaggacaauccuaccugggucuauugccagcuccauaugccaaaauguagagauaauaauauuaacagugcuaacccuccuuauauuuauacuauuaagcauacugaguaaaacuuacauauguuauauacucaugccaauauuuaucccgcuugcuuauauauaugguguaauauauaauaaaucguguaaaaaauguaaacuaugcggauuaguuuaccaucccuucacugagugcggcacccauugcguauguggugcuagauacgagacaucggauaggaugaaauugcacagggcaucuggguuguguccagguuauaaaagucucagggcugcaagagucaugugcaaauccaaagggccagcuucuauuuuaucuauaaucacugcaguguuaauccuuacuuuugucacucccauaaaugccaugguagcuggggacacacaagaaacauuuaagcuugaggaccuaccagaugacaugcugagcauggcaaugaaaguaaauauguacuacauuauguguauaauaaauuaugcuguaacuuggucauuuauuuuaugcgcucuauuaauugcuuuacucuucaagaaguaucagcauagguucuuaaacuuuuaugccauguacugccacgagugcgauauguaccaugauagaucuggccuaaaauauaauggagacuucacaaacaaauguagacagugcacaugcgggcaguacgaagaugccgcaggucuacuaacccacagaaaaacauacaacugccucgugcaguacaaaucaaaauggcugacuaauuucuuaauuguauacauaaucuugaugcuuauuaaagauucuguacuaauagugcaugcugauggcacagacuuugaaaaaugcaguggugaggcggauauaacauggaauuguacaggaccauucuugaaucuagguaauugugagaagaagcaaaagaaggagucauauaauaauauagcaacucaacuaaaagggcuagaugccauaucgguuuuagauauccccaugauaucuaaaauaccagaggauauagcuggagcccuaagauucauugaggagcaaagaucauaccauguccaauugacugcagaauaugcuaugcuaacuagauacugcgauuauuauacccaguucacugacaauucuggauacagucagaccacauggaggguuuacuugagaucccaugauuuugaggcauguauuuuauaucccaaucagcauuuuugcagaugugucaagcauggggauaaaugcucaagcuccaauugggauuucgccaaugagaugaagaacuauuacaguggaaaacagucuaaauuugauaaagauuuaaauuuagcauugauguccuuacaccacgcauuuagaggaacaucuaguuuuuauauugcuaaacuccugaaggaaaagaaaaauggagaccuuguaacuuaugcagaaaagauuaaaggcaaauauccaggcaaugccuugcuaaaggcaauaauugacuacauaaaguauaugaaggauuuaaccgagaugaacaauuucaaacaugaugagaugugggaugacuucauauuugaaguuucuccuacaaagagcccaucaguaagaagauuggagucuucauaugauuuuaaaacuaauguaaauucaaacccaucacacauuugcaagaauaucaaaacuguggucuguuugucaccaaagucaggagugucuuacgauucaauaauugccuguggggagccaagccagccaagcaucuacagaaagccagacagucaagucuuccaaucaaaugcugaccagacacauuuuuguuuaucagauacacacugccuggaaaauuaugagacaguuggagaggaaaucauugaugcaauuaaaaaaucgaaaugcugggaaacagaauuuacugaguacauccaauuuaaacagagugaugggguaaggaguugcaggaugaaagacucaggagaauguacagucaccaccaauaaauggccuauaauacucugcgauaacgauaaauucuacuacucugaguugcagaaagauuaugauaaggaccaggauauaggucacuucugucucagcccaagaugcaacacaauuaggcacccuauaaaucggaaacauauaucaaauuguacauggcagguuagucacagcaauauagacaagauugagguacaugaacuggaggaucuugaacaguauaagaaggccauaacacagaaguugcagacaagccuaacccuauuuaaauacucaaagacaaaaaacuugccccauaucaagccuauauacaaauauauaacaauugaaggaacagagacugcugaggguauagaaagugcuuauauagaaucagagauacccgcucuagcaggaacaucaauagguuucaagaucacauccaagucuggaaagcauuuauuagaugucauugguuauguuaagagcgcaucuuauucagccguuuauacaaaauuguauacaacaggaccuacuauagguguuaacacuaaacaugaugaauuaugcacagggccauguccugucaaugugccucauggcacagguuggcucacauuugcuaaggagaggacaagcuccugggggugugaagaauuuggcugccuggcgauuagcgauggguguguuuuugguuccugucaagauauuauaaaagaugaaauaacugucuauaggaaggagacugaggagaccacagauguggaauugugccugacauuugcagacaaaacauauugcacuaaccucaaugcaauuaccccuauaaucaccgaccaauuugaaguccaauuuaaaacuguagaggcuuacagucugccuagaaucauugcagugcggaaccaugagauuaugguugggcaaauaaaugacauagguguuuacucaaaaggcuguggaaauguacagaaaguaaacaacacaaauuauggaaauggugugccuaaguuugauuaccuaugucauuuagcaaguagaaaagaagugauagugaggaaaugcuuugauaaugacuaucaggccugcaaauuucuacaaacaccagcaaguuauaggcuagaagaagagggagguucaguuacagucauagacuacaagaaaauccuuggcacuauaaagaugaaggcuauccuuggagaugugaaauacaaaacauuugcagacaauguggacuuaaccguugaggggguaugcacuggcugcaucaauuguuuugaaaauauacauugugaguuaacaauacacaguacaguugaagccagcugcccgguaguaaguucguguacaguauuucaugauagaauuuuaauaaccccaaaugagcacaaguaugcuauaaaggugaucugcaaugaaaagccagguccuacauugccguucaagaucugcagugcaaagacagaugcugcaaugacacuggcagaugcuaagccaauauuagagcuagcaccuguagaccaaacaacauauauuaaggagaaagaugaaaggugcaagacuuggaugugcagaguaagagaugaagguuuucaaguaauuuuugaaccauucaaaaacuuauuugguucuuauauugggauauuuuauacauuuauaauaucuuuaauggcaauauuuauaguuauauauauuguguugccuauauguuucaaacuuagagacacacugaggcagcaugaagacgcuuauaagagagagaugaaaauuagguaa

SEQ ID NO: 4244 - RNA, 4323 nt, Artificial Sequence
  derived and/or modified CDS sequence (wt) from TAHV(76)__GQ386824.1__GP
augauguucguauuguuuuuuauugcacuaagugcugcaagcccaguuuaucagagguguuuccaggauggugcaauugucaagcaaaacccauccaaacaggcuguaacagagguaugccuaaaggaugacguuaguaugauaaaaacagaagcuagauauuucagaaaugcuaccggaacauaugccaacaauguugccauuagaaaguggcuugucucagauuggcaugacugcagaccaaaaaaagucucagggggucauauaaauguuauagaaguuggagaugacuuaacgcugcauacagaggcauauguaugcaaugcagacugcacaauagguguagauaaagaaaccgcacaaguaagauugcaaacagauacaacaaaucauuuugagauugcaggaacaacaguuaagucagggugguucaaaagcacaacuuauaucacccuugaucaaacuugcgagcauuugaaaguuucuugugggccuaaaucuauacaguuccaugcguguuucaaucaacacaugucuuguguuagauucuuacauaggacaauccuaccagggucuauugccagcuccauaugccaaaauguagagauaauaauauuaacagugcuaacccuccuuauauuuauacuauuaagcauacugaguaaaacuuacauauguuauauacucaugccaauauuuaucccgcuugcuuauauauaugguguaauauauaauaaaucguguaaaaaauguaaacuaugcggauuaguuuaccaucccuucacugagugcggcacccauugcguauguggugcuagauacgagacaucggauaggaugaaauugcacagggcaucuggguuguguccagguuauaaaagucucagggcugcaagagucaugugcaaauccaaagggccagcuucuauuuuaucuauaaucacugcaguguuaauccuuacuuuugucacucccauaaaugcuaugguagcuggggacacacaagaaacauuuaagcuugaggaccuaccagaugacaugcugagcauggcaaugaaaguaaauauguacuacauuauguguaugauaaauuaugcuguaacuuggucauuuauuuuaugcgcccuauuaauugcuuuacucuucaagaaguaucagcauagauucuuaaacuuuuaugccauguacugccacgagugcgauauguaccaugauagaucuggccuaaaauauaauggagacuucacaaacaaauguagacagugcacaugcgggcaguacggagaugccgcaggucuacuaacccacagaaaaacauacaacugccucgugcaguacaaaucaaaauggcugacuaauuucuuaauuguauacauaaucuugaugcuuauuaaagauucuguacuaauagugcaugcugauggcacagacuuugaaaaaugcaguggugaggcggauauaacauggaauuguacaggaccauucuugaaucuagguaauugugagaagaagcaaaagaaggagucauauaauaauauagcaacucaacuaaaagggcuagaugccauaucgguuuuagauauccccaugauaucuaaaauaccagaggauauagcuggagcccuaagauucauugaagagcaaagaucauaccauguccaacugacugcagaauaugcuaugcuaacuagauauugcgauuauuauacccaauucacugacaauucuggauacagucagaccacauggaggguuuacuugagaucccacgauuuugaggcauguauuuuauaccccaaucagcauuuuugcagaugugucaagcauggggacaaaugcucaagcuccaauugggauuucgcuaaugagaugaagaacuauuacaguggaaaacaguccaaauuugauaaagauuuaaauuuagcauugauguccuuacaccacgcauuuagaggaacaucuaguuuuuauauugccaaacuccugaaggaaaagaaaaaugaagaccuuguaacuuaugcagaaaagauuaaaggcaaauacccaggcaaugccuugcuaaaggcaauaauugacuacauaaaguauaugaaggauuuaaccgagaugaacaauuucaaacaugaugagaugugggaugacuucauauuugaaguuccuccuacaaagagcccaucaguaagaagauuagagucuucauaugauuuuaaaacuaauguaaauucaaacccaucacacauuugcaagaauaucaaaacuguggucugcuugucaccaaagucaggagugucauaugauucaauaauugccuguggggagccaagccagccaagcaucuacaggaagccagacagucaaguuuuccaaucaaaugcugaccagacacauuuuuguuuaucagauacacacugccuggaaaauuaugaggcaguuggagaggaaaucauugaugcaauuaaaaaaucgaaaugcugggaaacagaauuuacugaguacauccaauuuaaacagagugaugggguaaggaguugcaggaugaaagacucaggagaauguacagucaccaccaauagauggccuauaauacucugcgauaacgauaaauucuacuacucugaguugcagaaagauuaugauaaggaccaggauauaggucacuucugucucagcccaagaugcaacacaauuaggcacccuauaaaucggaaacauauaucaaauuguacauggcagguuagucacaauaauauagacaagauugagguacaugaacuggaggaucuugaacaguauaagaaggccauaacacagaaguugcagacaagccuaacccuauuuaaauacucaaagacaaaaaacuugccccauaucaagccuauguacaaauauauaacaauugaaggaacagagacugcugaggguauagaaagugcuuauauagaaucagagauacccgcucuagcaggaacaucaauagguuucaagaucacauccaagucuggaaagcauuuauuagaugucauuaguuauguuaagagcgcaucuuauucagccguuuauacaaaauuguauacaacaggaccuacuauagguguuaacacuaaacaugaugaauuaugcacagggccauguccuguuaaugugccucauggcacagguuggaucacauuugcuaaggagaggacaagcuccuggggaugugaagaauuuggcugccuggcaauuagcgauggguguguuuuugguuccugucaagauauuauaaaagaugaaauaacugucuauaggaaggagacugaagagaccacagauguggaauugugccugacauuugcagacaaaacauauugcacuaaccucaaugcaauuaccccuauaaucaccgaccaguuugaaguccaauuuaaaacuguagaggcuuacagucugccuagaaucauugcagugcggaaucaugagauuaugguugggcaaauaaaugacauagguguuuacucaaaaggcuguggaaauguacagaaaguaaacaacacaaauuauggaaauggugugccuaaguuugauuaccugugucauuuagcaaguagaaaagaagugauagugaggaaaugcuuugauaaugacuaccaggccugcaaauuucuacaaacaccagcgaguuauaggcuagaagaggagggagguucaguuacagucauagacuacaagaaaauccuuggcacuauaaagaugaaggcuauccuuggagaugugaaauauaaaacauuugcagacaauguggacuuaaccguugaggggguaugcacuggcugcaucaauuguuuugaaaauauacauugugaguuaacaauacacaguacaguugaagccagcugcccgguaguaaguucguguacaguauuucaugauagaauuuuaauaaccccaaaugagcacaaguaugcuauaaaggugaucugcaaugaaaagccagguccuacauugccguucaagaucugcagugcaaagacagaugcugcaaugacacuggcagaugcuaagccaauauuagagcuagcaccuguagaccaaacaacauauauuaaggagaaagaugaaaggugcaagacuuggaugugcagaguaagagaugaagguuuucaaguaauuuuugaaccauucaaaaacuuauuugguucuuauauugggauauuuuauacauuuauaauaucuuuaauggcaauauuuauaguuauauauauuguguugccuauauguuucaaacuuagagacacacugaggcagcaugaagacgcuuacaagagagagaugaaaauuagguaa

SEQ ID NO: 4245 - RNA, 4323 nt, Artificial Sequence
  derived and/or modified CDS sequence (wt) from TAHV(83)__GQ386825.1__GP
augauguucguauuguuuuucauugcacuaagugcugcaagcccaguuuaucagagguguuuccaggauggugcaauugucaagcaaaacccauccaaacaggcuguaacagagguaugccuaaaggaugacguuaguaugauaaaaacagaagcuagauauuucagaaaugcuaccggaacauaugccaacaauguugccauuagaaaguggcuugucucagauuggcaugacugcaggccaaaaaaagucucagggggucauauaaauguuauagaaguuggagaugacuuaacgcugcauacagaggcauauguauguaaugcagacugcacaauagguguagauaaagaaaccgcacagguaagauugcaaacagauacaacaaaucauuuugagauugcaggaacaacaguuaagucagggugguucaaaagcacaacuuauaucacccuugaucaaacuugcgagcauuugaaaguuucuugugggccuaaaucuauacaguuccaugcguguuucaaucaacacaugucuuguguuagauucuuacauaggacaauccuaccugggucuauugccagcuccauaugccaaaauguagagauaauaauauuaacagugcuaacccuccuuauauuuauacuauuaagcauacugaguaaaacuuacauauguuauauacucaugccaauauuuaucccgcuugcuuauauauaugguguaauauauaauaaaucguguaaaaaauguaaacuaugcggauuaguuuaccaucccuucacugagugcggcacccauugcguauguggugcuagauacgagacaucggauaggaugaaauugcacagggcaucuggguuguguccagguuauaaaagucucagggcugcaagagucaugugcaaauccaaagggccagcuucuauuuuaucuauaaucacugcaguguuaauccuuacuuuugucacucccauaaaugccaugguagcuggggacacacaagaaacauuuaagcuugaggaccuaccagaugacaugcugagcauggcaaugaaaguaaauauguacuacauuauguguaugauaaauuaugcuguaacuuggucauuuauuuuaugcgcccuauuaauugcuuuacucuucaagaaguaucagcauagauucuuaaacuuuuaugccauguacugccacgagugcgauauguaccaugauagaucuggccuaaaauauaauggagacuucacaaacaaauguagacagugcacaugcgggcaguacgaagaugccgcaggucuacuaacccacagaaaaacauacaacugccucgugcaguacaaaucaaaauggcugacuaauuucuuaauuguauacauaaucuugaugcuuauuaaagauucuguacuaauagugcaugcugauggcacagacuuugaaaaaugcaguggugaggcggauauaacauggaauuguacaggaccauucuugaaucuagguaauugugagaagaagcaaaagaaggagucauauaauaauauagcaacucaacuaaaagggcuagaugccauaucgguuuuagauauccccaugauaucuaaaauaccagaggauauagcuggagcccuaagauucauugaagagcaaagaucauaccauguccaacugacugcagaauaugcuaugcuaacuagauacugcgauuauuauacccaauucacugacaauucuggauacagucagaccacauggaggguuuacuugagaucccacgauuuugagguaugcauuuuauaucccaaucagcauuuuugcaggugugucaagcauggggacaaaugcucaagcuccaauugggauuucgccaaugagaugaagaacuauuacaguggaaaacaguccaaauuugauaaagauuuaaauuuagcauugauguccuuacaccacgcauuuagaggaacaucuaguuuuuauauugcuaaacuccuaaaggaaaagaaaaaugaagaucuuguaacuuaugcagaaaagauuaaaggcaaauacccaggcaaugccuugcuaaaggcaauaauugacuacauaaaguauaugaaggguuuaaccgagaugaacaauuucaaacaugaugaggugugggaugacuucauauuugaaguuccuccuacaaagagcccaucaguaagaagauuagagucuucauaugauuuuaaaacuaauguaaauucaaacccaucacacauuugcaagaauaucaaaacuguggucugcuugucaccaaagucaggagugucauaugauucaauaauugccuguggggagccaagccagccaagcaucuacagaaagccagacagucaaguuuuccaaucaaaugcugaccagacacauuuuuguuuaucagauacacacugccuggaaaauuaugagacaguuggagaggaaaucauugaugcaauuaaaaaaucgaaaugcugggaaacagaauuuacugaguacauccaauuuaaacagagugaugggguaaggaguugcaggaugaaagacucaggagaauguacagucaccaccaauagauggccuauaauacucugcgauaacgauaaauucuauuacucugaguugcagaaagauuaugauaaggaccaggauauaggucacuucugucuuagcccaagaugcaacacaauuaggcacccuauaaaucggaaacauauaucaaauuguacguggcagguuagucacaacaauauagacaagauugagguacaugaacuggaggaucuugaacaguauaagaaggccauaacacagaaguugcagacaagccuaacccuauuuaaauacucaaagacaaaaaacuugccccauaucaagccuauguacaaauauauaacaauugaaggaacagagacugcugaggguauagaaagugcuuauauagaaucagagauacccgcucuagcaggaacaucaauagguuucaagaucacauccaagucuggaaagcauuuauuagaugucauugguuauguuaagagcgcaucuuauucagccguuuauacaaaauuguauacaacaggaccuacuauagguguuaacacuaaacaugaugaauuaugcacagggccauguccugucaaugugccucauggcacagguuggcucacauuugcuaaggagaggacaagcuccugggggugugaagaauuuggcugccuggcaauuagcgauggguguguuuuugguuccugucaagauauuauaaaagaugaaauaacugucuauaggaaggaaacugaggagaccacagauguggaauugugccugacauuugcagacaaaacauauugcacuaaccucaaugcaauuaccccuauaaucaccgaccaguuugaaguccaauuuaaaacuguagaggcuuacagucugccuagaaucauugcagugcggaaucaugagauuaugguugggcaaauaaaugacauagguguuuacucaaaaggcuguggaaauguacagaaaguaaacaacacaaauuauggaaauggugugccuaaguuugauuaccugugucauuuagcaaguagaaaagaagugauagugaggaaaugcuuugauaaugacuaccaggccugcaaauuucuacaaacaccagcgaguuauaggcuagaagaggagggagguucaguuacagucauagacuacaagaaaauccuuggcacuauaaagaugaaggcuauccuuggagaugugaaauauaaaacauuugcagacaauguggacuuaaccguugaggggguaugcacuggcugcaucaauuguuuugaaaauauacauugugaguuaacaauacacaguacgguugaagccagcugcccgguaguaaguucguguacaguauuucaugauagaauuuuaauaaccccaaaugagcacaaguaugcuauaaaggugaucugcaaugaaaagccagguccuacauugccguucaagaucugcagugcaaagacagaugcugcaaugacacuggcagaugcuaagccaauauuagagcuagcaccuguagaccaaacaacauauauuaaggagaaagaugaaaggugcaagacuuggaugugcagaguaagagaugaagguuuucaaguaauuuuugaaccauucaaaaacuuauuugguucuuauauugggauauuuuauacauuuauaauaucuuuaauggcaauauuuauaguuauauauauuguguugccuauauguuucaaacuuagagacacacugaggcagcaugaagacgcuuauaagagagagaugaaaauuagguaa

SEQ ID NO: 4246 - RNA, 4323 nt, Artificial Sequence
  derived and/or modified CDS sequence (wt) from TAHV(89)__GQ386826.1__GP
augauguucguauuguuuuucauugcacuaagugcugcaagcccaguuuaucagagguguuuccaggauggugcaauugucaagcaaaacccauccaaacaggcuguaacagagguaugccuaaaggaugacguuaguaugauaaaaacagaagcuagauauuucagaaaugcuaccggaacauaugccaacaauguugccauuagaaaguggcuugucucagauuggcaugacugcagaccaaaaaaagucucagggggucauauaaauguuauagaaguuggagaugacuuaacgcugcauacagaagcauauguaugcaaugcagacugcacaauagguguagauaaagaaaccgcacaaguaagauugcaaacagauacaacaaaucauuuugagauugcaggaacaacaguuaagucagggugguucaaaagcacaacuuauaucacccuugaccaaacuugcgagcauuugaaaguuucuugugggccuaaaucuauacaguuccaugcguguuucaaucaacacaugucuuguguuagauucuuacauaggacaauccuaccugggucuauugccagcuccauaugccagaauguagagauaauaauauuaacagugcuaacccuccuuauauuuauacuauuaagcauacugaguaaaacuuacauauguuauauacucaugccaauauuuaucccgcuugcuuauauauaugguguaauauauaauaaaucguguaaaaaauguaaacuaugcggauuaguuuaccaucccuucacugagugcggcacccauugcguauguggugcuagauacgagacaucggauaggaugaaauugcacagggcaucuggguuguguccugguuauaaaagucucagggcugcaagagucaugugcaaauccaaagggccagcuucuauuuuaucuauaaucacugcaguguuaauccuuacuuuugucacucccauaaaugccaugguagcuggggacacacaagaaacauuuaagcuugaggaccuaccagaugacaugcugagcauggcaaugaaaguaaauauguacuacauuauguguaugauaaauuaugcuguaacuuggucauuuauuuuaugcgcccuauuaauugcuuuacucuucaagaaguaucagcauagauucuuaaacuuuuaugccauguacugccacgagugcgauauguaccaugauagaucuggccuaaaauauaauggagacuucacaaacaaauguagacagugcacaugcgggcaguacgaagaugccgcaggucuacuaacccacagaaaaacauacaacugccucgugcaguacaaaucaaaauggcugacuaauuucuuaauuggauacauaaucuugaugcuuauuaaagauucuguacuaauagugcaugcugauggcacagacuuugaaaaaugcaguggugaggcggauauaacauggaauuguacaggaccauucuugaaucuagguaauugugagaagaagcaaaagaaggagucauauaauaauauagcaacucaacuaaaagggcuagaugccauaucgguuuuagauauccccaugauaucuaaaauaccagaggauauagcuggagcccuaagauucauugaagagcaaagaucauaccauguccaacugacugcagaauaugcuaugcuaacuagauacugcgauuauuauacccaauucacugacaauucuggauacagucagaccacauggaggguuuacuugagaucccacgauuuugaggcauguauuuuauaucccaaucagcauuuuugcagaugugucaagcauggggacaaaugcucaagcuccaauugggauuucgccaaugagaugaagaacuauuacaguggaaaacaguccaaauuugauaaagauuuaaauuuagcauugauguccuuacaccacgcauuuagaggaacaucuaguuuuuauauugcuaaacuccugaaggaaaagaaaaaugaagaccuuguaacuuaugcagaaaagauuaaaggcaaauauccaggcaaugcccugcuaaaggcaauaauugacuacauaaaguauaugaaggguuuaaccgagaugaacaauuucaaacaugaugagaugugggaugacuucauauuuggaguuccuccuacaaagagcccaucaguaagaagauuagaguccucauaugauuuuaaaacuaauguaaauucaaacccaucacacauuugcaagaauaucaaaacuguggucugcuugucaccaaagucaggagugucauaugauucaauaauugccuguggggagccaagccagccaagcaucuacagaaagccagacagucaaguuuuccaaucaaaugcugaccagacacauuuuuguuuaucagauacacacugccuggaaaauuaugagacaguuggagaggaaaucauugaugcaauuaaaaaaucgaaaugcugggaaacagaauuuacugaguacauccaauuuaaacagagugaugggguaaggaguugcaggaugaaagacucaggagaauguacagucaccaccaauagauggccuauaauacucugcgauaacgauaaauucuacuacucugaguugcagaaagauuaugauaaggaccaggauauaggucacuucugucucagcccaagaugcaacacaauuaggcacccuauaaaucggaaacauauaucaaauuguacguggcagguuaaucacaacaauauagacaagauugagguacaugaacuggaggaucuugaacaguauaagaaggccauaacacagaaguugcagacaagccuaacccuauuuaaauacucaaagacaaaaaacuugccccauaucaagccuauguacaaauauauaacaauugaaggaacagagacugcugaggguauagaaagugcuuauauagaaucagagauacccgcucuagcaggaacaucaauagguuucaagaucacauccaagucuggaaagcauuuauuagaugucauugguuauguuaagagcgcaucuuauucggccguuuauacaaaauuguauacaacaggaccuacuauagguguuaacacuaaacaugaugaauuaugcacagggccauguccugucaaugugccucauagcacagguuggcucacauuugcuaaggagaggacaagcuccugggggugugaagaauuuggcugccuggcaauuagcgauggguguguuuuugguuccugucaagauauuauaaaagaugaaauaacugucuauaggaaggagacugaggagaccacagauguggaauugugccugacauuugcagacaaaacauauugcacuaaccucaaugcaguuaccccuauaaucaccgaccaguuugaaguccaauuuaaaacuguagaggcuuacagucugccuagaaucauugcagugcggaaucaugagauuaugguugggcaaauaaaugacauagguguuuacucaaaaggcuguggaaauguacagaaaguaaacaacacaaauuauggaaauggugugccuaaguuugauuaccugugucauuuagcaaguagaaaagaagugauagugaggaaaugcuuugauaaugacuaccaggccugcaaauuucuacaaacaccagcaaguuauaggcuagaagaagagggagguucaguuacagucauagacuacaagaaaauccuuggcacuauaaagaugaaggcuauccuuggagaugugaaauauaaaacauuugcagacaaugcggacuuaaccguugaggggguaugcacuggcugcaucaauuguuuugaaaauauacauugugaguuaacaauacacaguacaguugaagccagcugcccgguaguaaguucguguacaguauuucaugauagaauuuuaauaaccccaaaugagcacaaguaugcuauaaaggugaucugcaaugaaaagccagguccuacauugccguucaagaucugcagugcaaagacagaugcugcaaugacacuggcagaugcuaagccaauauuagagcuagcaccuguagaccaaacaacauauauuaaggagaaaggugaaaggugcaagacuuggaugugcagaguaagagaugaagguuuucaaguaauuuuugaaccauucaaaaacuuauuugguucuuauauugggauauuuuauacauuuauaauaucuuuaauggcaauauuuauaguuauauauauuguguugccuauauguuucaaacuuagagacacacugaggcagcaugaagacgcuuauaagagagagaugaaaauuagguaa

SEQ ID NO: 4247 - RNA, 4323 nt, Artificial Sequence
  derived and/or modified CDS sequence (wt) from TAHV(90)__GQ386827.1__GP
augauguucguauuguuuuucauugcacuaagugcugcaagcccaguuuaucagagguguuuccaggauggugcaauugucaagcaaaacccauccaaacaggcuguaacagagguaugccuaaaggaugacguuaguaugauaaaaacagaagcuagauauuucagaaaugcuaccggaacauaugccaacaauguugccauuagaaaguggcuugucucagauuggcaugacugcagaccaaaaaaagucgcagggggucauauaaauguuauagaaguuggagaugacuugacgcugcauacagaggcauauguaugcaaugcagacugcacaauagguguagauaaagaaaccgcacaaguaagauugcaaacagauacaacaaaucauuuugagauugcaggaacaacaguuaagucagggugguucaaaagcacaacuuauaucacccuugaucaaacuugcgagcauuugaaaguuucuugugggccuaaaucuauacaguuccaugcguguuucaaucaacacaugucuuguguuagauucuuacauaggacaauccuaccugggucuauugccagcuccauaugccaaaauguagagauaauaauauuaacagugcuaacccuccuuauauuuauacuauuaagcauacugaguaaaacuuacauauguuauauacucaugccaauauuuaucccgcuugcuuauauauaugguguaauauauaauaaaucguguaaaaaauguaaacuaugcggauuaguuuaccaucccuucacugagugcggcacccauugcguauguggugcuagauacgagacaucggauaggaugaaauugcacagggcaucuggguuguguccagguuauaaaagucucagggcugcaagagucaugugcaaauccaaagggccagcuucuauuuuaucuauaaucacugcaguguuaauccuuacuuuugucacucccauaaaugccaugguagcuggggacacacaagaaacauuuaagcuugaggaccuaccagacgacaugcugagcauggcaaugaaaguaaauauguacuacauuauguguaugauaaauuaugcuguaacuuggucauuuauuuuaugugcccuauuaauugcuuuacucuucaagaaguaucagcauagauucuuaaacuuuuaugccauguacugccacgagugcgauauguaccaugauagaucuggccuaaaauauaauggagacuucacaaacaaauguagacagugcacaugcgggcaguacgaagaugccgcaggucuacuaacccacagaaaaacauacaacugccucgugcaguacaaaucaaaauggcugacuaauuucuuaauuggauacauaaucuugaugcuuauuaaagauucuguacuaauagugcaugcugauggcacagacuuugaaaaaugcaguggugaggcggauauaacauggaauuguacaggaccauucuugaaucuagguaauugugagaagaagcaaaagaaggagucauauaauaauauagcaacucaacuaaaagggcuagaugccauaucgguuuuagauauccccaugauaucuaaaauaccagaggauauagcuggagcccuaagauucauugaagagcaaagaucauaccauguccaacugacugcagaauaugcuaugcuaacuagauacugcgauuauuauacccaauucacugacaauucuggauacagucagaccacauggaggguuuacuugagaucccacgauuuugaggcauguauuuuauaucccaaucagcauuuuugcagaugugucaagcauggggacaaaugcucaagcuccaauugggauuucgccaaugagaugaagaacuauuacaguggaaaacaguccaaauuugauaaagauuuaaauuuagcauugauguccuuacaccacgcauuuagaggaacaucuaguuuuuauauugcuaaacuccugaaggaaaagaaaaaugaagaccuuguaacuuaugcagaaaagauuaaaggcaaauauccaggcaaugcccugcuaaaggcaauaauugacuacauaaaguauaugaaggguuuaaccgagaugaacaauuucaaacaugaugagaugugggaugacuucauauuugaaguuccuccuacaaagagcccaucaguaagaagauuagagucuucauaugauuuuaaaacugauguaaauucaaacccaucacacauuugcaagaauaucaaaacuguggucugcuugucaccaaagucaggagugucauaugauucaauaauugccuguggggagccaagccagccaagcaucuacagaaaaccagacagucaaguuuuccaaucaaaugcugaccagacacauuuuuguuuaucagauacacacugccuggaaaauuaugagacaguuggagaggaaaucauugaugcaauuaaaaaaucgaaaugcugggaaacagaauuuacugaguacauccaauuuaaacagagugaugggguaaggaguugcaggaugaaagacucaggagaauguacagucaccaccaauagauggccuauaauacucugcgauaacaauaaauucuacuacucugaguugcagaaagauuaugauaaggaccaggauauaggucacuucugucucagcccaagaugcaacacaauuaggcacccuauaaaucggaaacauauaucaaauuguacguggcagguuaaucacaacaauauagacaagauugagguacaugaacuggaggaucuugaacaguauaagaaggccauaacacagaaguugcagacaagccuaacccuauuuaaauacucaaagacaaaaaacuugccccauaucaagccuauguacaaauauauaacaauugaaggaacagagacugcugaggguauagaaagugcuuauauagaaucagagauacccgcucuagcaggaacaucaauagguuucaagaucacauccaagucuggaaagcauuuauuggaugucauugguuauguuaagagcgcaucuuauucggccguuuauacaaaauuguauacaacaggaccuacuauagguguuaacacuaaacaugaugaauuaugcacagggccauguccugucaaugugccucauggcacagguuggcucacauuugcuaaggagaggacaagcuccugggggugugaagaauuuggcugccuggcaauuagcgauggguguguuuuugguuccugucaagauauuauaaaagaugaaauaacugucuauaggaaggagacugaggagaccacagauguggaauugugccugacauuugcagacaaaacauauugcacuaaccucaaugcaguuaccccuauaauuaccgaccaguuugaaguccaauuuaaaacuguagaggcuuacagucugccuagaaucauugcagugcggaaucaugagauuaugguugggcaaauaaaugacauagguguuuacucaaaaggcuguggaaauguacagaaaguaaacaacacaaauuauggaaauggugugccuaaguuugauuaccugugucauuuagcaaguagaaaagaagugauagugaggaaaugcuuugauaaugacuaccaggccugcaaauuucuacaaacaccagcaaguuauaggcuagaagaagagggagguucaguuacagucauagacuacaagaaaauccuuggcacuauaaagaugaaggcuauccuuggagaugugaaauauaaaacauuugcagacaauguggacuuaaccguugaggggguaugcacuggcugcaucaauuguuuugaaaauauacauugugaguuaacaauacacaguacaguugaagccagcugcccgguaguaaguucguguacagcauuucaugauagaauuuuaauaaccccaaaugagcacaaguaugcuauaaaggugaucugcaaugaaaagccagguccuacauugccguucaagaucugcagugcaaagacagaugcugcaaugacacuggcagaugcuaagccaauauuagagcuagcaccuguagaccaaacaacauauauuaaggagaaagaugaaaggugcaagacuuggaugugcagaguaagagaugaagguuuucaaguaauuuuugaaccauucaaaaacuuauuugguucuuauauugggauauuuuauacauuuauaauaucuuuaauggcaauauuuauaguuauauauauuguguugccuauauguuucaaacuuagagacacacugaggcagcaugaagacgcuuauaagagagagaugaaaauuagguaa

SEQ ID NO: 4248 - RNA, 4323 nt, Artificial Sequence
  derived and/or modified CDS sequence (wt) from TAHV(94)__GQ386828.1__GP
augauguucguauuguuuuucauugcacuaagugcugcaagcccaguuuaucagagguguuuccaggauggugcaauugucaagcaaaacccauccaaacaggcuguaacagagguaugccuaaaggaugacguuaguaugauaaaaacagaagcuagauauuucagaaaugcuaccggaacauaugccaacaauguugccauuagaaaguggcuugucucagauuggcaugacugcaggccaaaaaaagucucagggggucauauaaauguuauagaaguuggagaugacuuaacgcugcauacagaggcauauguauguaaugcagacugcacaauagguguagauaaagaaaccgcacagguaagauugcaaacagauacaacaaaucauuuugagauugcaggaacaacaguuaagucagggugguucaaaagcacaacuuauaucacccuugaucaaacuugcgagcauuugaaaguuucuugugggccuaaaucuauacaguuccaugcguguuucaaucaacacaugucuuguguuagauucuuacauaggacaauccuaccugggucuauugccagcuccauaugccaaaauguagagauaauaauauuaacagugcuaacccuccuuauauuuauacuauuaagcauacugaguaaaacuuacauauguuauauacucaugccaauauuuaucccgcuugcuuauauauaugguguaauauauaauaaaucguguaaaaaauguaaacuaugcggauuaguuuaccaucccuucacugagugcggcacccauugcguauguggugcuagauacgagacaucggauaggaugaaauugcacagggcaucuggguuguguccagguuauaaaagucucagggcugcaagagucaugugcaaauccaaagggccagcuucuauuuuaucuauaaucacugcaguguuaauccuuacuuuugucacucccauaaaugccaugguagcuggggacacacaagaaacauuuaagcuugaggaccuaccagaugacaugcugagcauggcaaugaaaguaaauauguacuacauuauguguaugauaaauuaugcuguaacuuggucauuuauuuuaugcgcccuauuaauugcuuuacucuucaagaaguaucagcauagauucuuaaacuuuuaugccauguacugccacgagugcgauauguaccaugauagaucuggccuaaaauauaauggagacuucacaaacaaauguagacagugcacaugcgggcaguacgaagaugccgcagcucuacuaacccacagaaaaacauacaacugccucgugcaguacaaaucaaaauggcugacuaauuucuuaauuguauacauaaucuugaugcuuauuaaagauucuguacuaauagugcaugcugauggcacagacuuugaaaaaugcaguggugaggcggauauaacauggaauuguacaggaccauucuugaaucuagguaauugugagaagaagcaaaagaaggagucauauaauaauauagcaacucaacuaaaagggcuagaugccauaucgguuuuagauauccccaugauaucuaaaauaccagaggauauagcuggagcccuaagauucauugaagagcaaagaucauaccauguccaacugacugcagaauaugcuaugcuaacuagauacugcgauuauuauacccaauucacugacaauucuggauacagucagaccacauggaggguuuacuugagaucccacgauuuugagguaugcauuuuauaucccaaucagcauuuuugcaggugugucaagcauggggacaaaugcucaagcuccaauugggauuucgccaaugagaugaagaacuauuacaguggaaaacaguccaaauuugauaaagauuuaaauuuagcauugauguccuuacaccacgcauuuagaggaacaucuaguuuuuauauugcuaaacuccuaaaggaaaagaaaaaugaagaucuuguaacuuaugcagaaaagauuaaaggcaaauacccaggcaaugccuugcuaaaggcaauaauugacuacguaaaguauaugaaggauuuaaccgagaugaacaauuucaaacaugaugagaugugggaugacuucauauuugaaguuccuccuacaaagagcccaucaguaagaagauuagagucuucauaugauuuuaaaacuaauguaaauucaaacccaucacacauuugcaagaauaucaaaacuguggucugcuugucaccaaagucaggagugucauaugauucaauaauugccuguggggagccaagccagccaagcaucuacagaaagccagacagucaaguuuuccaaucaaaugcugaccagacacauuuuuguuuaucagauacacacugccuggaaaauuaugagacaguuggagaggaaaucauugaugcaauuaaaaaaucgaaaugcugggaaacagaauuuacugaguacauccaauuuaaacagagugaugggguaaggaguugcaggaugaaagacucaggagaauguacagucaccaccaauagauggccuauaauacucugcgauaacgauaaauucuauuacucugaguugcagaaagauuaugauaaggaccaggauauaggucacuucugucuuagcccaagaugcaacacaauuaggcacccuauaaaucggaaacauauaucaaauuguacguggcagguuagucacaacaauauagacaagauugagguacaugaacuggaggaucuugaacaguauaagaaggccauaacacagaaguugcagacaagccuaacccuauuuaaauacucaaagacaaaaaacuugccccauaucaagccuauguacaaauauauaacaauugaaggaacagagacugcugaggguauagaaagugcuuauauagaaucagagauacccgcucuagcaggaacaucaauagguuucaagaucacauccaagucuggaaagcauuuauuagaugucauugguuauguuaagagcgcaucuuauucagccguuuauacaaaauuguauacaacaggaccuacuauagguguuaacacuaaacaugaugaauuaugcacagggccauguccugucaaugugccucauggcacagguuggcucacauuugcuaaggagaggacaagcuccugggggugugaagaauuuggcugccuggcaauuagcgauggguguguuuuugguuccugucaagauauuauaaaagaugaaauaacugucuauaggaaggaaacugaggagaccacagauguggaauugugccugacauuugcagacaaaacauauugcacuaaccucaaugcaauuaccccuauaaucaccgaccaguuugaaguccaauuuaaaacuguagaggcuuacagucugccuagaaucauugcagugcggaaucaugagauuaugguugggcaaauaaaugacauagguguuuacucaaaaggcuguggaaauguacagaaaguaaacaacacaaauuauggaaauggugugccuaaguuugauuaccugugucauuuagcaaguagaaaagaagugauagugaggaaaugcuuugauaaugacuaccaggccugcaaauuucuacaaacaccagcgaguuauaggcuagaagaggagggagguucaguuacagucauagacuacaagaaaauccuuggcacuauaaagaugaaggcuauccuuggagaugugaaauauaaaacauuugcagacaauguggacuuaaccguugaggggguaugcacuggcugcgucaauuguuuugaaaauauacauugugagucaacaauacacaguacgguugaagccagcugcccgguaauaaguucguguacaguauuucaugauagaauuuuaauaaccccaaaugagcacaaguaugcuauaaaggugaucugcaaugaaaagccagguccuacauugccguucaagaucugcagugcaaagacagaugcugcaaugacacuggcagaugcuaagccaauauuagagcuagcaccuguagaccaaacaacauauauuaaggagaaagaugaaaggugcaagacuuggaugugcagaguaagagaugaagguuuucaaguaauuuuugaaccauucaaaaacuuauuugguucuuauauugggauauuuuauacauuuauaauaucuuuaauggcaauauuuauaguuauauauauuguguugccuauauguuucaaacuuagagacacacugaggcagcaugaagacgcuuauaagagagagaugaaaauuagguaa

SEQ ID NO: 4249 - RNA, 4323 nt, Artificial Sequence
  derived and/or modified CDS sequence (wt) from TAHV(XJ0625)__EU622819.2__GP
augauguuuguauuguucuuuauagcacuaaguacugcaaguccaguguaccaaagguguuuccaagauggugcaauugugaagcagaacccauccaaacaggcuguaacagaaguaugccugaaggaugauguuagcaugauaaaaacagaagcuagguauuucaaaaaugcuacuggaacauaugcaaauaauguugcaaucaggaaaugguugguuucagacuggcaugauuguagaccaaaaaaaguagcaggaggccacauaaaugucauagaaguaggggaugacuuaaccuuacauacugaagccuauguaugcaaugcagacugcacaauaggaguggacaaagaaacugcacaggugagguugcagacagacacaacgaaccauuuugagauugcagguacaacuguuaaaucagggugguucaaaagcacaacauauaucacccuugaucaaacuugcgagcauuuaaagguuuccugcggcccaaaaucuguccaguuccaugcuugcuucaaucagcacaugucuuguguaagauuucugcacaggacuauacugccuggcucuauagcgaguuccauaugucaaaauguagaaauaauaauuuuaacagugcuaaccuuacuaauuuucauauuacuuaguauacuaagcaaaacauauauaugcuaucuauugaugccaauauuuaucccacuugccuauguauaugguguuauauauaacaaaucaugcaaaaaauguaaauuaugcgguuuaguuuaccacccauucacagaauguggcacucauugcguguguggugcuagauaugaaacuucugauaggaugaaauugcauagggcgucaggcuuaugcccagguuacaaaagucugagggcagcacgaguuauguguaagucgaaagggccagcaucuauacuaucuguaauaacugcaguauugauacuaacauuugugaccccaauaaaugcaaugguugcuggagauacgcaagaaacauuuaagcuugaagaucugccggaugauauguuaaguauggcuaugaaaauacagauguauuauauaaugugcauugucaacuauauugucacuuggucguucauuguaugugcuuuaauaauugccuugauuuuuaagaaguaccaacacagauucuuaaauuuuuaugccauguauugucaugaaugcgauauguaccaugauaggucaggcuuaaaauauaauggggacuucacaaacaaauguaggcagugcacauguggucaguaugaagaugcugcaggcuuacuaacccauaggaaaacauacaauugccuaguacaauacaaaucgaagugguuagugaauuuuuugauaauauacauacuucugaugcuuguaaaagauucaguacuaauaguccaagcagaaggcacagauuuugaaaaauguaguggggaaauaaacauaaccuggaauugcacaggaccuuuccuaaacuuaggcaauugugagaagaaacaaaagaaggagccauacagcaacauagcgacacaauugaagggccuagaugcuauaucuauuuuagacaucccaaugauaucaaggauaccugaagauauagcuggagcucugagguuuauugaagagcaaaauucauaccaugugcagcugacugcagaauaugcaaugcuaaccagauauugugacuauuacacucaauuuagugauaauucagguuauagccaaaaaacauggagaguauacuuaagaucccaugauuucgaagcauguauauuguacccaaaccagcauuuuugcagauguguuaagcauggugacaaauguucaagcucaaacugggacuuugcuagugagaugaagaauuauuacacuggcaaacaacugaaauuuaauaaagauuuaaauuuagcucugaugucuuuucaucaugcuuuuagagggacaucuagcuucuauguugcaaaacuccuaagagagaaaaauaaugaggaauuggugaauuacacagaaaagauaaaagauaaguacccaggcaaugcacuuuugaaagcuauaauugacuacauaaaauauaugaagaaccuaagugagaugaccaacuuuaaacaugaugagaugugggaugauuuuguuuuuaauagucccccaacuaaaagcccuucuguaagacgcucagacucugcauaugauuucaagaauaauauaaauucaaauccaucacauauaugccagaauauaaaaacuguuauaugucuaucaccaaaaucuggaguaucuuacgauucaauaauagcuuguggcgaaccgagucagccgacaauuuauaaaaagccagaaagcagaguguuucagucaaaugcagaucaaacacacuucuguuuagcagauacccauugccuggagaacuaugagacaguaggugaagaaauucuugacgcuauuaagaaaucaaaauguugggagacagauuuuacugaguacauucaauucaaacaaagugacggaguaagaagcugcagaaugaaagauucaggagaauguacagugaccacccacagauggccuaucauacugugcgacaauaacaaguuuuacuacucugaauugcaaaaggacuaugacaaagaucaagauauaggccauuucugccucagccccagaugcaauacaaucaggcauccaauaaaucagaagcacauaucaaauugcacauggcaagucagucacaauaauaucgagaagauugaagugcacgaguuggaaaaucuggagcaauauaagaaggcuauaacucaaaaguuacagacaaguuuaacauuauucaaguauucuaaaacaaaaaaccuaccccauauuaagccaauguacaaauacauaacuauugaggguacagaaacagcagaagguauugaaagugccuauauagagucagaaauaccugcauuagcuggaacaucaauaggguuuaaaaucacauccaagucaggaaagcacuuauuagaugugauagguuaugucaaaagugcaucuuacucagcuguuuauacaaaguuguacacaacaggcccaacaaucggugucaacacaaagcaugaugaguuguguacaggcccauguccaguuaauguaccacacggcacugguuggcuaacauuugcuaaagagagaacaagcucgugggguugugaggaguuugguugccuggcgauuagcgacgggugugucuuuggcucaugucaagauauuauaaaagaagagcuagcuguuuauaggaaagaaacugaagagacuacagauguagaauuaugccuaaccuuugcagauaaaacuuauugcaccaaucugaacgcaauaacaccaauaaucacugaccaauuugaaguucaauucaaaacagucgaaucuuauaguuuaccuagaauuauugcuguacgaaaccaugaaaucauggugggacagauaaaugauaucggcguuuauucgaaagguugcggaaaugugcaaaagguaaauaauacaaacuaugggaaugguguacccaaauuugauuauuuaugccauuuagcaaguaggaaagaaguaauagucagaaaaugcuuugauaacgauuaucaggcuugcaaauuucuacaaacaccagcaagcuauagacuagaggaagagggcgguucuguuacaguuauagauuauaaaaagauucucggaacaauaaagaugaaggcuauucugggagauguaaaauacaaaacguuugcagacaauguagauuuaacuguugaaggggugugcacaggguguaucaauuguuuugaaaauauacacugugaacugacaauacauagcacaguggaagcaaguugcccagugacaagcucaugcacuguguuucacgauagaauccugauaacaccaaacgagcacaaauacgcuauaaagguaauuugugcugaaaaaccagggccaucauuacaguucaaaauauguaaugcaaaaacugaugcagcuaugacauuagcagaugcaaaaccaauauuagaauuagcgccaguugaucagacaacauauauaaaggaaaaagaugugagaugcaaaaccuggauguguagagucagagaugaaggccuccaaguuauauuugaaccauucaagaaccuauuuggcucuuauauaggcauauuuuauacauuuuuaauaaccuuaauugccguauucguagucauauacaucgugcugccaauaugcuuuaaacuuagagacacuuugaggcagcaugaagaugccuacaagagagaaaugaaaauuagauaa

SEQ ID NO: 4250 - RNA, 4323 nt, Artificial Sequence
  derived and/or modified CDS sequence (wt) from TAHV(XJ0708)__HM243138.1__GP
augauacuuguacuggucuuuguugcacuaagugcugccagcccagucuaucagagguguuuccaggauggugcaauugucaaacaaaguccauccaaacaagcagugacggaagugugcuugaaggaugaugucagcaugauaaaaacagaagcuagauacuuuaagaaugcaacuggaacauaugcgaauaauguugcuauuaggaaguggcuuguaucagacuggcaugauugcaggcccaagaaaauuucuggaggccacauaaaugugauagaagugggagaugauuuaacacugcacacagaagcuuauguuuguaaugcagauugcauaauuggaguggauaaagagacagcacaagugagauugcaaacagacacaacaaaccacuuugagauugccggcacuacugucaaaucugggugguucaaaagcacuacuuauauuacccucgaccagacaugugagcacuugaaagucucaugcgggccuaagucuauucaauuccaugcuugcuuuaaucagcacaugucaugugucagauuuuugcauaggacaauauuaccuggauccauagcuagcucgauaugccaaaauguugaaauaauaauacuaacaguuuuaacucuacuuauauucauuuuacuuaguauacuaagcaaaacauauauaugcuauauuuuaaugccaauauuuaucccauuagcuuauguguacggcguuauauauaacaagucuugcaagaagugcaaacuaugugggcuaguuuaccauccauuuacagaguguggaacucacuguguuugcggugcucgauaugagacaucugacagaaugaaguugcauagagcaucuggauuaugcccggguuauaaaagucucagagcagcaagggucaugugcaaguccaaagggccagcaucaauauuauccaucauaacugcaguacuaaucuuaacauuuguuacuccaauaaaugccaugauugcuggggaaacacaagagacauuuaaacuugaagauuugccagaugacauguuaaguauggcuaugaaacuaaacauguacuauuugaugugcauuguuaauuauauuguuacuuggucauuuaucauaugugccuuaauaauugcgcuaaucuuuaaaaaauaccaacauagauucuugaauuucuaugccauguacugccaugagugcgauauguaucaugaccgauccggucuuaaauauaauggugacuuuacaaacaaaugcagacaaugcacaugugggcaauaugaggaugcugcugggcugcugacucacaggaaaacauauaauugccuggugcaauauaaaucaaaauggcuaguuaacuuuuugauuguauacauacuacuuaugcuugucaaggauuccauauugauaguccaagcagagggcacagauuucgauaaaugcaguggagaggcaggcauaauuuggaauuguacagggccauucuuaaaucuaggcaacugcgagaaaaaacagaaaaaagaaucguauaauaauauugcaacgcagcugaagggauugaaugcaaucucuguuuuagauauuccuaugauaucaagaauaccagaggauauagccggggcauuaagguucauugaagaucagaacucauaucauguccagcugacagcugaguaugcuaugcuaacuagguacugcgacuacuacacacaguucagcgacaauucaggauauagccagacaacauggagaguuuaucuaaggucucauaacuuugaggcuugcauauuauacuccaaccaacacuucuguagaugugucaaacauggagauaagugcucaagcucuaacugggauuuugcuaacgaaaugaagaauuauuauucugguaaacaguccaaguucaacaaagaucuaaaccuggcauuaaugucucuucaucaugccuuuagaggaacauccagcuuuuauauugccaaacucuugagagagaagaagaaugaagaauuaauaaauuauguggaagagauuaagaagaaguacccagguaaugcauuacuaaaagcugugauugauuacaucaaguauaugaagaaucuaacagagauggcuagcuuuaagcacgaugagaugugggaugaauuuguauaugagaguccaccaacaagaagcccauccgccagaagaucagaaucugaauaugauuucaaaacuaaugugaauucaaaaccaacacauguauguaaaaacauaaaaacuguuguaugcuugucaccaaaaucaggggugucuuaugauucaauaauugcuuguggugagccagggcagccaaguguauauaggaagccagagcaacaagucuuccaauccaaugcagaccagacacacuucugccuauuggacacacauugcuuagaaaauuauacaacugucaaugacgaaauucuagaugcgauaaaaaaauccagauguugggagacugaauucacugaguauauucaguucaaacagggcgauggggugaggaguuguagaaugaaagacucuggcgaaugugcuguagcagcaaacagguggccuauaauauugugugacaauaauaaauuuuauuacucagagcugcaaaaggacuaugauaaagaccaggauauaggccacuucugucuuaguccuagaugcaacacaaucaggcacccaauaaaucagaagcacauaucaaauuguacauggcaagucagucacaauaauauagaaaagauugagguccaugaauuagaaaaucucgaacaauacaaaaaagccaucacccagaaauugcagacaagcuugacacuauucaaguauucaaaaacgaaaaaccuuccucauaucaagcccauguauaaguauauaacaauugagggaacagagacagcagaggguaucgagagugcauauauagaaucggagauaccugcccuugcagggacaucaauaggauucaaaaucacuucuaaaucuggaaagcacuuacuagauguuauuggcuacguuaagagugcaucuuauucaucuguauacacacgacuguauacaacaggcccaaccauugguaucaauacaaggcaugaugaguugugcacaggaccauguccagucaaugucccccacaacacugguuggcuuacauuugcaaaagaaaggacaaguucuugggggugugaagaauuuggauguuuagccauuagugauggguguguuuuugguucuugccaggauaucauaaaggaagaguuaacaguuuauagaaaagaaacugaagaaaccacugauguagaauuaugucuaacguuugcagacaaaaccuauuguaccaaucucaaugcaaucacuccuauaauuacugaucaguuugagguucaauucaaaacuguugaagcuuauagccugccuagaauuauugcaguacggaaccaugagauacugguaggccaaauaaaugaucucgguguuuauucaaaagguugcgguaauguacagaaaguaaauaaaacaaauuacgggaauggugugccaaaauucgauuauuugugccauuuagcaagcagaaaagaaguuauaguuaggaaaugcuuugacaaugauuaucaggcuuguaaguuuuugcagacaccagccagcuauaggcuagaagaggaagguggaacagugacagucauugauuauaaaaagauucuugggacuauaaagaugaaagccauacuuggagauguaaaauauaaaacuuuugcagauaaugucgaccuaaccauagaaggaguaugcacaggaugcauuaauugcuucgaaaacauacacugcgaauugacaauacauagcacuguugaagcuagcugcccaauuauuagcucaugcacaguauuucaugauagaauuuuaauaacuccgaaugagcauaaauaugccauaaaagugaucuguaaugagaagccugguucaucauuaucauucagagucugcaacacaaaaacugaugcagccaugacuuuaacagaugcgaaaccaauauuagaauuagcaccaguggaucaaacagcauacauaaaggaaaaagaugagagaugcaaaaccuggaugugcaggguuagagaugaaggucuccaggugaucuuugagccauucaagaaccuauuugguucuuauauagggauauuuuauacuuucauauuaucuuuaauugcaauauucauaaucauauacauugugcucccuauaugcuucaagcuuagagacacuuuaaggcagcaugaagaugcuuacaaaagggagaugaaaauuagguaa

SEQ ID NO: 4251 - RNA, 4323 nt, Artificial Sequence
  derived and/or modified CDS sequence (wt) from TAHV(XJ0710)__HM243141.1__GP
augauguucguauuguuuuuuauagcacuaagugcugcaaguccaguguaccaaagguguuuccaagauggugcaauugugaagcagaacccauccaaacaggcuguaacagaaguaugccugaaggaugaugucagcaugauaaaaacagaagcuagguauuucaaaaaugcuacuggaacauaugcaaauaauguugcaaucaggaaaugguugguuucagacuggcaugauuguagaccaaaaaaaguagcaggaggccacauaaaugucauagaaguaggggaugacuuaaccuuacacacugaagccuauguaugcaaugcggacugcacaauaggaguggauaaagaaacugcacaggugagguugcaaacggacacaacgaaccauuuugagauugcagguacaacugucaaaucagggugguucaaaagcacaacguauaucacccuugaucaaacuugugagcauuuaaagguuucuugcggcccgaaaucuguccaguuccaugcuugcuucaaucaacacauguccuguguaagauuucugcacaggacuauacugccugguucuauagcgagcuccauaugucaaaauguagaaauaauaauuuuaacaguacuaaccuugcuaauuuucauauuacucaguauacuaagcaaaacauauauaugcuaucuauugaugccaauauuuaucccacuugccuauguauaugguguuauauauaauaaaucaugcaaaaaauguaaauuaugcgguuugguuuaccacccauucacagaauguggcacucauuguguguguggugcuagauaugagacuucugauaggaugaaauugcauagggcaucaggauuaugcccagguuacaaaagccuuagggcagcacgaguuauguguaagucaaaagggccagcaucuauacuaucuauaauaacugcaguauugauacuaacauuuguaaccccaauaaaugcaaugguugcuggagauacacaagaaacauuuaagcuugaagaucuaccagaugauauguugaguauggcuaugaaaauacagauguauuauauaaugugcauugucaacuauauugucacauggucauucauuguaugugcuuuaauaauugccuuaauuuuuaagaaguaccaacauagauucuuaaauuuuuaugccauguauugucaugaaugcgauauguaccaugauaggucaggcuuaaaauacaauggggauuucacaaacaaauguaggcagugcacauguggccaguaugaagaugcugcaggcuugcuaacccauaggaaaacauacaacugccuaguacaauacaaaucgaagugguuagugaacuuuuuaauaauauauauacuucugaugcuuguuaaagauucaguacuaauaguccaagcagaaggcauagauuucgaaaaauguaguggagaaauaaacauaaccuggaauugcacaggaccuuuccuaaacuuagguaauugugaaaagaaacaaaagaaggagccauacaguaacauagcgacacaauugaagggccuagaugcuauaucuauuuuagacaucccaaugauaucaaggauaccugaagacauagcuggagcucugagguuuauugaagagcaaaauucauaucaugugcagcugacugcagaauaugcaaugcuaaccagauauugugacuauuacacucaauuuagugauaauucagguuauagccaaacaacauggaggguguaccuaagaucucacgauuucgaagcauguauauuguacccaaaccagcauuuuugcagauguguuaagcacggugauaaauguucaagcucaaacugggacuuugcuaguaagaugaagaauuauuacacuggcaaacaacugaaauuuaauaaagauuuaaauuuagcuuugaugucuuuucaucaugcuuuuagagggacaucuaguuucuauguugcgaaacuccuaagagagaaaaauaaugacgaguuggugaauuacacagaaaagauaaagaauaaguacccaggcaaugcacuuuugaaagcuauaauugacuauauaaaauauaugaagagccuaagcgagaugaccaacuuuaaacaugacgagaugugggaugauuuuguuuuuaauagucccccaacuaagagcccuucuguaagacgcucagacucugcauaugauuucaaaaauaacauaaauucaaauccaucacacauaugcaagaauauaaaaacuguuguauguuuaucaccaaaaucuggaguaucuuaugauucaauaauagcuuguggcgaaccaagucagccgacaauuuacaaaaagccggaaagcagaguguuucagucaaaugcagaucagacacacuuuuguuuagcagacacccauugccuggagaacuaugagacaguaggugaagaaauucuugaugcuauuaagaaaucaaaauguugggagacagauuuuacagaguacauucaauuuaaacaaagugauggaguaagaagcugcagaaugaaagauucaggagaaugcacagugaccaccaacagauggccuaucauauugugugacaauaacaaguuuuacuacuccgaauuacaaaaagacuaugacaaagaccaagauauaggccauuucugccucagcccuagaugcaauacaaucaggcauccaauaaaucagaagcacauaucaaauuguacauggcaagucagucacaacaauaucgagaagauugaagugcaugaguuggaaaaucuagagcaauauaagaaggcuauaacucaaaaguuacagacaaguuuaacauuauuuaaguacucuaaaacaaaaaaccugccccauaucaagccuauguauaaauacauaacuauugaggguacagagacagcagaagguauugaaagugccuauauagagucagaaauaccugcauuagcuggaacaucaauaggguuuaaaaucacauccaagucaggaaaacauuuauuagaugugauagguuaugucaaaagugcgucuuacucagcuguuuauacaaaguuguacacgacaggcccaacaaucggugucaauacaaagcaugaugaguugugcacaggcccaugcccagucaauguaccgcacggcacugguuggcuaacauuugccaaagagagaacaagcucgugggguugugaggaguuugguugccuggcgauuagugacgggugugucuuugguucaugucaagauauuauaaaagaagagcuagcuguuuauaggaaagaaacugaagaggcuacagauguagaauuaugccuaaccuuugcagauaagacuuauugcaccaaccugaaugcaauaacaccaauaaucacugaucaauuugaaguucaauucaaaacagucgaaucuuauaguuuaccuagaauuauugcuguacggaaucaugagaucaugguggggcagauaaaugauaucggcguuuauucgaaagguugcggaaaugugcaaaagguaaauaauacaaauuauggcaaugguguacccaaauuugauuauuuaugccauuuagcaaguaggaaagaaguaauagucagaaaaugcuuugauaacgauuaucaagcuuguaaauuucuacaaacaccagcaagcuauagauuggaggaagagggugguucuguuacaguuauagauuauaagaagauccucggaacaauaaagaugaaggcuauucuaggagauguaaaauacaaaacauuugcagacaauguagauuuaacuguugaaggggugugcacaggguguaucaauuguuuugaaaauauacauugugaacugacaauacauaguacaguggaagcaaguuguccagugacaagcucaugcacuguguuucaugauagaauccugauaacaccaaaugagcacaaauacgcuauaaaggugauuugugcugaaaaaccagggccaucauuacaguucaaaauauguaaugcaaaaacugaugcagcuaugacauuagcagaugcaaaaccgauauuagaauuagcgccaguugaucaaacaacauauauaaaggaaaaagaugagagaugcaaaaccuggauguguagagucagagaugaaggccuccaaguuauauuugaaccguuuaagaacuuauuuggcucuuauauaggcauauuuuauacauuuuuaauaaccuuaauugccguauucauagucauauacaucgugcugccaauauguuuuaagcuuagagacacuuuaaggcagcaugaagaugccuacaagagagaaaugaaaauuagauaa

SEQ ID NO: 4252 - RNA, 4326 nt, Artificial Sequence
  derived and/or modified CDS sequence (wt) from TVTV__AF123491.1__GP
augauuguuuuugcuuugcuaacaauuguggcugcaaguccugucuacaaaagauguuuccaagauggagcaauugucagacaagaguacucaaaaaaugcaguuacugaagucugcuuaaaagacgauguuaguaugauaaaaacagaggcugaauacuucaagaauucaaccggcguuuuuucaaaaaacauagcauacaggaaauggcuaguuucagauuggaaugagugcaggccacaaaagucagcaaauggacacaucaaugugauugaaguucaaccagaccuaucuuugcaaacuaacuccuaugucugugcugcaacauguguuaucaguauugauaaagaaacagcacagguacgccuucagacagauacaacaaaccauuuugaaauaucuggcacaacugugaaaucuggaugguuuaagagcacuacauaccuaacccucgaucagacuugugaacauuugaaaauuucaugugguucaaagucuguacaacuacaugcgugcuucaaucagcauaugagcuguguuagauuucuacauaggacaauucuaccaggaaaacaucgcaaaucaauuugucaaaauauagaaauaaucauacugacuagccuaagucuuuuuauauuuuuauucuuaacaauaauaaguaagacauauauauguuauguacuaauaccaauauucauaccaauagcuuacguauauggauuuaucuacaauaaaucauguaaaaaaugcaaacuauguggacugguauaucacccuuuuacagaaugcggcagucauuguguuuguggggcaaaauaugacacaucugacaggaugaaaaugcauagaucaucaggauuauguccaggguauaaaagcuuaagggcugcaagaucuaugugcaaaucaaaaggaccagcucccauacuaucguuauugagugcagucuugauccuaacuuuuguaacaccuauaacggccauaucacuuaaagaugaagaaaaagaaacauacaaauuaccagaauuaccugaugauaagguuaauuuggaaaccaagauugacuuauacuuccaaaugugucuaauaaauuaugcaacuacaugggcucuaauuuucuguguauuaauaacugcauguuuauucaaaaagcuucaacauaaguuucuugauuauuaugcugucuauugccaugaaugugacauguaucaugaaaagacgagccugaaauacaauggugauuucucaaacaaaugcagacaaugcacaugugaacaguaugaggaugcuacuggauuacuaacacaucggaaaucauauaaucgucuaguacaauauaaagcaaaauggacguugaauuucuugauaacauaugcuaucuuaguuaucaucaaagacucuguaaugauuguaggugcaagcaauacagaugucaaggauugcuuggaccaagaagaaauaaccuggaauuguacuggacccuucuugaauaugggaagaugcacaagaccucaaaaaaaggaaaacuacggaaauauagcaacucaacugaaaggccuagauguguuaucugcuuuagauaugccagcuguagguaaaauaccagaagauauugcuggggcauugucauacaucgaaucuaaaaagacauaucaugaacaauuaacuuuagaauuugcaaugcuaacaagguauugugauuucuauaagcaauaugcugacaauucaggcuacagucagacaacauggagggcauacauaagaucucaugacuuugggguuuguauaauguacccgaaucaacauuuuuguagguguguaaaaaugggggaaaaauguacaaguucaaauugggacuuugcaaaucaaauggcuaacuacuauaaugggaagcaaaauagauuuaacaaagauuuaaauuuagcauuauauaccaugcaucaugcuuuuagaggaaguacuaguuacuuaauaucuaaaguccuccaugagaaaaaauaugaccaauugacuaaucuuuuaacacaauugaagacaaaauaucccgguaaugcuuuauugaaagcacugauaggcuaccaaaucuauuuaaaaagccuuagugaaaugucuaguuuuacaccugacgagcucugggaugaucugcaauaugucccagccccaacauuuaaaccaaaucucggcagaaguggagacaaugaauacaaguuugacaaaucaagaauagucgauccacaaacuacauguaccucuuugaaaggagugaauugcuuaucgccaagaucgcgagcaagugugagugauauuauagcauguggacaagcuacacagccagcauuguuuuauguaccaaaugauaaaauccaccaaucuaacacagaucagaaucaauauuguaucggugauucucauugcuuaacaaaauucacgcccauaacagaagaauuguuggcagcuguaaaaaaaucaaaaugucaggcuuuugauuuagacaauauuguuaaaacuaguacaucaacugggguuagaagcugcuugguuaaaaaguuuggaaacugcaacacuacaaaccaaguauggccgauaacuauaugcucugacgaucaauauuauuauacagacacgaaacaaucauaugacucauaucaagauauuggacacuucugccuaucuccaagguguucaacaauccgauauccaguaaacccaaaacaucuaucugcauguacauggacggaagaauauacaccagucgacaaaauuucugugacaaauauugaggaaauagagcaauauaaaaaagcucuauuacaaaaauugcagacagggcugaacauuuucaaauacaggaagacaagcaaucuaccacacaucaagucaauguauaaauacauaacaguucaaggaacagggacugcugaaggcguagaaaaugcuuacauagaaucugaaaugccugcuuuggccgguaguucuucuggauuuaaaguuuuaucuaaagaagguaaucauuuauuugauguuguggccuauauaaagucugcaucauauuccucaguuuauaauaaauuauacaguacgggacccaccuuaggcauaaauguaaaacaugaugagaaaugcacagggccauguccugcaaacauuccacauaagacagguugguuaacuuuugcuagagagagaacaagcaccuggggacgugaagaauauggaugcuuggcaauuagugauggauguguuuuugguuccugucaagauauaauuaaaccugagaugacuguuuauaggaagcaaacagaugaaauugucaccguagaauuaugucuaacuuuuguggacaaaacuuauugcacugaauugaaugcuguaacaccuauaauaucagacuuauuugagguacaauucaaaacaguagaaaguuacaguuuacccaaaauaguugcaauuaaaaaucaucaaauuuuuguaggccaaaucaaugucauuggaacuaauucaaaaggcugcggaaaugugcagguauuuaauggaacaaauuaugguucaggaacccccagauuugacuaucuaugccaucuggcaagcagaagagaagucauaaugaggaaguguuuugacaaugauuaccaagcauguaaguuuuuacaacaacccucaaguuuuagacuugaggaagagggagaaaccguaacaauaauugauuacaaaaaaauauuggggacaauaaagaugaaagcaauuuucggggacguaaaauauagaacuuuuagugaaaaaguggauauaaaugcugaaggugucugcgcagggugcaucaauuguuuugagagaauuaacugugaguucacaauccacagcacuguugaaacaaguuguccuuuaguagcagauugucaauuguuccaugacagguuacuuauaacaccaaaugaacacaaauaugcuauaaaagcuauuugcaaagauaaaccuucaaacacuuugagauuuaguaucugcaacacaaagguugaagcaacagucacuauaauagaugcaaaaccuauauuggagcuugccccuguggaucaaacagcauauauuaaggagaaagaugaaaggugcaaaacauggcuuuguagagugaaagaugaagguguggcaguucuauuggagccauuuaagaacuuguuugguucauauauagggauauuuuauggaauaauucuugucgucuuagcuauacuaguuuguauauauaucgucuugccaguaugcuuuaaaauuaaagacacucuaaagaagcacgaggaugcuuacaaaagagaaaugaaaauaagguaa

SEQ ID NO: 4253 - RNA, 4335 nt, Artificial Sequence
  derived and/or modified CDS sequence (wt) from TVTV(AR42)__KX891322.1__GP
augaggaauaugauuguuuuugcuuugcuaacaauuguggcugcaaguccugucuacaaaagauguuuccaagauggagcaauugucagacaagaguacucaaaaaaugcaguuacugaagucugcuuaaaagacgauguuaguaugauaaaaacagaggcugaauacuucaaaaauucaaccggcguuuuuucgaaaaacauagcauacaggaaauggcuaguuucagauuggaaugagugcaggccacaaaagucagcaaauggacacaucaaugugauugaaguucaaccagaccuaucuuugcaaacuaacuccuaugucugugcugcaacauguguuaucaguauugauaaagaaacagcacagguacgccuucaaacagauacaacaaaccacuuugaaauaucuggcacaacugugaaaucuggaugguuuaagagcacuacauaccuaacccucgaucagacuugugaacauuugaaaauuucaugugguucaaagucuguacaacuacaugcaugcuucaaucagcauaugagcuguguuagauuccuacauaggacaauucuaccaggaaacaucgcaaauucaauuugucaaaauauagaaauaaucauacugacuagccuaagccuuuuuauauuuuuauucuuaacaauaauaaguaagacauauauauguuauguacuaauaccaauauucauaccaauagcuuacguauauggauuuaucuacaauaaaucauguaaaaaaugcaaacuauguggacugguauaccacccuuuuacagaaugcggcagucauuguguuuguggggcaaaauaugacacaucugacaggaugaaaaugcauagaucaucaggauuauguccaggguauaaaagcuuaagggcugcacgaucuaugugcaaaucaaaaggaccagcuucuauacuaucguuauugagugcagucuugauccuaacuuuuguaacaccuauaacagccauaucacuuaaagaugaagaaaaagaaacauauaaauuaucagaauuaccugaugauaugguuaauuuggaaaacaagauugacuuauacuuccaaaugugucuaauaaauuaugcaacuacaugggcccuaauuuucugugcauuaauaacugcauguuuauucaaaaagcuucaacauaaguuucuugauuauuaugcugucuacugccaugaaugugacauguaucaugaaagaagaggccugaaauacaauggugauuucucaaacaaaugcagacaaugcacauguggacaguaugaggaugcuacuggauuacuaacacaucggaaaucauauaauugucuagugcaauauaaagcaaaauggauguugaauuucuugauaacauaugcuaucuuaguuaucaucaaagauucuguaaugauuguaggugcaagcgauacagaugucaaggauugcuuggaccaagaagaaauaaccuggaauuguacuggacccuucuugaauaugggaagcugcacaagaccucaaaaaaaggaaaacuacggaaauauagcaacucaacugaaaggcuuagauguguuaucugcuuuagauaugccagcuguaggcaaaauaccagaagauauugcuggggcauugucauacauugaaucuaaaaagacauaucaugaacaauuaacuuuagaauuugcaaugcuaacaagguauugugauuucuauaagcaauaugcugacaauucaggcuacagucagacaacauggagggcauacauaagaucucaugacuuugggguuuguauaauguacccgaaucaacauuuuuguagguguguaaaaaugggggaaaaauguacaaguucaaauugggacuuugcaaaucaaauggcuaacuacuauaaugggaagcaaaauagauucaacaaagauuuaaauuuagcauuauacaccaugcaucaugcuuuuagaggaaguacuaguuauuuaauaucuaaaguccuccaugagaaaaaauaugaccaauugacuaaucuuuuaacacaauugaagacaaaauaucccgguaaugcuuuauugaaagcacugauagacuaccaaaucuauuuaaaaagccuuagugaaaugucuaguuuuacaccugacgagcucugggaugaucugcaauaugucccagccccaacauuuaaaccaaaucucggcagaagugaagacaacgaauacaaguuugauaagucaagaauaguugauccacaaacuacauguaccucuuugaaaggagugaauugcuuaucgccaagaucgcgagcaagugugagugauauuauagcauguggacaggcuacacagccagcauuguuuuauguaccaaaugauaaaauucaccaaucuaauacagaucagaaucaauauuguauuggugauucucauugcuuaacaaaauucacgcccauaacagaagaauuguuggcagcuguaaaaaaaucaaaaugucaggcuuuugauuuagacgauauuguuaaaacuaguccaucaacugggguuagaagcugccuaguuaagaaguuuggaaacugcaacacuacaaaccaaguauggccgauaacuauaugcucugacgaucaauauuauuauacagacacgaaacaaucauaugacucaaaucaagauauuggacacuucugccuaucuccaagguguucaacaauccgauauccgguaaacccaaaacaucuaucugcauguacauggacagaagaauauacaccagucgacaaaauuucugugacaaauauugaagaaauagagcaauauaaaaaagcucuauuacaaaaauuacagacagggcugaacauuuucaaauacaagaagacaagcaaucuaccacauaucaagccaauguauaaauacauaacagugcaaggaacagagacugcugaaggcguagaaaaugcuuacauagaaucugaaaugccugcuuuggcugguaguucuucuggauuuaaaguuuuaucuaaagaagguaaucauuuauuugauguuguggccuauauaaagucugcaucauauuccucaguuuauaauaaauuauacaguacaggacccaccuuaggcauaaauguaaaacaugaugagaaaugcacagggccauguccugcaaacauuccacauaagacagguugguuaacuuuugcuagagagagaacaagcaccuggggaugugaagaauauggaugcuuggcaauuagugauggauguguuuuugguuccugucaagauauaauuaaaccugagaugacuguuuauaggaagcaaacagaugaaauugucaccguagaauuauguuuaacuuuuguggacaaaacuuauugcacugaauugaaugcuguaacaccuauaauaucagacuuauuugagguacaauucaaaacaguagaaaguuacaguuuacccaaaaucguugcaauuaaaaaucaucaaauuuuuguaggccaaaucaaugacauuggaacuuauucaaaaggcugcggaaaugugcagguauuuaauggaacaaauuaugguucaggaacucccagauuugacuaucuaugccaucuggcaagcagaaaagaagucauaaugaggaaguguuuugacaaugauuaccaagcauguaaguuuuuacaacaacccucaaguuuuagacuugaggaagagggagaaaccguaacaauaauugauuacaaaaaaauauuagggacaauaaagaugaaagcaauuuucggggacguaaaauauaaaacuuuuagugaaaaaguggauauaaaugcugaaggugucugcgcagggugcaucaauuguuuugagaguauuaacugugaguucacaauccacagcacuguugagacaaguuguccuuuaguagcagauugucaauuguuccaugacagguuacuuauaacaccaaaugaacacaaauaugcuauaaaagcuauuuguaaagauaaaccuucaaacacuuugagauuuaguaucugcaacacaaagguugaagcaacagucacuauaauagaugcaaaaccuauauuggagcuugccccuguagaucaaacagcauauauuaaggagaaagaugaaaggugcaagacauggcuuuguagagugaaagaugaagguguggcaguucuauuggagccauuuaagaacuuguuugguucauauauagggauauuuuauggaauaauucuugucgucuuagcuauacuaguuuguauauauaucgucuugccaguaugcuuuaaaauuagagacacucuaaagaagcacgaggaugcuuacaagagagaaaugaaaauaagguaa

SEQ ID NO: 4254 - RNA, 4335 nt, Artificial Sequence
  derived and/or modified CDS sequence (wt) from TVTV(Eklund)__KR149248.1__GP
augaggaauaugauuguuuuugcuuugcuaacaauuguggcugcaaguccugucuacaaaagauguuuccaagauggagcaauugucagacaagaguacucaaaaaaugcaguuacugaagucugcuuaaaagacgauguuaguaugauaaaaacagaggcugaauacuucaagaauucaaccggcguuuuuucaaaaaacauagcauacaggaaauggcuaguuucagauuggaaugagugcaggccacaaaagucagcaaauggacacaucaaugugauugaaguucaaccagaccuaucuuugcaaacuaacuccuaugucugugcugcaacauguguuaucaguauugauaaagaaacagcacagguacgccuucagacagauacaacaaaccauuuugaaauaucuggcacaacugugaaaucuggaugguuuaagagcacuacauaccuaacccucgaucagacuugugaacauuugaaaauuucaugugguucaaagucuguacaacuacaugcgugcuucaaucagcauaugagcuguguuagauuucuacauaggacaauucuaccaggaaacaucgcaaauucaauuugucaaaauauagaaauaaucauacugacuagccuaagucuuuuuauauuuuuauucuuaacaauaauaaguaagacauauauauguuauguacuaauaccaauauucauaccaauagcuuacguauauggauuuaucuacaauaaaucauguaaaaaaugcaaacuauguggacugguauaucacccuuuuacagaaugcggcagucauuguguuuguggggcaaaauaugacacaucugacaggaugaaaaugcauagaucaucaggauuauguccaggguauaaaagcuuaagggcugcaagaucuaugugcaaaucaaaaggaccagcuucuauacuaucguuauugagugcagucuugauccuaacuuuuguaacaccuauaacagccauaucacuuaaagaugaagaaaaagaaacauacaaauuaucagaauuaccugaugauaugguuaauuuggaaaccaagauugacuuauacuuccaaaugugucuaauaaauuaugcaacuacaugggcucuaauuuucugugcauuaauaacugcauguuuauucaaaaagcuucaacauaaguuucuugauuauuaugcugucuauugccaugaaugugacauguaucaugaaagacgaggccugaaauacaauggugauuucucaaacaaaugcagacaaugcacauguggacaguaugaggaugcuacuggauuacuaacacaucggaaaucauauaauugccuaguacaauauaaagcaaaauggauguugaauuucuugauaacauaugcuaucuuaguuaucaucaaagacucuguaaugauuguaggugcaagcaauacagaugucaaggauugcuuggaccaagaagaaauaaccuggaauuguacuggacccuucuugaauaugggaagaugcacaagaccucaaaaaaaggaaaacuacggaaauauagcaacucaacugaaaggccuagauguguuaucugcuuuagauaugccagcuguagguaaaauaccagaagauauugcuggggcauugucauacaucgaaucuaaaaagacauaucaugaacaauuaacuuuagaauuugcaaugcuaacaagguauugugauuucuauaagcaauaugcugacaauucaggcuacagucagacaacauggagggcauacauaagaucucaugacuuugggguuuguauaauguacccgaaucaacauuuuuguagguguguaaaaaugggggaaaaauguacaaguucaaauugggacuuugcaaaucaaauggcuaacuacuauaaugggaagcaaaauagauuuaacaaagauuuaaauuuagcauuauauaccaugcaucaugcuuuuagaggaaguacuaguuauuuaauaucuaaaguccuccaugagaaaaaauaugaccaauugacuaaucuuuuaacacaauugaagacaaaauaucccgguaaugcuuuauugaaagcacugauagacuaccaaaucuauuuaaaaagccuuagugaaaugucuaguuuuacaccugacgagcucugggaugaucugcaauaugucccagccccaacauuuaaaccaaaucucggcagaagugaagacaaugaauacaaguuugacaaaucaagaauagucgauccacaaacuacauguaccucuuugaaaggagugaauugcuuaucgccaagaucgcgagcaagugugagugauauuauagcauguggacaagcuacacagccagcauuguuuuauguaccaaaugauaaaauccaccaaucuaacacagaucagaaucaauauuguaucggugauucucauugcuuaacaaaauucacgcccauaacagaagaauuguuggcagcuguaaaaaaaucaaaaugucaggcuuuugauuuagacaauauuguuaaaacuaguccaucaacugggguuagaagcugcuugguuaaaaaguuuggaaacugcaacacuacaaaccaaguauggccgauaacuauaugcucugacgaucaauauuauuauacagacacgaaacaaucauaugacucauaucaagauauuggacacuucugccuaucuccaagguguucaacaauccgauauccaguaaacccaaaacaucuaucugcauguacauggacggaagaauauacaccagucgacaaaauuucugugacaaauauugaagaaauagagcaauauaaaaaagcucuauuacaaaaauugcagacagggcugaacauuuucaaauacaggaagacaagcaaucuaccacacaucaagccaauguauaaauacauaacaguucaaggaacagagacugcugaaggcguagaaaaugcuuacauagaaucugaaaugccugcuuuggccgguaguucuucuggauuuaaaguuuuaucuaaagaagguaaucauuuauuugauguuguggccuauauaaagucugcaucauauuccucaguuuauaauaaauuauacaguacaggacccaccuuaggcauaaauguaaaacaugaugagaaaugcacagggccauguccugcaaacauuccacauaagacagguugguuaacuuuugcuagagagagaacaagcaccuggggaugugaagaauauggaugcuuggcaauuagugauggauguguuuuugguuccugucaagauauaauuaaaccugagaugacuguuuauaggaagcaaacagaugaaauugucaccguagaauuauguuuaacuuuuguggacaaaacuuauugcacugaauugaaugcuguaacaccuauaauaucagacuuauuugagguacaauucaaaacaguagaaaguuacaguuuacccaaaauaguugcaauuaaaaaucaucaaauuuuuguaggccaaaucaaugacauuggaacuuauucaaaaggcugcggaaaugugcagguauuuaauggaacaaauuaugguucaggaacccccagauuugacuaucuaugccaucuggcaagcagaaaagaagucauaaugaggaaguguuuugacaaugauuaccaagcauguaaguuuuuacaacaacccucaaguuuuagacuugaggaagagggagaaaccguaacaauaauugauuacaaaaaaauauuggggacaauaaagaugaaagcaauuuucggggacguaaaauauaaaacuuuuagugaaaaaguggauauaaaugcugaaggugucugcgcagggugcaucaauuguuuugagaguauuaacugugaguucacaauccacagcacuguugaaacaaguuguccuuuaguagcagauugucaauuguuccaugacagguuacuuauaacaccaaaugaacacaaauaugcuauaaaagcuauuugcaaagauaaaccuucaaacacuuugagauuuaguaucugcaacacaaagguugaagcaacagucacuauaauagaugcaaaaccuauauuggagcuugccccuguagaucaaacagcauauauuaaggagaaagaugaaaggugcaaaacauggcuuuguagagugaaagaugaagguguggcaguucuauuggagccauuuaagaacuuguuugguucauauauagggauauuuuauggaauaauucuugucgucuuagcuauacuaguuuguauauauaucgucuugccaguaugcuuuaaaauuaaagacacucuaaagaagcacgaggaugcuuacaaaagagaaaugaaaauaagguaa

SEQ ID NO: 4255 - RNA, 4335 nt, Artificial Sequence
  derived and/or modified CDS sequence (wt) from JCV(3324-04)__HM007357.1__GP
auggaaguccuaaacuuaauaugguugcugacauuauguuuggcuaguccaguauuccagcgauguuuccaagauggggcuauagugaagcaaaacccaucaaaagaggcagugacagaagucugcuugaaagaugauguaaguaugauaaaaacagaagcaaaauauguaaaaaauacaacaggaacauuugccaacaacauugcuaugaggaaaugguuaguugcagauuggcaugacugcaggccucagaagucaucggguggucauaucaaugucauugagguuggugaugaccuaucgcuccauacugaaucauacaucuguagugcagacugugucauuacaguugacaaggaaacagcacaaauccgguuacagacugacaauacaaaucauuuugaaguugccggcacuacaguuaaaucuggaugguuuaagagcacaacguauaucacacucgaccagacaugugagcaucucaaagugucaugugggccuaaaucaauacaauuccaugcuugcuucaaucagcauaugucaugcguacgauucuugcauagaacaauacuuccagguucaauagcaaacuccauaugccaaaauauagaaauaauuaucuuagucacucuaucauuagugaucuucauauuuuuaacaauagugaguaagacauacauaugcuacuuauuaaugccuaucuuuauuccaauagcauuuauuuacggauggauauauaauaaauccugcaaaaaguguaaacuaugugguuugguguaucacccauuuaccgaauguggcacacauuguguuugcggugcaagauaugagacuucugauagaaugaaauugcacagagcaucuggguuaugcccaggguauaaaagccuuagagcagcaaggguuauguguaagucaaaagggccagcuucaguuuuaucuauaaugacugcaguucucauauuaacauucgucacuccuauuagugcuaugguuauuggugaaucaagugaaauauauacacuagaagauuuaccugacgauaugguacaaauggcagaaaggauaaauauuuauuaucaaauaauuauuaucaauuacgguauuacaugggcuuuccuacugcuuggccugcuucucgcauacuuuuuuaggaaauaucagcauagauucuuagacuuuuacgcaauguauugugaagagugugacauguaccaugaaaaagcugguuugacacauuggggugacuucacaaauaagugcagacaauguacaugcggccaauaugaagacauuacuggguuaaugguucauaaaaaauccuauaauugcuuggugaaguauaaagcaaaauggauacgagauauuuuaaucacauaucuuguuauaauauuaguuaaagauucacuacuauuuguuggugcaacaggaaccgauuuugcuacauguauagaugagaaaacuguuacauggaauuguaccggaccauucuuaaauuuggguagaugugauaaaucucaaaagaaaaccaauuaugcugauauagccaaucaauuaaagggguuaggugucauuucaguacuagacaucccaaugauaaagaagaugccagaugaaauaucaggaucuuuaaaauauauugauaauuuagagacguaccaugagcaacugacugcugaguaugcuuuucuuacuagauacugcgacuauuauacacaauacacugacaauucaggcuauagccagacaguguggagaacauacuugcgaucucaugacuucggugcauguguugucuacccaaaccaacauuuuugcagauguguaaaauauggugauaaguguaauagugccaagugggauuucgcaaaugaaaugaaaacuuucuauacaggucaaaaagcgaaauucaauaaggaccuaaauuuggcauuauuaguauugcauaaggcauuuagaggcaccggaaccgcauauauagcagaagcuauggcucgcaaagauaaugguucuauggcacacuuugccuuagaaguaagaaagaaauucccaacaaaugcccuauuggcagcauugauagauuacauuguuuacuuacaaucacuugcagaaauauccacauuugaacuagaugaggauugggaagauuuuaaauauaagccagagccaacagaaucaacaauccaagccagaucgcauagagaugaucaguacaauuuuaagaaugcagcuaguggcagcaauguuaaaguuuguaaaaauauucagaaagugcuauguauuucaccuagaucaagggcuaaauuugagaauaucauagcauguggagaacaugcaaacccaucaguauauaugaugccuaauguuaguauuuaccaaucaagcucagagagaagccauuauuguauagcugauucacauugcuuagaagaauaugaagugguggagacagagcuuuugaaugcacugaagaagucuaaaugcugggucaaagaaauggacgauguuauucuacauaagcaaagugaugguuugaggaguuguaggaugaaagacacuggaaauugcaauguucaagaaaaugauuggaauauuguccuaugugaaaauggcaacuauuauuauucagaaauucacaaagauuaugauaaagaccaggauguaggacacuuuugucuaagcccuaggugcaacacaauacguuacccaauaaguaagaggcauaucagaagcugcaacuggcaaauuucacauucuacaaucgacaagauagcaguccaagaauuagcugauauagaacaauauaagaaggcuaucucacaaaaauugcaaacgagucuaucaauuuucaaauauauaaaaacaaaaaaucuuccacacauuaaaccugcauacaaauauauaacuguggaagguguugagacuguugaaggaauagaaaaugccuuuauagagucugaaaucccagcauuggcuggcacagcuaucggcuucaaaauaaauucaagagaaggcaauuauuuaauggaugugauaggguauguuaaaagugcaucuuacucagcaacauauacaaaauuguacacaacuggccccacuauaggaauaaauacuagacaugaugagaaauguacaggaccuugcccagcuguaauagaucauaaagauggcugguuaacuuucucaaaggaaagaacuaguacauggggcugcgaagaauuugguuguuuagcaguaagugaugguuguguauuuggauccugucaagauauuauaaaggacgaacuagcugucuauaggaagaccacugaggagcuuacuacuguagaauuguguuugacauuuucagauaagacuuacuguacuaauuuaaaugcuauaacuccuauaauaacugacaaguuugaaguucaauuuaaaacaguugaggccuauacauuaccaagaauaauugcaguaaagaaucacgagaucaagguuggacagauuaaugaucuugguguuuacucuaaaggauguggaaauguccaaaagguuaauggaacuaauuaugggaauggugcaccaagauucgauuaucugugccacuuagcaaguagaaaagaagugauuuuaagaaaguguuuugacaaugauuaucaagcuugcaaauuucuacaaaguccuucaaguuaucguuuggaagaacaccaaggcacaguaacaguuauagauuauaagaaaauuuuagguaccauaaaaaugaaggcuauauugggagauguaaaauacaagaauuuccaaagcaauauagaaaucaaugcagaagggacaugugcuggauguauaaauugcuuugagaauauucacugugaauuuacuauacauaccacuguugaaacaagcugcccuauaguuacagauuguguuucauuucaugauagaauauuaauuacaccagaugagcauaaguaugcauuaaaaguuguaugucaagacaagcccaaagugucucuaaaauuuaaaauuugcaauacgaauauugaugcaucuaugaccauaguggauucuaagccaaucuuagaacuugcaccaguugaccaaacugcauauaucagagaaaaagaugaaagguguaagaccuggauguguagaguccgagacgaaggguuucaaguuauacuagagccuuuuaagaaccuuuuuggcucuuacauagggauauuuuauacagguauauuaucuauaauuugucuccuuauugucauuuauauuauacugccuaucugcuucaaauuaagagacacuuuaaggcagcaugaggacgcauauaagaaagaaaugaaaauaagauaa

SEQ ID NO: 4256 - RNA, 4335 nt, Artificial Sequence
  derived and/or modified CDS sequence (wt) from JCV(61V2235)__U88058.1__GP
auggaaguccuaaacuuaaucugguuacuagcauugugcucagcuaguccaguauuucaacgguguuuccaagauggagcuauagugaagcaaaacccaucuaaggaagcagugacagaggugugcuuaaaggaugacgugagcaugauaaaaacagaagcaaaauauguaaaaaauaccacagggacauuugcuaauaacauagcuaugagaaaaugguugguugcagauuggcaugacuguaggccccaaaagucaucagguggucauauuaauguuauugaaguuggagaugaucugucgcuccacacagagucuuauauuugcagugcagauuguguuaucacaguugauaaagaaacugcucagauccgcuugcaaacugacaauacaaaccacuuugagguugcugggaccacaguaaaaucagguugguucaaaaguacaacuuauaucacacuugaucaaacaugugagcaucuuaaaguaucaugcggaccaaaaucgauacaguuucaugcuugcuucaaucagcauaugucuugugugcgauucuuacauagaacgauacuaccagggucaauugcuaauuccauaugucaaaauauagaaauaauuaucuugguuacucucucauuaguaaucuucauauucuuaucaauaguaagcaagacauauguauguuacuuauuaaugccuaucuucaccccaauagcuuuuaucuauggauggguauacaauaaauccugcaagaaaugcaaguuauguggcuuaguuuaucacccauucacagaauguggaacacacuguguauguggugcaagauaugaaaauucugauaggaugaaauugcauagagcaucuggauuguguccaggguacaagagucucagagcagcuagaguuaugugcaaaucaaaaggaccagcuucuauccuaucuauaaugacugcaauucucauacuaacauuugucaccccuauuagugccauggucauaggugaaucaagugagcuguacacacuagaugauuuacccaaugauaugguacaaauggcggagagggugaauaucuauuaucaaauaaccaucauuaauuauggugucacuugggcuuucuuuugccuugguuuaauuuuggcauacuucuucaaaaaauaucaacauaaauuucuagauuuuuaugcgauguauugugaggaaugcgauauguaucaugagaaaucugguuugacacacuggggugacuuuacuaauaaauguagacagugcacaugcggucaguuugaagauguugcuggcuugaugauacauaaaaaaucuuacaauuguuuggucaaauauaaagcgaaauggauaagagacauacucaucauauauuuggcuaugauucugaucaaagauucguuauuauucguuggagcaucggggacagacuuugcugcauguauagaugagaaagucguuacauggaacugcaccgggccauuccuaaauuuagguagaugcgacaaaucucagaagaaagcaagcuaugcagguauagcugaucaguuaaagggcuuaggaguuauaucuguuuuggauaucccgaugauaaaaaauaugccagaugaaauaucagguucacuaaaguauaucgacagcuuagagacguaucaugagcagcuaacugcugaauaugccuuccucaccagguacugcgacuauuauacacaauacacagauaaaucuggcuauagucaaacaguauggaggacuuauuuacgaucucaugauuuuggugcauguguuguuuauccgaaucaacauuuuuguagaugcguaaaguauggagauaaaugcaauagugccaagugggauuuugccaaugagaugaaaacauucuacacaggccagaaagugaaguuuaauaaggauuuaaacuuggcauuauugguauuacauaaagcauuuagaggcacuggaacugcauauguugcagaagcuauggcucgggaagauaacgguuccauggcacauuuugcuuuggagauaagaaaaaaauucccaacaaaugcuuuguuagcagcauuaauagauuauauaguuuauuuacagucccuuggagaaauagccacauuugaacucgaugaagauugggaagauuuuaaauauaagccagagccaacagaaucaacaccucaaguuaggucacacagaaaugaucaguauaacuucaaaaaugcugaaaguaauagugauaccaaagucuguaagaauguucagaaaguacuauguauuucacccaggucaaaggcaaaauucgaaaauauuauagcauguggagagcaugcaaauccaucuguauacaugaugccaaaugucagcaucuaccaauccaauucggaaaggagucacuauuguauagcuggcucucauugccuugagaaauaugaagugguagaaacagaacuuuugaaugcuuuaaagaagucaaaauguugggccaaggaaauggaugauauuaucuugcauaagcagagcgauggcuugaggaguuguagaauaaaagauacuggaaacugcaauguucaagaaaaugauuggaccauugucuuaugcgaaaauggcaacuauuacuacucugagguccacaaagacuaugauaaagaucaggauguaggucauuucugucuuagcccuagaugcacuacaauacguuauccaauaaguaaaaggcauauaaagaagugcgaauggcagauaucacauucaacaauugauaaaaucucuguucaagaguuagcagacauagaacaauauaagaaggccauaucacaaaaacugcaaacaagucuaucaauuuuuaaguauguaagaacaaaaaaccucccacauaucaaacccgcauauaaguacauaacuguagaaggugucgaaacuauugaaggaaucgaaaacgcuuuuauagagucugagaucccagcauuggcagguacagcuauagguuucaaaauaaauucaagagaaggcaacuaucuaauggaugugauaggguauguuaagagcgcaucauauucagcaguguacacaaagcuauauacaacugggccuacuauaggaauaaacaccaaacaugaugaaaaaugcacaggaccuugcccagcuauaauagaucauaaagaugguuggcuaaccuucucaaaagaaaggaccagcacuugggguugugaagaguuugguugcuuagcagucagugaugguuguguauuuggcucuugccaagauauaauaaaagaugaauuggcuguuuauaggaaaacuacugaagaacucacuacaguagaacugugcuugacauuuucagauaaaacauauugcaccaacuugaaugcuauaacuccuauuauaacagauaaauuugaagugcaguucaaaacuguugaaucuuauacacuaccaagagucauugccauaaagaaucaugagauuaagguuggacaaaucaaugacuuaggugucuacucaaaaggauguggaaauguucaaaaggucaauggaacaaacuauggcaaugguucaccaagguuugauuaucuuugccacuuggcgaguagaaaagaaguaauccuaaggaaauguuuugacaaugauuaccaggcuugcaaauucuugcagaguccuucaaguuaucguuuagaagagcaccagggaacagugacaguuauagauuauaaaaagauucuaggcacuauaaagaugaaggcuauauuaggggaugugaaauacaaaaauuaucaaaauaauauagaaaucagugcugagggaacaugugcuggauguauugauugcuuugaaaauauacacugugaauuuacuauacauacuacaguugaggcaaguuguccuauaacaacagagugugucuccuuccaugauagaauauugaucacaccagaugaacauaaguaugcauugaagauuguaugucaugauaaaccaaaagugucucuuaaauuuaaaaucuguaacacacauguugaugcagcuaugacuauuguagauucuaaaccaauuuuagaacuugcgccaguagaucaaacaacauacaucagagagaaagaugaaagaugcaagaccuggauguguagaguccgagaugaaggguuccaggugauauuagaaccuuuuaaaaaccucuuugguucguauauuggaauauuuuauacugguauauugucuauuauuuguuuacucauugucgucuauauuauauugcccauuuguuucaaauugagggacaccuuaaggcagcaugaagaugccuauaaaaaggaaaugaagauaagauga

SEQ ID NO: 4257 - RNA, 4335 nt, Artificial Sequence
  derived and/or modified CDS sequence (wt) from JCV(61V2235)__HM007351.1__GP
auggaaguccuaaacuuaaucugguuacuagcauugugcucagcuaguccaguauuucaacgguguuuccaagauggagcuauagugaagcaaaacccaucuaaggaagcagugacagaggugugcuuaaaggaugacgugagcaugauaaaaacagaagcaaaauauguaaaaaauaccacagggacauuugcuaauaacauagcuaugagaaaaugguugguugcagauuggcaugacuguaggccccaaaagucaucagguggucauauuaacguuauugaaguuggagaugaucugucgcuccacacagagucuuauauuugcagugcagauuguguuaucacaguugauaaagaaacugcucagauccgcuugcaaacugacaauacaaaccacuuugagguugcugggaccacaguaaaaucagguugguucaaaaguacaacuuauaucacacuugaucaaacaugugagcaucuuaaaguaucaugcggaccaaaaucgauacaguuucaugcuugcuucaaucagcauaugucuugugugcgauucuuacauagaacgauacuaccagggucaauugcuaauuccauaugucaaaauauagaaauaauuaucuugguuacucucucauuaguaaucuucauauucuuaucaauaguaagcaagacauauguauguuacuuauuaaugccuaucuucaucccaauagcuuuuaucuauggauggguauacaauaaauccugcaagaaaugcaaguuauguggcuuaguuuaucacccauucacagaauguggaacacacuguguauguggugcaagauaugaaacuucugauaggaugaaauugcauagagcaucuggauuguguccaggguacaagagucucagagcagcuagaguuaugugcaaaucaaaaggaccagcuucuauccuaucuauaaugacugcaauucucauacuaacauuugucaccccuauuagugccauggucauaggugaaucaagugagguguacacacuagaugauuuacccaaugauaugguacaaauggcggagagggugaauaucuauuaucaaauaaucaucauuaauuauggugucacuugggcuuucuuauugcuugguuuaauuuuggcauacuucuucaaaaaauaucaacauaaauuucuagauuuuuaugcaauguauugugaggaaugcgauauguaucaugagaaaucugguuugacacacuggggugacuuuacuaauaaauguagacagugcacaugcggucaguuugaagauguugcuggcuugaugauacauaaaaaaucuuacaauuguuuggucaaauauaaagcgaaauggauaagagacauacucaucauauauuuggcuaugauucugaucaaagauucguuauuauucguuggagcaucggggacagacuuugcugcauguauagaugagaaagucguuacauggaacugcacugggccauuccuaaauuuagguagaugcgacaaaucucagaagaaagcaagcuaugcagguauagcugaucaguuaaagggcuuaggaguuauaucuguuuuggauaucccgaugauaaaaaauaugccagaugaaauaucagguucacuaaaguauaucgacagcuuagagacguaucaugagcagcuaacugcugaauaugcuuuccucaccagguacugcgacuauuauacacaauacacagauaacucuggcuauagucaaacaguauggaggacuuauuuacgaucucaugauuuuggugcaugugucguuuauccgaaucaacauuuuuguagaugcguaaaguauggagauaaaugcaauagugccaagugggauuuugccaaugagaugaaaacauucuacacaggccagaaagugaaguuuaauaaggauuuaaacuuggcauuauugguauuacauaaagcauuuagaggcacuggaacugcauauguugcagaagcuauggcucggaaagauaacgguuccauggcacauuuugcuuuggagauaagaaaaaaauucccaacaaaugcuuuguuagcagcauuaauagauuauauaguuuauuuacagucccuuggagaaauagccacauuugaacucgaugaagauugggaagauuuuaaauauaagccagagccaacagaaucaacaccucaaguuaggucacacagaaaugaucaguauaacuucaaaaaugcugaaaguaauagugauaccaaagucuguaagaauguucagaaaguacuauguauuucacccaggucaaaggcaaaauucgaaaauauuauagcauguggagagcaugcaaauccaucuguauacaugaugccaaaugucagcaucuaccaauccaauucggaaaggagucacuauuguauagcugacucucauugccuugagaaauaugaagugguagaaacagaacuuuugaaugcuuuaaagaagucaaaauguugggccaaggaaauggaugauauuaucuugcauaagcagagcgauggcuugaggaguuguagaauaaaagauacuggaaacugcaauguucaagaaaaugauuggaccauugucuuaugcgaaaauggcaacuauuacuacucugagguccacaaagacuaugauaaagaucaggauguaggucauuucugucucagcccuagaugcacuacaauacguuauccaauaaguaaaaggcauauaaagaagugcgaauggcagauaucacauucaacaauugauaaaaucucuguucaagaguuagcagacauagaacaauauaagaaggccauaucacaaaaacugcaaacaagucuaucaauuuuuaaguauguaagaacaaaaaaccucccacauaucaaacccgcauauaaguacauaacuguagaaggugucgaaacuauugaaggaaucgaaaacgcuuuuauagagucugagaucccagcauuggcagguacagcuauagguuucaaaauaaauucaagagaaggcaacuaucuaauggaugugauaggguauguuaagagcgcaucauauucagcaguguacacaaaacuauauacaacugggccuacuauaggaauaaacaccaaacaugaugaaaaaugcacaggaccuugcccagcuauaauagaucauaaagaugguuggcuaaccuucucaaaagaaaggaccagcacuugggguugugaagaguuugguugcuuagcagucagugaugguuguguauuuggcucuugccaagauauaauaaaagaugaauuggcuguuuauaggaaaacuacugaagaacucacuacaguagaacugugcuugacauuuucagauaaaacauauugcaccaacuugaaugcuauaacuccuauuauaacagauaaauuugaagugcaguucaaaacuguugaaucuuauacacuaccaagagucauugccauaaagaaucaugagauuaagguuggacaaaucaaugacuuaggugucuacucaaaaggauguggaaauguucaaaaggucaauggaacaaacuauggcaaugguucaccaagguuugauuaucuuugccacuuggcgaguagaaaagaaguaauccuaaggaaauguuuugacaaugauuaccaggcuugcaaauucuugcagaguccuucaaguuaucguuuagaagagcaccagggaacagugacaguuauagauuauaaaaagauucuaggcacuauaaagaugaaggcuauauuaggggaugugaaauacaaaaauuaucaaaauaauauagaaaucaaugcugagggaacaugugcuggauguauugauugcuuugaaaauauacacugugaauuuacuauacauacuacaguugaagcaaguuguccuauaacaacagagugugucuccuuccaugauagaauauugaucacaccagaugaacauaaguaugcauugaagauuguaugucaugauaaaccaaaagugucucuuaaauuuaaaaucuguaacacaaauguugaugcagcuaugacuauuguagauucuaaaccaauuuuagaacuugcgccaguagaucaaacaacauacaucagagagaaagaugaaagaugcaagaccuggauguguagaguccgagaugaaggguuccaggugauauuagaaccuuuuaaaaaccucuuugguucguauauuggaauauuuuauacugguauauugucuauuauuuguuuacucauugucgucuauauuauauugcccauuuguuucaaauugagggacaccuuaaggcagcaugaagaugccuauaaaaaggaaaugaagauaagauga

SEQ ID NO: 4258 - RNA, 4335 nt, Artificial Sequence
  derived and/or modified CDS sequence (wt) from JCV(61V2235)__KX817316.1__GP
auggaaguccuaaacuuaaucugguuacuagcauugugcucagcuaguccaguauuucaacgguguuuccaagauggagcuauagugaagcaaaacccaucuaaggaagcagugacagaggugugcuuaaaggaugacgugagcaugauaaaaacagaagcaaaauauguaaaaaauaccacagggacauuugcuaauaacauagcuaugagaaaaugguugguugcagauuggcaugacuguaggccccaaaagucaucagguggucauauuaacguuauugaaguuggagaugaucugucgcuccacacagagucuuauauuugcagugcagauuguguuaucacaguugauaaagaaacugcucagauccgcuugcaaacugacaauacaaaccacuuugagguugcugggaccacaguaaaaucagguugguucaaaaguacaacuuauaucacacuugaucaaacaugugagcaucuuaaaguaucaugcggaccaaaaucgauacaguuucaugcuugcuucaaucagcauaugucuugugugcgauucuuacauagaacgauacuaccagggucaauugcuaauuccauaugucaaaauauagaaauaauuaucuugguuacucucucauuaguaaucuucauauucuuaucaauaguaagcaagacauauguauguuacuuauuaaugccuaucuucaucccaauagcuuuuaucuauggauggguauacaauaaauccugcaagaaaugcaaguuauguggcuuaguuuaucacccauucacagaauguggaacacacuguguauguggugcaagauaugaaacuucugauaggaugaaauugcauagagcaucuggauuguguccaggguacaagagucucagagcagcuagaguuaugugcaaaucaaaaggaccagcuucuauccuaucuauaaugacugcaauucucauacuaacauuugucaccccuauuagugccauggucauaggugaaucaagugagguguacacacuagaugauuuacccaaugauaugguacaaauggcggagagggugaauaucuauuaucaaauaaucaucauuaauuauggugucacuugggcuuucuuauugcuugguuuaauuuuggcauacuucuucaaaaaauaucaacauaaauuucuagauuuuuaugcaauguauugugaggaaugcgauauguaucaugagaaaucugguuugacacacuggggugacuuuacuaauaaauguagacagugcacaugcggucaguuugaagauguugcuggcuugaugauacauaaaaaaucuuacaauuguuuggucaaauauaaagcgaaauggauaagagacauacucaucauauauuuggcuaugauucugaucaaagauucguuauuauucguuggagcaucggggacagacuuugcugcauguauagaugagaaagucguuacauggaacugcacugggccauuccuaaauuuagguagaugcgacaaaucucauaagaaagcaagcuaugcagguauagcugaucaguuaaagggcuuaggaguuauaucuguuuuggauaucccgaugauaaaaaauaugccagaugaaauaucagguucacuaaaguauaucgacagcuuagagacguaucaugagcagcuaacugcugaauaugcuuuccucaccagguacugcgacuauuauacacaauacacagauaacucuggcuauagucaaacaguauggaggacuuauuuacgaucucaugauuuuggugcaugugucguuuauccgaaucaacauuuuuguagaugcguaaaguauggagauaaaugcaauagugccaagugggauuuugccaaugagaugaaaacauucuacacaggccagaaagugaaguuuaauaaggauuuaaacuuggcauuauugguauuacauaaagcauuuagaggcacuggaacugcauauguugcagaagcuauggcucggaaagauaacgguuccauggcacauuuugcuuuggagauaagaaaaaaauucccaacaaaugcuuuguuagcagcauuaauagauuauauaguuuauuuacagucccuuggagaaauagccacauuugaacucgaugaagauugggaagguuuuaaauauaagccagagccaacagaaucaacaccucaaguuaggucacacagaaaugaucaguauaacuucaaaaaugcugaaaguaauagugauaccaaagucuguaagaauguucagaaaguacuauguauuucacccaggucaaaggcaaaauucaaaaauauuauagcauguggagagcaugcaaauccaucuguauacaugaugccaaaugucagcaucuaccaauccaauucggaaaggagucacuauuguauagcugacucucauugccuugagaaauaugaagugguagaaacagaacuuuugaaugcuuuaaagaagucaaaauguugggccaaggaaauggaugauauuaucuugcauaagcagagcgauggcuugaggaguuguagaauaaaagauacuggaaacugcaauguucaagaaaaugauuggaccauugucuuaugcgaaaauggcaacuauuacuacucugagguccacaaagacuaugauaaagaucaggauguaggucauuucugucucagcccuagaugcacuacaauacguuauccaauaaguaaaaggcauauaaagaagugcgaauggcagauaucacauucaacaauugauaaaaucucuguucaagaguuagcagacauagaacaauauaagaaggccauaucacaaaaacugcaaacaagucuaucaauuuuuaaguauguaagaacaaaaaaccucccacauaucaaacccgcauauaaguacauaacuguagaaggugucgaaacuauugaaggaaucgaaaacgcuuuuauagagucugagaucccagcauuggcagguacagcuauagguuucaaaauaaauucaagagaaggcaacuaucuaauggaugugauaggguauguuaagagcgcaucauauucagcaguguacacaaaacuauauacaacugggccuacuauaggaauaaacaccaaacaugaugaaaaaugcacaggaccuugcccagcuauaauagaucauaaagaugguuggcuaaccuucucaaaagaaaggaccagcacuugggguugugaagaguuugguugcuuagcagucagugaugguuguguauuuggcucuugccaagauauaauaaaagaugaauuggcuguuuauaggaaaacuacugaagaacucacuacaguagaacugugcuugacauuuucagauaaaacauauugcaccaacuugaaugcuauaacuccuauuauaacagauaaauuugaagugcaguucaaaacuguugaaucuuauacacuaccaagagucauugccauaaagaaucaugagauuaagguuggacaaaucaaugacuuaggugucuacucaaaaggauguggaaauguucaaaaggucaauggaacaaacuauggcaaugguucaccaagguuugauuaucuuugccacuuggcgaguagaaaagaaguaauccuaaggaaauguuuugacaaugauuaccaggcuugcaaauucuugcagaguccuucaaguuaucguuuagaagagcaccagggaacagugacaguuauagauuauaaaaagauucuaggcacuauaaagaugaaggcuauauuaggggaugugaaauacaaaaauuaucaaaauaauauagaaaucaaugcugagggaacaugugcuggauguauugauugcuuugaaaauauacacugugaauuuacuauacauacuacaguugaagcaaguuguccuauaacaacagagugugucuccuuccaugauagaauauugaucacaccagaugaacauaaguaugcauugaagauuguaugucaugauaaaccaaaagugucucuuaaauuuaaaaucuguaacacaaauguugaugcagcuaugacuauuguagauucuaaaccaauuuuagaacuugcgccaguagaucaaacaacauacaucagagagaaagaugaaagaugcaagaccuggauguguagaguccgagaugaaggguuccaggugauauuagaaccuuuuaaaaaccucuuugguucguauauuggaauauuuuauacugguauauugucuauuauuuguuuacucauugucgucuauauuauauugcccauuuguuucaaauugagggacaccuuaaggcagcaugaagaugccuauaaaaaggaaaugaagauaagauga

SEQ ID NO: 4259 - RNA, 4335 nt, Artificial Sequence
  derived and/or modified CDS sequence (wt) from JCV(3573-03)__HM007354.1__GP
auggaaguucuaagcuuaaucugguugcugacauuguguucagcuaguccaguauuccaacgguguuuccaagauggggcuauagugaagcaaaacccgucaaaggaagcuguaacagaaguuugccuaaaagaugauguaagcaugauaaagaccgaagcaaaauaugugaagaacacuacaggaacauucgcuaacaacauagccaugagaaaguggcuuguugcagauuggcaugauuguagaccucagaagucaucggguggucacaucaauguuauugaagucggugaugaucuaucacuccauacagaaucauacaucuguagugcagauuguguuaucacaguugauaaggaaacagcucagauccgcuuacaaacugacaauacaaaucauuuugaagucgcugggacuacaguaaaaucugggugguuuaaaaguacaacauauauaacacucgaucaaacuugugaacaccucaaggugucauguggaccuaaaucgauacaauuccaugcuugcuuuaaccaacauaugucauguguacgguuuuuacacagaacaauacucccuaguucaauagcuaacucuauaugccagaauauagagauaauaaucuuagucacucuaucauuaacaaucuucauauucuuaacaauaguaaguaagacauauauauguuauuuacugaugcccguuuuuauuccaauagcauuuguuuauggguggauauauaauaagucuuguaagaaauguaaguugugcggguuaguuuaucacccuuuuacugaguguggaacacauugugucuguggugcacgguaugaaacuucugauaggaugaaguugcacagagcaucaggauuaugcccaggauauaaaagcuuaagagcagcuagggugauguguaagucaaaagggccagcaucgauuuuaucuauaaugacagcaguuuugauauuaacauuugucaccccuauuagugcuaugaugauuggggaaucaagcgagguguacacucuagaugauuuacccgaugauaugguacaaauggcugagagagugaacauuuacuaucagauaaucauuauaaauuaugguguuacaugggcuuucuugcuacuuggucuaguucuagcauauuucuuuaagaaauaccagcacaaguuccuagacuuuuaugcaauguauuguaaugaaugugauauguaucaugaaaaagccggucuaacacauuggggugauuuuacaaauagaugcagacaauguacaugugggcaauaugaagauguuacuggauugauaguacacaaaaaaucguacaauugcuuaguuaaauauaaagcaaaguggauaagagauauuuuaaucacauauuuaauuauaauauugguuaaagauucacuguuguuuguuggugcaacaggaacugacuuugcugcauguauagaugagaaaacaguuacauggaacuguacuggaccguuucuaaauuuagguagaugugauaaaucucaaaagaaaacaaguuacaaugauauagcuaaccaauuaaaaggguuaggcgucauaucgguacuagacaucccaaugauaaaaagaaugccagacgagauaucaggaucacugaaguauauugauaacuuagaaacauaccaugaacaauuaacugcagaauaugcuuuccucacuagauacugugauuauuacacgcaguauacugacaauucagguuauagucaaacaguauggagaacuuauuuacggucucaugauuuuggugcauguguugucuauccaaaucagcacuucuguagaugugugaaauauggcgauaagugcaauagugcuaaaugggauuuugcaaaugaaaugaagacauuuuauacaggucaaaaaauaaaauuuaacaaagacuugaauuuggcacuauuaguauugcauaaagcauuuagaggcacuggaacugcauacauagcagaagcuauggcccgaaaagacaauggaucgauggcacacuuugccuuagaagugcgaaagaaguuuccaacaaaugcccuauuggcagcauuaauagauuauauaguuuaccuacaaucacuugcagaaauaucuacauucgaacuugaugaggacugggaagacuucaaauauaaaccagaaccaacugagucaccuucucaagcuaggucacauagaagugaucaguacaacuucaaaaaugcagagaguaauaguaaugucaaaguuuguaagaauauucagaaaguacuauguauuucaccuagaucaagggcuaaauucgagaauauuauagcaugcggagaacaugcaaaucccucuguauauaugaugcccaauguuagcauuuaucaaucuaauucagaaaggagucauuauuguauagcugacucucauugucuagaagacuacgaaauaguggaaacagagcuuuuaagugcacuaaagaagucuaagugcugggccaaggagauggaugauauuguuuugcacaagcaaagugauggucuaagaaguuguaggaugaaagauacugggaacugugauguucaagaaaaugacuggacaauugucuuaugugaaaauggcaauuauuacuauucagaaauccacaaggauuaugauaaagaucaagaugugggacauuuuugccuuagucccagaugcaguacaauaagauauccgauaaacaagagacauauaaaaagauguaauuggcagauuucacacucgacaauugauaaaaucucaguucaagaacuagcagacauagaacaguauaaaaaggcuauuucacaaaaguuacagacaaguuugucuaucuucaaauacgugaagaccaaaaauuugccgcacauuaaaccugcauacaaguauauaacuguggaaggcauugagacuguagaaggcauagaaaaugcuuucauagagucugagaucccugcauuagcugguacagcuaucggcuucaaaauaaacucaagagaagguaauuauuuaauggaugugauaggauauguuaagagcgcaucauacucugcuacauauacaaaauuguauacaacugguccuacuauuggaauaaauacuagacaugaugagaagugcacaggacccuguccagcugugauagaccacaaagauggauggcuaacuuuuucaaaagaaagaaccaguacaugggguugugaagaguuugguuguuuagcaguuagugaugggugugucuuuggguccugucaagacauuauaaaagaugagcuagcuguuuauaggaagacuacugaagaacucacuacaguagaauugugucugacauuuucugauaaaacauacugcacaaacuuaaaugcuauaacucccauaauaacagacaaauucgaaguucaauuuaagacaguugaaucuuacacauuaccaagaguaauugcuguaaaaaaucaugagauuaaaguugggcagauuaaugacuuaggcguuuacucuaaaggguguggaaaugugcaaaaaguaaauggcaccaauuaugggaauggaaugccaaaauuugacuaucuaugccaucuagcaaguagaaaagagguaauuuugaggaaaugcuuugacaacgauuaccaagcuugcaaauuuuuacaaagcccuucaaguuaccguuuagaagagcaucagggcacaguaacgaucauagauuauaaaaagauuuugggcacuauuaagaugaaggcuauacugggagauguuaaauacaaaaacuaccagaguaauauagaaaucaaugcugaagggacaugugcuggguguauaaauugcuuugaaaauauucauugugaauuuacuauacauaccacuguugaagcgagcuguccuauagugacagauuguguuucauuccaugauagaauucuaauaacaccagaugaacauaaauaugcauugaagguagucugucaagauaaacccaaaguaucuuuaaaauuuaagauuuguaacacgaacauugaugcaucaaugaccauuguagauucuaagccgauccuagagcuugcaccaguagaccaaacugcauauaucaaagagaaagaugagagauguaaaaccuggauguguagaguucgagaugaaggauuucaaguuauauuagagccuuuuaaaaauuuguucggcucuuauauugguauauuuuauacaggcauauuaucuguuauuugucuccucaucguuauuuauauaauauuacccauuuguuucaaauugagagacacuuugcggcaacacgaagaugcguauaagaaggaaaugaaaauaagguaa

SEQ ID NO: 4260 - RNA, 4335 nt, Artificial Sequence
  derived and/or modified CDS sequence (wt) from KEYV(KEYV/Ochlerotatus atlanticus/USA/KEYVLK01/2005)__KT630289.1__GP
augaugaucuggauucugcucacuguugucacugugacaauugcaaauccagucuaccaacguugcuuccaagauggugcuauagugaagcaaaauccaucaaaggaggcagucacugaaguaugucugaaagaugaugucagcaugaucaaaacugaggcaaaauaugugaaaaauuugaccggaacauuuucaaacaauguugcaaugagaaaauggcuaguugcugauuggcaugauuguaggccacaaaaaagagcuggcggacacauaaauguuauugaaguaggcgaugaccugucuuuacacacagagucuuauauaugcagugcagauugcguaauuaguguugauaaagaaacagcacaaauaagguuacagacagacaccacuaaucauuuugaaguugcaggaacaacuguaaaaucgggaugguuuaagagcaccacauacauaacuuuagaccagacaugugagcacuugaaagucucuugcggaccuaaaucuauucaauuccaugcaugcuuuaaucagcauaugucauguguuagauuuuuacaucguacuauauuaccaggaucgauugcuaauucuauuugucaaaacauagaaauaauaauauugguuacucuuacauuacuaauauucauacucuugaguauuuugaguaagacauacauauguuacauacuaaugccaauauucauaccgauugcuuauauauaugguuggguuuauaacaagucauguaaaaaaugcaaguuauguggcuuaguuuaccauccauucacagaaugugggacacacugugucuguggagcaagauaugagacuucagauaggaugaaguugcauagagcuucaggauuauguccugguuauaaaagcuuaagagcagcaagaguaaugugcaaaucaaaaggcccagcaucaauacuaucuauuuugacugcaguguuaauacuaacauuuauuacaccuaugaaugcuauggugcuuggcucaucagaagagguguauaaauuagaggaucuaccugaugauauguugaacauggcggagaagauagauauuuacuauuuaucuaucguauugaauuauaguacuacaugggggcuauuaaucuuguugcuaauagugucaugucuguucaaaaaguaucaacauguauuuuugaauuauuaugccauguauugccaugagugcgauauguaucaugaaaagaaaaaucuaguauauaauggggauuuuucaaacaaaugucgucaguguacaugcgggcaauaugaagacgcuacagguuugauaguccaucaaaaaucauauaacugcuugauuaaguauaaggcaaaaugguuuauaaauauacuuauaauauauaccauauuaguacuccugaaagacucuguguugauggcugcugcugaaggaccagauuucaauacauguauugagcagagaagcauuucauuaaauuguacugggccauuuauaaauuugggaggaugugaaaaaccucaaaagagggcgagcuaucaaucaauagcugaacaguuaaaagcaaucaaugcaauaucaauacuugacaugccuaugauuucgaaaauaccagaugauauaucuggagcuuuaaggcauauugaaaaucucaaaacauaccaugaacaacuaacagcagaauuugcaauguugacaagauacugugauuacuacacccaauucucugacaauucuggauauagccaaaccagcuggagaacauauuuacggucucaugauuuugagguaugcauugcauauccaaaucaacauuuuuguagaugugucaagaauggagaaaaaugcacaagugcuaacugggauuuugcuaaugagaugaagaauuacuauacuggaaaacagauuagguuugacaaagaucuaaauuuagcacuuacuacauuacauaccgcauuuagaggaacauccacguauuacaugucagacauauuagcagagacaaaagcgaacucauugagagacuacgcauuagcacucaagaguaaguacccuggaaaugccuuguugaaagcuauucuagauuucauaauguacuugcaaucccuaaaugaggcuacaaaauucaagcuuaguagugauugggaagacuuuaaauauaauucugaacuagaagcaagggcauuaaugccucgugccaggagcucuggugauuacaauuuuaguaaugcagaaagcacaaauaagguaaaaauuugcaagaacauacaacguguaauguguuuaucuccaagauccaaagcuacaguugaggacauuauugcaugcggugaacaugagcauccaucaguguauaugguuccaaacacuacuauauaccaguccaacauugagaggagccauuacuguauagcugauucacauugccuagaagaauaugaacuaguucagaaugaacuauuaacugcauuaaagaaauccacaugcuggacuggagaauuagaaaauguuauaccacauaaacaaagugaugggauccggagcugcaggacgaagaacacagggagaugcaauguuaaaggugaagauuggacugucaucuugugugaaaaugacaaauauuacuacucagaauuaaauaaagacuaugauaaggaucaagauauaggucaugucuguuuaaguccuagaugcaacucaauuagauacccaauaagcccaagacacaucacuaauugcaagugggaaaacccugcuggaacaaucaguagaauagagacccacucauuagcugauauagagcaauauaagaaagcaauaucacagaaauugcagaauaguuuaacaauuuuuaaauaugaaaaaacaaagaacuuaccacauauaaaaccuauuuauaaauauauaaccauagaagguacagaaacuguugaagguguggaaaaugcauucauagaggcagagauuccagcauuggcugguacuucaauaggauucaagguaaauucaagagauggugaucauuugauggacauaauugcauauauuaagguugcaucuuauucaucaacauauacgaaauuguauacgacaggaccaaccauugguauuaauacaaaacaugaugaaaagugcacagguaauugcccagcaagauuagaacauaaaguaggcuggcucaccuuugcuaaagaaagaacaagcacauggggcugugaggaauuuggcugucuagcuguaagugaugguugugucuuugguucaugucaagacaucauaaaagaggaacuaucuguuuacagaaaagauacagaggaagugucuaauguugaauugugucuaacauuugcagauaaaacguacugcacaaguuugaaugcuauuaccccaaucauaacagaaaaguuugaagugcaguuuaaaacuguugagucuuauuccuuaccuagaauuguaggaauaagaaaccaugagauuagaauuggccaaauaaaugauuugggcagcuauucuaaaggauguggaaauguucaaagggugaauggcacaaauuaugguaguggucaaccaaaguuugacuauuuaugucaucuugccagccgaaaagaagugauugucagaaagugcuuugacaaugauuaucaagcaugcaaauuccugcagacaccaucaagcuacagauuagaagagcaugaaggaacaguaacaaucauagauuacaaaaagauccuagguacuauaaaaaugaaagcaauuuuaggugaugucagauacaaaaauuaugcuucagccauugauauaaaugcugaagggguuugugcaggauguauuaauugcuucgaaaacauacacugugaauuuacaauacauacuacaauugaagcaaguugcccuauugagagcgacuguguaucuuuucacgauagaauacuagucacaccaaaugagcacaaauaugcucuaaaauuaauaugugaagacaagccaggaaguacacugaaguucaaaauaugcaacacaaagauugaugcugcuaugacauugguugaugcuaaaccaauccuagaauuggcaccaguagaccagacagcauauaucagagaaaaagaugagaggugcaagacuuggauguguagggugcgagaugagggcaucaagguuuuacuagaaccauuuaagaauuuauuugguucauauauagguauuguuuauaguauaauccugauuauuauugcagcaauaaucauaauuuauauaauacugccuaucugcuucaaauuaagggacacuuuaaagaagcaugaagaugcuuauagaaaggagaugaaaauuagauag

SEQ ID NO: 4261 - RNA, 4332 nt, Artificial Sequence
  derived and/or modified CDS sequence (wt) from KEYV(KEYV/Ochlerotatus atlanticus/USA/KEYVLK01/2005)__KT630289.1__GP
augaucuggauucugcucacuguugucacugugacaauugcaaauccagucuaccaacguugcuuccaagauggugcuauagugaagcaaaauccaucaaaggaggcagucacugaaguaugucugaaagaugaugucagcaugaucaaaacugaggcaaaauaugugaaaaauuugaccggaacauuuucaaacaauguugcaaugagaaaauggcuaguugcugauuggcaugauuguaggccacaaaaaagagcuggcggacacauaaauguuauugaaguaggcgaugaccugucuuuacacacagagucuuauauaugcagugcagauugcguaauuaguguugauaaagaaacagcacaaauaagguuacagacagacaccacuaaucauuuugaaguugcaggaacaacuguaaaaucgggaugguuuaagagcaccacauacauaacuuuagaccagacaugugagcacuugaaagucucuugcggaccuaaaucuauucaauuccaugcaugcuuuaaucagcauaugucauguguuagauuuuuacaucguacuauauuaccaggaucgauugcuaauucuauuugucaaaacauagaaauaauaauauugguuacucuuacauuacuaauauucauacucuugaguauuuugaguaagacauacauauguuacauacuaaugccaauauucauaccgauugcuuauauauaugguuggguuuauaacaagucauguaaaaaaugcaaguuauguggcuuaguuuaccauccauucacagaaugugggacacacugugucuguggagcaagauaugagacuucagauaggaugaaguugcauagagcuucaggauuauguccugguuauaaaagcuuaagagcagcaagaguaaugugcaaaucaaaaggcccagcaucaauacuaucuauuuugacugcaguguuaauacuaacauuuauuacaccuaugaaugcuauggugcuuggcucaucagaagagguguauaaauuagaggaucuaccugaugauauguugaacauggcggagaagauagauauuuacuauuuaucuaucguauugaauuauaguacuacaugggggcuauuaaucuuguugcuaauagugucaugucuguucaaaaaguaucaacauguauuuuugaauuauuaugccauguauugccaugagugcgauauguaucaugaaaagaaaaaucuaguauauaauggggauuuuucaaacaaaugucgucaguguacaugcgggcaauaugaagacgcuacagguuugauaguccaucaaaaaucauauaacugcuugauuaaguauaaggcaaaaugguuuauaaauauacuuauaauauauaccauauuaguacuccugaaagacucuguguugauggcugcugcugaaggaccagauuucaauacauguauugagcagagaagcauuucauuaaauuguacugggccauuuauaaauuugggaggaugugaaaaaccucaaaagagggcgagcuaucaaucaauagcugaacaguuaaaagcaaucaaugcaauaucaauacuugacaugccuaugauuucgaaaauaccagaugauauaucuggagcuuuaaggcauauugaaaaucucaaaacauaccaugaacaacuaacagcagaauuugcaauguugacaagauacugugauuacuacacccaauucucugacaauucuggauauagccaaaccagcuggagaacauauuuacggucucaugauuuugagguaugcauugcauauccaaaucaacauuuuuguagaugugucaagaauggagaaaaaugcacaagugcuaacugggauuuugcuaaugagaugaagaauuacuauacuggaaaacagauuagguuugacaaagaucuaaauuuagcacuuacuacauuacauaccgcauuuagaggaacauccacguauuacaugucagacauauuagcagagacaaaagcgaacucauugagagacuacgcauuagcacucaagaguaaguacccuggaaaugccuuguugaaagcuauucuagauuucauaauguacuugcaaucccuaaaugaggcuacaaaauucaagcuuaguagugauugggaagacuuuaaauauaauucugaacuagaagcaagggcauuaaugccucgugccaggagcucuggugauuacaauuuuaguaaugcagaaagcacaaauaagguaaaaauuugcaagaacauacaacguguaauguguuuaucuccaagauccaaagcuacaguugaggacauuauugcaugcggugaacaugagcauccaucaguguauaugguuccaaacacuacuauauaccaguccaacauugagaggagccauuacuguauagcugauucacauugccuagaagaauaugaacuaguucagaaugaacuauuaacugcauuaaagaaauccacaugcuggacuggagaauuagaaaauguuauaccacauaaacaaagugaugggauccggagcugcaggacgaagaacacagggagaugcaauguuaaaggugaagauuggacugucaucuugugugaaaaugacaaauauuacuacucagaauuaaauaaagacuaugauaaggaucaagauauaggucaugucuguuuaaguccuagaugcaacucaauuagauacccaauaagcccaagacacaucacuaauugcaagugggaaaacccugcuggaacaaucaguagaauagagacccacucauuagcugauauagagcaauauaagaaagcaauaucacagaaauugcagaauaguuuaacaauuuuuaaauaugaaaaaacaaagaacuuaccacauauaaaaccuauuuauaaauauauaaccauagaagguacagaaacuguugaagguguggaaaaugcauucauagaggcagagauuccagcauuggcugguacuucaauaggauucaagguaaauucaagagauggugaucauuugauggacauaauugcauauauuaagguugcaucuuauucaucaacauauacgaaauuguauacgacaggaccaaccauugguauuaauacaaaacaugaugaaaagugcacagguaauugcccagcaagauuagaacauaaaguaggcuggcucaccuuugcuaaagaaagaacaagcacauggggcugugaggaauuuggcugucuagcuguaagugaugguugugucuuugguucaugucaagacaucauaaaagaggaacuaucuguuuacagaaaagauacagaggaagugucuaauguugaauugugucuaacauuugcagauaaaacguacugcacaaguuugaaugcuauuaccccaaucauaacagaaaaguuugaagugcaguuuaaaacuguugagucuuauuccuuaccuagaauuguaggaauaagaaaccaugagauuagaauuggccaaauaaaugauuugggcagcuauucuaaaggauguggaaauguucaaagggugaauggcacaaauuaugguaguggucaaccaaaguuugacuauuuaugucaucuugccagccgaaaagaagugauugucagaaagugcuuugacaaugauuaucaagcaugcaaauuccugcagacaccaucaagcuacagauuagaagagcaugaaggaacaguaacaaucauagauuacaaaaagauccuagguacuauaaaaaugaaagcaauuuuaggugaugucagauacaaaaauuaugcuucagccauugauauaaaugcugaagggguuugugcaggauguauuaauugcuucgaaaacauacacugugaauuuacaauacauacuacaauugaagcaaguugcccuauugagagcgacuguguaucuuuucacgauagaauacuagucacaccaaaugagcacaaauaugcucuaaaauuaauaugugaagacaagccaggaaguacacugaaguucaaaauaugcaacacaaagauugaugcugcuaugacauugguugaugcuaaaccaauccuagaauuggcaccaguagaccagacagcauauaucagagaaaaagaugagaggugcaagacuuggauguguagggugcgagaugagggcaucaagguuuuacuagaaccauuuaagaauuuauuugguucauauauagguauuguuuauaguauaauccugauuauuauugcagcaauaaucauaauuuauauaauacugccuaucugcuucaaauuaagggacacuuuaaagaagcaugaagaugcuuauagaaaggagaugaaaauuagauag

SEQ ID NO: 4262 - RNA, 4332 nt, Artificial Sequence
  derived and/or modified CDS sequence (wt) from KEYV(KEYV/Ochlerotatus atlanticus/USA/KEYVLK02/2005)__KT630292.1__GP
augaucuggauucugcucacuguugucacugcgacaauugcaaauccaguuuaccaacguugcuuccaagauggcgcuauagugaagcaaaauccaucaaaggaggcagucacugaaguaugucugaaagaugaugucagcaugaucaaaacugaggcaaaauaugugaaaaauuuaaccggaacauuuucaaacaauguugcaaugagaaaauggcuaguugcugauuggcaugauuguaggccacaaaagagagcuggcggacacauaaauguuaucgaaguaggcgacgaucugucuuuacacacagagucuuauauaugcagugcagauugcguaauuaguguugauaaagaaacagcacaaauaagguuacagacggacaccacuaaucauuuugaaguugcaggaacaacuguaaaaucgggaugguuuaagagcacuacauacauaacuuuagaccagacuugugagcacuugaaagucucuugcggaccuaaaucuauucaauuccaugcaugcuuuaaucaacauaugucauguguuagauuuuuacaucguacuauauuaccaggaucaauugcuaauucuauuugucaaaacauagaaauaauaauauugguuacucuuacauuacuaauauucauacucuugaguauucugaguaagacauacauauguuacauacuaaugccaauauucauaccgauugcuuauaucuaugguuggguuuauaacaagucauguaaaaaaugcaaguuauguggccuaguuuaccauccauucacagaaugugggacacacugugucuguggagcaagauaugagacuucagauaggaugaaguugcauagagcuucaggauuauguccugguuauaaaagcuuaagagcagcaagaguaaugugcaaaucaaaaggcccagcaucaauacuaucuauuuugacugcaguguuaauacuaacauuuauuacaccuaugaaugcuauggugcuuggcucaucagaagagguguauaaauuagaggaucuaccugaugauauguugaacauggcagagaagauagauauauacuauuuaucuaucguauugaauuauaguacuacaugggggcuauuaaucuuauugcuaauagugucgugucuguucaaaaaguaucaacauguauuucugaauuauuaugccauguauugccaugagugugauauguaucaugaaaagaaaaaucuaguauauaauggggauuuuucaaacaaaugucggcaguguacaugcgggcaauaugaagacgcuacagguuugauaguccaccaaaaaucauauaacugcuugauuaaguauaaggcaaaaugguuuauaaauauacuuauaauauauaccauauuaguacuccugaaagacucuguauugauggcugcugcugaaggaccagauuucaauacauguauugagcagaggagcauuucauugaauuguacugggccauuuauaaauuugggaggaugugaaaaaccucaaaagagggcgagcuaucaaucaauagcugaacaguuaaaagcaaucaaugcaauaucaauacuugacaugccuaugauuucaaaaauaccagaugauauaucuggagcuuuaaggcauauugaaaaucucaaaacauaccaugaacaacuaacagcagaauuugcaauguugacaagauacugugauuacuacacccaauucucugacaauuccggauauagccaaaccagcuggagaacauauuuacggucucaugauuuugagguaugcauugcauauccaaaucaacauuuuuguagaugugucaagaauggagaaaaaugcacaagugcuaacugggauuuugcuaaugagaugaagaauuacuauacuggaaaacagauuagguuugacaaagaucuaaauuuagcacucacuacacuacauaccgcauuuagaggaacauccacauauuacaugucagacauauuagcagaaacaaaagcgaacucauugagagacuacgcauuagcacucaagaguaaguacccuggaaaugccuuguugaaagcuauucuagauuucauaauguacuugcaaucccuaaaugaggcuacaaaauucaagcuuaguagugauugggaagacuuuaaauauaauucugaaccagaagcaagggcauuaaugccucgugccaggagcucuggugauuacaauuuuaguaaugcagaaagcacaaauaaggcaaaaguuugcaagaacauacaacguguaaugugcuuaucuccaagauccaaagccacaguugaggacauuauugcaugcggugaacaugagcauccaucaguguauaugguuccaaacacuacuguauaccaguccaacauugagaggagucauuacuguauagcugacucacauugccuagaagaauaugagcuaguucagaaugaacuauuaacugcauuaaagaaauccacaugcuggacuggagaauuagaaaauguuauaccacauaaacaaagugaugggacccggagcugcaggacgaagaacacagggagaugcaauguuaaaggugaagauuggacuguuaucuugugugaaaaugacaaauauuacuacucagaauuaaauaaagacuaugauaaggaccaagauauaggucaugucuguuuaagcccuagaugcaacucaauuagauacccaauaagcccaagacacaucacuaauugcaagugggaaaacccugcuggaacaaucaguagaauagagacccacucauuagcugauauagagcaauauaagaaagcaauaucacagaaauugcagaauaguuuaacaauuuuuaaauaugaaaaaacaaagaauuuaccacauauaaaaccuauuuauaaauauauaaccauagaagguacagaaacugucgaagguguggaaaaugcauucauagaggcagagauuccagcauuggcugguacuucaauaggauucaagguaaauucaagagauggugaucaucugauggacauaauugcauauaucaagguugcaucuuauucaucaacauauacgaaauuguauacgacaggaccgaccauugguauuaauacaaaacaugaugaaaagugcacagguaauugcccagcaagauuagaacauaaaguaggcuggcucaccuuugcuaaagaaagaacaagcacauggggcugugaggaauuuggcugucuagcuguaagugaugguugugucuuugguucaugucaagacaucauaaaagaggaacuaucuguuuacaggaaagauacagaagaagugacuaauguugaauugugucugacauuugcagauaagacguacugcacaaguuuaaaugcuauuaccccaaucauaacagaaaaguuugaagugcaguuuaaaacuguugaguccuauuccuuaccuagaauuguaggaauaagaaaccaugagauuagaauuggccaaauaaaugauuugggcaguuauucuaaaggauguggaaauguucaaagggugaaugauacaaauuaugguaguggucaaccaaaguuugacuauuuaugucaucuugccagccgaaaagaagugauugucaggaagugcuuugacaaugauuaucaagcaugcaaauuucugcagacaccaucaagcuacagauuagaagagcaugaaggaacaguaacaaucauagauuacaaaaagauccuagguacuauaaaaaugaaagcaauuuuaggugaugucagauacaagaauuaugcuucagccauugauauaaaugcugaagggguuugugcaggauguauuaauugcuucgaaaacauacacugugaauuuacaauacauaccacaauugaagcaaguugcccuauugagagcgacuguguaucuuuucacgauagaaugcuagucacaccaaaugagcacaaauaugcucuaaaacuaauaugugaagacaagccaggaaguacacugaaguucaaaauaugcaacacaaagauugaugcugcuaugacauugguugaugcuaaaccaauccuagaauuggcaccaguagaccagacagcauauaucagagaaaaagaugagaggugcaagacuuggauguguagggugcgagaugagggcaucaaaguuuuacuagaaccauuuaagaauuuauuugguucauauauagguauuguuuauaguauaauccuaauuauuauugcagcaauaaucauaauuuauguaauacugccuaucugcuuuaaauuaagggacacuuuaaagaagcaugaagaugcuuauagaaaggaaaugaaaauuagauag

SEQ ID NO: 4263 - RNA, 4332 nt, Artificial Sequence
  derived and/or modified CDS sequence (wt) from KEYV(C14031-33)__AF123489.1__GP
augaucuggauucugcucacuguugucacugugacaauugcaaauccagucuaccaacguugcuuccaagauggugcuauagugaagcaaaauccaucaaaggaggcaguuacugaaguaugucugaaagaugaugucagcaugaucaaaacugaggcaaaauaugugaaaaauuugaccggaacauuuucaaacaauguugcaaugagaaaauggcuaguugcugauuggcaugauuguaggccacaaaaaagagcuggcggacacauaaauguuauugaaguaggcgaugaccugucuuuacacacagagucuuauauaugcagugcagauugcguaauuaguguugauaaagaaacagcacaaauaagguuacagacagacaccacuaaucauuuugaaguugcaggaacaacuguaaaaucgggaugguuuaagagcacuacauacauaacuuuagaccagacuugugagcgccugaaagucucuugcggaccuaaaucuauucaauuccaugcaugcuuuaaucaacauaugucauguguuagauuuuuacaucguacuauauuacuaggaucgauugcuaauucuauuugucaaaacauagaaauaauaauauugguuacucuuacauuacuaauauucauacucuugaguauuuugaguaagacauacauauguuacauacuaaugccaauauccauaccgauugcuuauauauaugguuggguuuauaacaagucauguaaaaaaugcaaguuauguggcuuaguuuaccauccauucacagaaugugggacacacugugucuguggagcaagauaugagacuucagauaggaugaaguugcauagagcuucaggauuauguccugguuauaaaagcuuaagagcagcaagaguaaugugcaaaucaaaaggcccagcaucaauacuaucuauuuugacugcaguguuaauacuaacauuuauuacaccuaugaaugcuauggugcuuggcucaucagaagagguguauaaauuagaggaucuaccugaugauaugcugaacauggcggagaagauagauauuuacuauuuaucuaucguauugaauuauaguacuacaugggggcuauuaaucuuguuguuaauagugucuugucuguucaaaaaguaucaucuuguauuuuugaauuauuaugccuuguauugccaugagugcgauauguaccaugaaaagaaaaaucuaguauauaauggggauuuuucaaacaaaugucugcaguguacaugcgggcaauaugaagaugcuacagguuugauaguccaucaaaaaucauauaacugcuugauuaacuauaaggcaaaaugguuuauaaauauacuuauaauauauaccauauuaguacuccugaaagacucuguguugauggcugcugcugaaagaccagauuucaauacauguauugagcagagaagcauuucauuaaauuguacugggccauuuauaaauuugggaggauguaaaaaaccucaaaagagggcgagcuaucaaucaauagcugaacaguuaaaagcaaucaaugcaauaucaauacuugacaugccuaugauuucaaaaauaccagaugauauauccggagcuuuaagacauauugaaaaucucaaaacauaccaugaacaacuaacagcagaauuugcaauguugacaagauacugugauuacuacacccaauucucugacaauuccggauauagccaaaccagcuggagaacauauuuacggucucaugauuuugagguaugcaucgcauauccaaaucaacauuuuuguagaugugucaagaauggagaaaaaugcacaagugcuaacugggauuuugcuaaugagaugaagaauuacuauacuggaaaacagauuagauuugacaaagaucuaaauuuagcacuuacuacacuacauaccgcauuuagaggaacauccacauauuacaugucagacauauuagcagagacaaaagcgaacucauugagagacuacgcauuagcacucaagaguaaguacccuggaaaugccuuguugaaagcuauucuagauuucauaauguacuugcaaccccuaaaugaggcuacaaaauucaagcuuaguagugauugggaagacuuuaaauauaauucugaaccagaagcaagggcauuaaugccucgugccaggagcucuggugauuacaauuuuagcaaugcagaaagcacaaauaagguaaaaguuugcaagaacauacaacguguaaugugcuuaucuccaagauccaaagcuacaguugaggacauuauugcaugcggugaacaugagcauccaucaguguauaugguuccaaacacuacuauauaccaguccaacauugagaggagccauuacuguauagcugacucacauugccuagaagaauaugagcuaguucagaaugaacuauuaacugcauuaaagaaauccacaugcuggacuggagaguuagaaaauguuauaccacauaaacaaagugaugggauccggagcugcaggacgaagaacacagggagaugcaauguuaaaggugaagauuggacugucaucuugugugaaaaugauaaauauuacuacucagaauuaaauaaagacuaugauaaggaucaagauauaggucaugucuguuuaagcccuagaugcaacucaauuagauacccaauaagcccaagacacaucacuaauugcaagugggaaaacccugcuggaacaaucaguagaauagagacccauucauuagcugauauagagcaauauaagaaagcaauaucacagaaauugcagaauaguuuaacaauuuuuaaauaugaaaaaacaaagaacuuaccacauauaaaaccuauuuauaaauauauaaccauagaagguacagaaacuguugaagguguggaaaaugcauucauagaggcagagauuccagcauuggcuggcacuucaauaggauucaagguaaauucaagagauggugaucaucugauggacauaauugcauauauuaagguugcaucuuauucaucaacauauacgaaauuguauacgacaggaccaaccauugguauuaauacaaaacaugaugaaaagugcacagguaauugcccagcaagauuagaacauaaaguaggcuggcucaccuuugcuaaagaaagaacaagcacauggggcugugaggaauuuggcugucuagcuguaagugaugguugugucuuugguucaugucaagacaucauaaaagaggaacuaucuguuuacaggaaagauacagaagaagugacuaauguugaauugugucuaacauuugcagauaaaacguacugcacaaguuuaaaugcuauuaccccaaucauaacagaaaaguuugaagugcaguuuaaaacuguugaaucuuauuccuuaccuagaauuguaggaauaagaaaccaugagauuagaauuggccaaauaaaugauuugggcagcuauucuaaaggauguggaaauguucaaagggugaauggcacaaauuaugguaguggucaaccaaaguuugacuauuuaugucaucuugccagccgaaaagaagugauugucagaaagugcuuugacaaugauuaucaagcaugcaaauuccugcagacaccaucaagcuacagauuagaagagcaugaaggaacaguaacaaucauagauuacaaaaagauccuagguacuauaaaaaugaaagcaauuuuaggugaugucagauacaagaauuaugcuucagccauugauauaaaugcugaagggguuugugcaggauguauuaauugcuucgaaaauauacacugugaauuuacaauacauacuacaauugaagcaaguugcccuauugagagcgacuguguaucuuuucacgauagaaugcuagucacaccaaaugagcacaaauaugcucuaaaacuaauaugugaagacaagccaggaagugcacugaaguucaaaauaugcaacacaaagauugaugcugcuaugacauugguugaugcuaaaccaauccuagaauuggcgccaguagaccagacagcauauaucagagaaaaagaugagaggugcaagacuuggauguguagggugcgagaugagggcaucaagguuuuacuagaaccauuuaagaauuuauuugguucauauauagguauuguuuauaguauaauccuaauuauuauugcagcaauaauuauaauuuauauaauacugccuaucugcuucaaauuaagggacaccuuaaagaagcaugaagaugcuuauagaaaggagaugaaaauuagauag

SEQ ID NO: 4264 - RNA, 4326 nt, Artificial Sequence
  derived and/or modified CDS sequence (wt) from LACV(Human/78)__NC_004109.1__GP
augauuuguauauuggugcuaauuacaguugcagcugcaagcccaguguaucaaagguguuuccaagauggggcuauagugaagcaaaacccauccaaagaagcaguuacagaggugugccugaaagaugauguuagcaugaucaaaacagaggccagguauguaagaaaugcaacaggaguuuuuucaaauaaugucgcaauaaggaaauggcuagucucugauuggcaugauugcaggccuaagaagaucguugggggacacaucaauguaauagaaguuggugaugaccugucacuccauacugaaucauauguuugcagcgcagauuguaccauagguguagacaaagagacugcacaggucaggcuucagacagauaccacaaaucauuuugaaauugcaggcacuacugugaagucaggaugguucaagagcacgacauauauaacucuugaucaaacuugcgaacaccuuaaaguuuccugcggcccaaaaucuguacaguuccaugccugcuucaaucagcauaugucuugcgucagauuuuuacacaggacaauauugccuggcucuauagccaauuccauaugucagaauaucgaaaucauaauuuuaguuacacuuacucuauuaaucuuuauauuguuaagcauuuuaaguaagacuuauauauguuauuuauuaaugccuauauucauccccauagcauauauauacgguauaauuuacaauaagucgugcaaaaaaugcaaauuauguggcuuaguguaucauccauucacagaguguggcacacauugugucuguggugcccgcuaugauacuucagauagaaugaaacugcauagagcuucuggauugugcccugguuauaaaagccuaagagcugccagagucaugugcaagucgaaagggccugcaucaauauugucuauaauuacugcgguacuggucuuaaccuuugugacaccaaucaacuccaugguuuuaggagagaguaaagaaaccuuugaacuugaagaucuuccagacgacauguuggaaauggcaucgagaauaaauucuuauuaucucaccuguaucuugaauuaugcuguaagcuggggucuuguuaucauuggauuguugaucgggcugcuuuuuaagaaauaccagcacagauucuuaaauguuuacgcaauguacugugaagaaugugacauguaucaugacaagucuggguugaaaagacauggugauuucaccaacaaaugcagacagugcacauguggucaauaugaagaugcugcagguuugauggcucacaggaaaaccuauaacugcuuagugcaguacaaagcaaaguggaugaugaacuuccugauaauuuacauauucuuaauuuugaucaaagauucugcuauaguuguacaagcugcuggaacugacuucaccaccugccuagagacugagaguauaaauuggaacugcacugggccauuuuugaaccucgggaauugccaaaagcaacaaaagaaagaaccuuacaccaacauugcaacucaguuaaagggacuaaaggcaauuuccguacuagaugucccuauaauaacagggauaccagaugauauugcgggugcuuuaagauauauagaagagaaggaagauuuccauguccagcuaacuauagaauaugcgauguuaagcaaauacugugacuauuauacccaauucucagauaacucaggauacagucagacaacauggagaguguacuuaaggucucaugauuuugaagccuguauacuauauccaaaucagcacuuuugcagauguguaaaaaauggugagaagugcagcagcuccaauugggacuuugccaaugaaaugaaagauuauuacucugggaaacaaacaaaguuugacaaggacuuaaaucuagcccuaacagcuuugcaucaugccuucagggggaccucaucugcauauauagcaacaaugcucucaaaaaaguccaaugaugacuugauugcauacacaaauaagauaaaaacaaaauucccagguaaugcauuguugaaggcuauaauagauuauauagcauauaugaaaaguuugccagguauggcaaauuucaaauaugaugaauucugggaugaauuacuguacaaacccaacccagcaaaggccucaaaccuugcuagaggaaaggagucaucuuacaacuucaaacuagcaauuucaucaaagucuauaaaaaccugcaagaauguuaaggauguugccugcuuaucgccaaggucaggugcuauauaugcuucaauaauugcguguggugaacccaaugggccaaguguguauaggaaaccaucaggugguguauuccaaucuagcacugaucggucuauauacugcuugcuggauagccauugucuagaagaauuugaggccaucggccaggaggagcuggaugcgguaaagaaauccaaauguugggaaauugaauauccugacguaaagcucauccaagaaggcgaugggacuaaaagcuguagaaugaaagauucugggaacugcaauguugcaacuaacagauggccagugauacaaugugagaaugacaaauuuuacuacucagagcuucaaaaagauuaugacaaagcucaagauauuggucacuauugcuuaagcccuggauguacuacuguccgguacccuauuaauccaaagcacaucucuaacuguaauuggcaaguaagcagaucuagcauagcgaagauagaugugcacaauauugaggauauugagcaauauaagaaagcuauaacucagaaacuucaaacgagccuaucucuauucaaguaugcaaaaacaaaaaacuugccgcacaucaaaccaauuuauaaauauauaacuauagaaggaacagaaacugcagaagguauagagagugcauacauugaaucagaaguaccugcauuggcugggacaucuaucggauucaaaaucaauucuaaagagggcaagcacuugcuagauguuauagcauauguaaaaagugccucauacucuucaguguauacaaaauuguacucaacuggcccaacaucagggauaaauacuaaacaugaugaauuguguacuggcccaugcccagcaaauaucaaucaucagguuggguggcugacauuugcaagagagaggacaagcucauggggaugcgaagaguuugguugccuggcuguaagugauggguguguauuuggaucaugccaagauauaauaaaagaagaacuaucugucuauaggaaggagaccgaggaagugacugauguagaacuguguuugacauuuucagacaaaacauacuguacaaacuuaaacccuguuaccccuauuauaacagaucuauuugagguacaguucaaaacuguagagaccuacagcuugccuagaauuguugcugugcaaaaccaugagauuaaaauugggcaaauaaaugauuuaggaguuuacucuaaggguugugggaauguucaaaaggucaauggaacuauuuauggcaauggaguucccagauuugacuacuuaugccauuuagcuagcaggaaggaagucauuguuagaaaaugcuucgacaaugauuaccaagcaugcaaauuucuucaaagcccugcuaguuacagacuugaagaagacaguggcacugugaccauaauugacuacaaaaagauuuuaggaacaaucaagaugaaggcaauuuuaggagaugucaaauauaaaacauuugcugauagugucgauauaaccgcagaagggucaugcaccggcuguauuaacugcuucgaaaauauccauugcgaauuaacguugcacaccacaauugaagccagcugcccaauuaaaagcucgugcacaguauuucaugacaggauucuugugacuccaaaugaacacaaauaugcauugaaaauggugugcacagaaaagccagggaacacacucacaauuaaagucugcaauacuaaaguugaagcaucuauggcccuuguagacgcaaagccuaucauagaacuagcaccaguugaucagacagcauauauaagagaaaaagaugaaagguguaaaacuuggauguguaggguaagagaugaaggacugcaggucaucuuggagccauuuaaaaauuuauuuggaucuuauauugggauauuuuacacauuuauuauaucuauaguaguauuauugguuauuaucuauguacuacuaccuauaugcuuuaaguuaagggauacccuuagaaagcaugaagaugcauauaagagagagaugaaaauuagauag

SEQ ID NO: 4265 - RNA, 4326 nt, Artificial Sequence
  derived and/or modified CDS sequence (wt) from LACV__KP271111.1__GP
augauucgcauacugguacugauugcaguuacagcugcaagcccaguguaucaaagguguuuccaagauggggcuauagugaagcaaaacccauccaaagaagcaguuacagaggugugccugaaagaugauguuagcaugaucaaaacagaggccagguacguaagaaaugcaacaggaguuuuuucaaacaauguugcaauaaggaaauggcuagucucugacuggcaugauugcagaccuaagaagaucauugggggacacaucaauguaauagaaguuggugaugaccugucacuccauacugaaucauauguuuguagcgcagauuguagcauagguguugacaaagagacugcacaggucaggcuucagacagauaccacaaaucacuuugaaauugcaggcacuacugugaagucagggugguuuaaaagcacgacguauauaacucuugaucaaaccugcgaacaccuuaaaguuuccugcggcccaaaaucuguacaguuccaugccugcuucaaucagcacaugucuugcgucagauuuuuacacaggacaauauugccuggcucuauagccaauucuauaugucagaauauugaaaucauaauuuuaguuacacuuacucuauuaaucuuuauauuguuaagcauuuuaaguaagacuuauauauguuauuuauuaaugccuauauuuaucccuauagcauacauguacgguauaauuuacaauaagucgugcaaaaaaugcaaacuaugcggccuaguguaucauccauucacagaguguggcacacauugcgucuguggugcucgcuaugauacuucagauagaaugaaacugcacagagcuucuggauugugcccugguuauaaaagccuaagagcugccagaguuaugugcaagucgaaagggccugcaucaauauugucuauaauuacugcaguacuggucuuaaccuuugugacaccaaucaauucuaugguuuuaggggagaguaaagaaacuuuugaacuugaagagcuuccagacgauauguuggaaauggcaucaagaauaaauucuuauuauuucaccuguaucuuaaauuaugcuguaagcuggggucuuguuaucauuggauuguugaccgggcugcuauuuaagaaauaucagcacagauuuuuaaauguuuacgcaauguacugugaggagugugacauguaccaugacaagucuggguugaaaagacauggugauuucacuaacaaaugcaggcagugcacauguggucaguaugaagaugcugcagguuugauggcccacaggaaaaccuauaacugcuuagugcaguacaaagcaaaauggaugaugaauuuccugauaauuuauauauucuuaauuuuaaucaaagauucugcuauaguuguacaagcugcuggaacugauuucaccacuugccuagagacugagaguauaaauuggaacugcacagggccauucuugaaccucgggaauugucaaaagcaacaaaagaaagaaccuuacaccaacauugcaacccaguuaaagggacuaaaggcaauuuccguacuagauaucccuauaauaacagggauaccagaugauaucgcaggugcuuuaagauauauagaagagagggaagacuuccauguccagcuaacuauagaauaugcaaugcugaguaaauacugugacuauuauacccaauucucagacaacucaggauacagucaaacaacauggagaguguacuuaaggucucaugauuuugaggcauguauacuauauccaaaucagcauuuuugcagaugugugaaaaauggugagaagugcagcagcuccaauugggacuuugccaacgaaaugaaagauuauuacucagggaaacaaacaaaguuugauaaagacuuaaaucuagcccuaacagcuuugcaucaugcuuucagggggacuucaucugcauauauagcaacaaugcucucaaaaaaauccaacgaugacuugauugcauacacaaauaagauaaaagcaaaauucccagguaaugcauuguugaaggcuauaauagauuauauagcauauaugaaaagucugccagguauggcaaauuucaaauaugaugaauucugggaugaguuauuguacaaacccaacccagcaaaggcuucaaaccuugcuagaggaaaggagucuucuuacaacuucaaacuagcaauuucaucaaaaucuauaaaaaccugcaagaauguuaaggauguugccugcuuaucgccaaggucaggugcuauauaugcuucaauaauugcauguggugaacccaauggaccaaguguguauagaaaaccaucaggugguguauuccaaucuagcacugaucggucuauauacugcuuacuagauagccauugucuagaagaauuugaggcuauuaaccaggaggaacuggaugcaguaaaaaaaucaaaauguugggaaauugaauauucugaugugaagccccuccaagaaggugauggaacuaaaagcuguagaaugaaagauucugggaacugcaauguugcaacuaacagauggccagugauacaaugcgagaaugacaaauuuuacuacucagagcuucaaaaagauuaugacaaaacucaagauauuggucauuauugcuuaaguccuggauguacuacuguucgguacccuauuaauccaaagcauaucucuaacuguaauuggcaggugagcagauccagcauagcgaagauagaugugcacaauauugaagauauugaacaguauaagaaggcuauaacucagaaacuucaaacaagcuuaucucuauucaaguaugcaaaaacaaagaauuugccgcacaucaagccaauuuacaaauauauaacuauagagggaacagaaacugcagaagguauagagagugcauacaucgaaucagagguaccugcauuggcugggacaucuaucggauucaaaaucaauucuaaagagggcaagcacuugcuagauguuauagcauauguaaaaagcgccucauacucuucaguguaugcaaaauuguacucaacuggcccaacaucagggauaaauacuaaacaugaugaauuguguacuggcccaugcccggcaaauaucaaucaucagguuggguggcuaacauuugcaaaagagaggacaagcucauggggaugcgaagaguuugguugccuggcuguaagugauggguguguauucgggucaugccaagauauaauaaaagaagaacuaucugucuauaggaaggagaccgaagaagugacugauguagaacuauguuuaacauuuucagacaaaacauacuguacaaacuuaaacccuguuaccccuauuauaacagaccuauuugagguacaguucaagacuguagagacuuacagcuugcccagaauuguugcugugcaaaaucaugagauuaagauugggcaaauaaaugaucuaggaguuuacucuaaggguuguggaaauguccaaaagaucaacggaacuguuuauggcaauggaguucccagauuugacuaucuaugccauuuagcuagcagaaaggaagucauuguuagaaaaugcuucgacaaugauuaccaagcaugcaaauuucuucagagcccugcuaguuacagacuugaagaagacaguggcacugugacuauaauugauuacaaaaagauauuaggcacaaucaagaugaaggcaauucuaggagaugucaaauauaaaacauuugcugauagugucgauauaacugcagaagggucaugcacuggcuguaucaacugcuucgagaauauccauugcgaauuaacguugcauacuacaauugaagccagcugcccaauuaaaagcucaugcacaguauuccaugauaggauucuugugacuccaaaugaacacaaauaugcauuaaaaauggugugcacagaaaagccggggaacacacucacaauuaaaguuugcaauacuaagauugaagcaucuauggcccuugucgaugcaaagccuaucauagaacuagcaccaguugaucagacagcauauauaagagaaaaagaugaaagguguaaaacuuggauguguaggguaagagaugaaggacugcaggucaucuuggagccauuuaaaaauuuguuugggucuuauauugggauauuuuacacauuuauuauaucuauaguggcauuauugguuauugucuaugugcuauugccuauaugcuuuaaguuaagagauacccuuagaaagcacgaagaugcauauaagagagagaugaaaauuagauag

SEQ ID NO: 4266 - RNA, 4326 nt, Artificial Sequence
  derived and/or modified CDS sequence (wt) from LACV__M87664.1__GP
augauuuguauauuggugcuaauuacaguugcgacugcaagcccaguguuacaaagguguuuccaagauggggcuauagugaagcaaaacccauccaaagaggcauucacagaggugugccugaaagaugauguuagcaugaucaaaacagaggccagguauguaagaaaugcaacaggaguuuuuucaaauaaugucgcaauaaggaaauggcuagucucugcuuggcaugauugcaggccuaagaagaucguugggggacacaucaauguaauagaaguuggugaugaccugucacuccauacugaaucauauguuugcagcgcagauuguaccauagguguagacaaagagacugcacaggucaggcuucagacagauaccacaaaucauuuugaaauugcaggcacuacugugaagucaggaugguucagaagcacgacauauauaacucuugaucaaacuugcgaacaccuuaaaguuuccugcggcccaaaaucuguacaguuccaugccugcuucaaucagcauaugucuugcgucagauuuuuacacaggacaauauugccucguucuauagccaauuccauaugucagaauaucgaaaucauaauuuuaguuacacuuacucuauuaaucuuuauauuguuaagcauuuuaaguaagacuuauauauguuauuuauuaaugccuauauucauccccauagcauauauauacgguacaauuuacaauaagucgugcaaaaaaugcaaauuauguggcuuagcgcaucacccauucacagaguguggcacacauugugucuguggugcccgcuaugauacuucagauagaaugaaacugcauagagcuucuggauugugcccugguuauaaaagccuaagagcugccagagucaugugcaagucgaaagggccugcaucaauauugucuauaauuacugcgguacugguccuaaccuuugugacaccaaucaacuccaugguuuuaggagagaguaaagaaaccuuugaacuugaagaucuuccagacgacauguuggaaauggcaucgagaauaaauucuuauuauccuaccuguaucuugaauuaugcuguaagcuggggucuuguuaucauuggauuguugaucgggcugcuuuuuaagaaauaccagcacagauucuuaaauguuuacgcaauguacugugaagaaugugacauguaucaugacaagucuggggugaaaagacauggugauuucaccaacaaaugcagacaaugcacauguggucaauaugaagaugcugcagguuugauggcucauaggaaaaccuauaacugcuuagugcaguacaaagcaaaguggaugaugaacuucuugauaauuuacauauucuuaauuuugaucaaagauucugcuauaguuguacaagcugcuggaacugacuucaccaccugccuagagacugagaguauaaauuggaacugcacugggccauuuuugaaccucgggaauugccaaaagcaacaaaagaaagaaccuuacaccaacauugcaacucaguuaaagggacuaaaagcaauuuccguacuagauaucccuauaauaacagggauaccagaugauauugcgggugcuuuaagauauauagaagagaaggaagauuuccauguccagcuaacuauagaauaugcgauguuaaguaaauacugugacuauuauacccaauucucagauaacucaggauacagucagacaacauggagaguguacuuaaggucucaugauuuugaagccuguauacuauauccaaaucagcacuuuugcagauguguaaaaaauggugagaagugcagcagcuccaaucgggacuuugccaaugaaaugaaagauuauuacucugggaaacaaacaaaguuugacaaggauuuaaaucuagcccuaacagcuuugcauucccagguaaugcauuguucaucugcauauauagcaacaaugcucucaaaaaaguccaaugaugacuugauugcauacacaaauaagauaaaaacaaaauucccagguaaugcauuguugaaggcuauaauagauuauauagcauauaugaaaaguuugccagguauggcaaauuucaaauaugacgaguucugggaugaauuauuguacaaaccuaacccagcaaaagccucaaaccuugcuagaggaaaggagucaucuuacaacuucaaacuagcaauuucaucaaagucuauaaaaaccugcaagaauguuaaggauguugccugcuuaucgccaaggucaggugcuauauaugcuucaauaauugcguguggugaacccaaugggccaaguguguauaggaaaccaucaggugguguauuccaauccaguacugaccggucuauauacugcuugcuggauagccauugucuagaagaauuugaggccaucagucaagaggagcuggaugcaguaaagaaauccaaauguugggaaauugaauauccugacguaaagcucauccaagaaggcgaugggacuaaaagcuguagaaugaaagauucugggaacugcaauguugcaacuaacagauggccagugacacaaugugagaaugacaaauuuuacuacucagaccuucaaaaagauuaugacaaaacucaagauauuggucacuauugcuuaagcccuggauguacuacuguccgguacccuauuaauccaaagcacaucucuaacuguaauuggcaaguaagcagaucuagcauagcagagauagaugugcacaauauugaggauauugagcaauauaagaaagcuauaacucagaaacuucaaacaagccuaucucuauucaaguaugcaaaaacaaaaaacuugccgcacaucaaaccaauuuauaaauauauaacuaugaagggaacagaaacugcagaagggauagagagugcauauauugagucagaaguaccugcauuggcugggacaucuaucggauucaaaaucaauucuaaagagggcaagcacuugcuagauguuauagcauauguaaaaagugccucauacucuucaguguauacaaaauuguacucaacuggcccaacaucagggauaaauacuaaacaugacgaauuguguacuggcccaugcccagcaaauaucaaucaucagguuggguggcugacauuugcaagagagaggacaagcucauggggaugcgaagaguuugguugccuggcuguaagugaugggugcguauuugggucaugccaagauauaauaaaagaagaacuaucugucuauaggaaggagaccgaggaggugaccaauguugagcuauguuuaacauuuucagacaagacauauugcacaaacuuaaacccuguuaccccuauuauaacagaucuauuugagguacaguucaaaacuguagagaccuacagcuugcccagaauuguugcugugcaaaaccaugagauuaagauugggcaaauaaaugauuuaggaguuuacucuaaggguugugggaauguucaaaaggucaauggaacuauuuauggcaauggaguucccagauuugacuacuuaugccauuuagcuagcaggaaggaagucauuguuagaaaaugcuucgacaaugauuaccaagcaugcaaauuccuucaaagcccugcuaguuacagacuugaagaagacaguggcacugugaccauaauugacuacaaaaagauuuuaggaacaaucaagaugaaggcaauuuuaggagaugucaaauauaaaacauuugcugauagugucgauauaaccgcagaagggucaugcaccggcuguauuaacugcuucgaaaauauccauugcgaauuaacguugcacaccacaauugaagccagcugcccaauuaaaagcucgugcacaguauuucaugacaggauucuuguaaccccaaaugaacacaaauaugcauugaaaauggugugcacagaaaagccagggaacacacucacaauuaaagucugcaauacuaaaauugaagcaucuauggcccuugucgaugcaaagccuaucauagaacuagcaccaguugaucagacagcauauauaagagaaaaagaugaaagguguaaaacuuggauguguaggguaagagaugaagggcugcaggucaucuuggagccauuuaaaaauuuauuuggaucuuauauugggauauuuuacacauuuauuauaucuauaguagcauuauugguuauuaucuauguacuacuaccuauaugcuuuaaguuaagggauacccuuagaaagcaugaagaugcauauaagagagagaugaaaauuagauag

SEQ ID NO: 4267 - RNA, 4326 nt, Artificial Sequence
  derived and/or modified CDS sequence (wt) from LACV__KP271105.1__GP
augauucgcauacugguacugauugcaguuacagcugcaagcccaguguaucaaagguguuuccaagauggggcuauagugaagcaaaacccauccaaagaagcaguuacagaggugugccugaaagaugauguuagcaugaucaaaacagaggccagguacguaagaaaugcaacaggaguuuuuucaaacaauguugcaauaaggaaauggcuagucucugacuggcaugauugcagaccuaagaagaucauugggggacacaucaauguaauagaaguuggugaugaccugucacuccauacugaaucauauguuuguagcgcagauuguagcauagguguugacaaagagacugcacaggucaggcuucagacagauaccacaaaucacuuugaaauugcaggcacuacugugaagucagggugguuuaaaagcacgacguauauaacucuugaucaaaccugcgaacaccuuaaaguuuccugcggcccaaaaucuguacaguuccaugccugcuucaaucagcacaugucuugcgucagauuuuuacacaggacaauauugccuggcucuauagccaauucuauaugucagaauauugaaaucauaauuuuaguuacacuuacucuauuaaucuuuauauuguuaagcauuuuaaguaagacuuauauauguuauuuauuaaugccuauauuuaucccuauagcauacauguaugguauaauuuacaauaagucgugcaaaaaaugcaaacuaugcggccuaguguaucauccauucacagaguguggcacacauugcgucuguggugcucgcuaugauacuucagauagaaugaaacugcacagagcuucuggauugugcccugguuauaaaagccuaagagcugccagaguuaugugcaagucgaaagggccugcaucaauauugucuauaauuacugcaguacuggucuuaaccuuugugacaccaaucaauucuaugguuuuaggggagaguaaagaaacuuuugaacuugaagagcuuccagacgauauguuggaaauggcaucaagaauaaauucuuauuauuucaccuguaucuuaaauuaugcuguaagcuggggucuuguuaucauuggauuguugaccgggcugcuauuuaagaaauaucagcacagauuuuuaaauguuuacgcaauguacugugaggaaugugacauguaccaugacaagucuggguugaaaagacauggugauuucacuaacaaaugcaggcagugcacauguggucaguaugaagaugcugcagguuugauggcccacaggaaaaccuauaacugcuuagugcaguacaaagcaaaauggaugaugaauuuccugauaauuuauauauucuuaauuuuaaucaaagauucugcuauaguuguacaagcugcuggaacugauuucaccacuugccuagagacugagaguauaaauuggaacugcacagggccauucuugaaccucgggaauugucaaaagcaacaaaagaaagaaccuuacaccaacauugcaacccaguuaaagggacuaaaggcaauuuccguacuagauaucccuauaauaacagggauaccagaugauaucgcaggugcuuuaagauauauagaagagagggaagacuuccauguccagcuaacuauagaauaugcaaugcugaguaaauacugugacuauuauacccaauucucagacaacucaggauacagucaaacaacauggagaguguacuuaaggucucaugauuuugaggcauguauacuauauccaaaucagcauuuuugcagaugugugaaaaauggugagaagugcagcagcuccaauugggacuuugccaacgaaaugaaagauuauuacucagggaaacaaacaaaguuugauaaagacuuaaaucuagcccuaacagcuuugcaucaugcuuucagggggacuucaucugcauauauagcaacaaugcucucaaaaaaauccaacgaugacuugauugcauacacaaauaagauaaaagcaaaauucccagguaaugcauuguugaaggcuauaauagauuauauagcauauaugaaaagucugccagguauggcaaauuucaaauaugaugaauucugggaugaguuauuguacaaacccaacccagcaaaggcuucaaaccuugcuagaggaaaggagucuucuuacaacuucaaacuagcaauuucaucaaaaucuauaaaaaccugcaagaauguuaaggauguugccugcuuaucgccaaggucaggugcuauauaugcuucaauaauugcauguggugaacccaguggaccaaguguguauagaaaaccaucaggugguguauuccaaucuagcacugaucggucuauauacugcuuacuagauagccauugucuagaagaauuugaggcuauuaaccaggaggaacuggaugcaguaaaaaaaucaaaauguugggaaauugaauauucugaugugaagccccuccaagaaggugauggaacuaaaagcuguaaaaugaaagauucugggaacugcaauguugcaacuaacagauggccagugauacaaugcgagaaugacaaauuuuacuacucagagcuucaaaaagauuaugacaaaacucaagauauuggucauuauugcuuaaguccuggauguacuacuguucgguacccuauuaauccaaagcauaucucuaacuguaauuggcaggugagcagauccagcauagcgaagauagaugugcacaauauugaagauauugaacaguauaagaaggcuauaacucagaaacuucaaacaagcuuaucucuauucaaguaugcaaaaacaaagaauuugccgcacaucaagccaauuuacaaauauauaacuauagagggaacagaaacugcagaagguauagagagugcauacaucgaaucagagguaccugcauuggcugggacaucuaucggauucaaaaucaauucuaaagagggcaagcacuugcuagauguuauagcauauguaaaaagcgccucauacucuucaguguaugcaaaauuguacucaacuggcccaacaucagggauaaauacuaaacaugaugaauuguguacuggcccaugcccggcaaauaucaaucaucagguuggguggcuaacauuugcaaaagagaggacaagcucauggggaugcgaagaguuugguugccuggcuguaagugauggguguguauucgggucaugccaagauauaauaaaagaagaacuaucugucuauaggaaggagaccgaagaagugacugauguagaacuauguuuaacauuuucagacaaaacauacuguacaaacuuaaacccuguuaccccuauuauaacagaccuauuugagguacaguucaagacuguagagacuuacagcuugcccagaauuguugcugugcaaaaucaugagauuaagauugggcaaauaaaugaucuaggaguuuacucuaaggguuguggaaauguccaaaaggucaacggaacuguuuauggcaauggaguucccagauuugacuaucuaugccauuuagcuagcagaaaggaagucauuguuagaaaaugcuucgacaaugauuaccaagcaugcaaauuucuucagagcccugcuaguuacagacuugaagaagacaguggcacugugacuauaauugauuacaaaaagauauuaggcacaaucaagaugaaggcaauucuaggagaugucaaauauaaaacauuugcugauagugucgauauaacugcagaagggucaugcacuggcuguaucaacugcuucgagaauauccauugcgaauuaacguugcauacuacaauugaagccagcugcccaauuaaaagcucaugcacaguauuccaugauaggauucuugugacuccaaaugaacacaaauaugcauuaaaaauggugugcacagaaaagccggggaacacacucacaauuaaaguuugcaauacuaagauugaagcaucuauggcccuugucgaugcaaagccuaucauagaacuagcaccaguugaucagacagcauauauaagagaaaaagaugaaagguguaaaacuuggauguguaggguaagagaugaaggacugcaggucaucuuggagccauuuaaaaauuuguuugggucuuauauugggauauuuuacacauuuauuauaucuauaguggcauuauugguuauugucuaugugcuauugccuauaugcuuuaaguuaagagauacccuuagaaagcacgaagaugcauauaagagagagaugaaaauuagauag

SEQ ID NO: 4268 - RNA, 4326 nt, Artificial Sequence
  derived and/or modified CDS sequence (wt) from LACV(74-32813)__D10370.1__GP
augauucgcaugcuggugcugauuguaguuacggcugcaagcccaguguaucagagauguuuccaagauggggcuauagugaagcaaaacccauccaaagaggcagucacagaagugugccuaaaagaugauguuagcaugaucaaaacagaggccagguauguaaaaaaugcaacaggaguuuucucaaacaauguugcaauaaggaagugguuagucucugauuggcaugacugcagaccuaagaagaucguuggggggcacaucaauguaauagaaguuggugaugaccugucgcuucauacugaaucauauguuugcagugcagauuguaccauagguguagacaaggaaacagcacaggucagacuucaaacagauaccacaaaccauuuugaaauagcagguacuacugugaagucaggaugguucaaaagcacaacauauauaacucuagaucagaccugugaacaccucaaaguuuccugcgccccaaaaucuguacaguuccaugccugcuucaaucagcauauguccugugucagauucuuacacaggacaauauugccugguuccauagcuaauuccauaugucagaauauugaaaucauaauuuuaguuacacuuaccuuauuaaucuucauacuguuaagcauuuuaaguaagacuuauauauguuauuuguuaaugcccauauucauccccauagcauauauguacgguguaauuuacaauaagucaugcaaaaagugcaagcuaugcggccuaguguaucauccauucacagaguguggcacgcauugugucuguggugcucgcuaugauacuuccgauagaaugaaacuacacagagcuucuggauugugcccugguuauaaaagccuaagagcugccagagucaugugcaaaucaaaagggccugcaucaauauugucuauaauuacugcagugcugguucuaaccuuugugacaccaaucaacuccaugguuuuaggggaaaguaaggaaaccuuugaacuagaagagcuuccagacgacaugcuggaaauggcauuaaggauaaauucuuauuacuucaccuguaucuuaaauuaugcuguaagcuggggucuuauuauugcuggauuauugguuggacugauauuuaaaaaauaccagcauagguucuuaaauauuuaugcaauguacugugaagaauguaacauguaucaugacaaaucugggcugaagagacacggugacuucaccaacaaauguagacaaugcacauguggucaauaugaagaugcuacagguuugauaacucauaggaaaaccuauaacuguuuagugcaguacaaagcaaaguggaugaugaauuuccuaauaauuuacauauucuuaauuuugaucaaagauucugccauaguuggacaagcuacugggacagauuucaccaccugccuagagacugagaguauaaauuggaacugcacugggccauuccuaaaccuuggaaacugccaaaagcaacaaaagaaagaaccuuacacaaauauugcaacccagcuaaaagggcuaaaagcaauuuccguacuagauaucccuauaauuacgaguaucccagacgacauugcaggugcuuuaagauauauagaggaaaaggaagauuuccauguccaacuaacuacagaauaugcaaugcugaguaaguacugugacuauuauacccaguucucagauaacucaggauauagucaaacaacauggagaguauacuugagaucucaugauuuugaggcaugcauacuauauccaaaucagcauuucugcaagugugugaaaaauggugaaaaguguagcagcuccaauugggacuuugccaauggaaugaagaauuauuacucugggaaacaagcaaaauuugauaaagauuuaaaccuagcucuaacagcuuugcaucaugccuucagagggaccucaucugcauauauagcagcaaugcucucaaagaaguccaaugaugauuugauugcauauacaaauaagauaaaagcaaaauuuccagguaaugcacuauugaaggcuauaauagauuauauagcauacaugaaagguuugccagaaauggcaaauuucaaauaugacgaguucugggaugaauuauuguacaaaccuaacccagcaaaagccucaaaucuugcuaggggaaaagagucauccuacaacuucaaguuagcaauuucgucaaaaucuauaaaaaccuguaagaauguuaaggauguugccugcuuaucaccaaggucaggugcuauauacucuucaauaauugcaugcggugaacccaacgggccaaguguguauagaaaaccaucaggugguguauuucaauccaguacugaccggucuauauauuguuugcuagacagccauugucuagaggaguuugaggcuaucagucaagaggaacuggaugcaguaaaaaaauccaaguguugggagauugaauauccugacguaagaccccuccaagaaagugacggggcuaaaagcuguagaaugaaagauucugggaauuguaauguugcaacuaacagauggccaguaaugcaaugcgagaaugacaaauuuuauuauucagaacuucaaaaagauuaugacaaaacucaagauauuggucauuauugcuuaagcccuggauguaccacuauccgguacccuauuaauccaaagcauaucucuaauuguaauuggcagguaagcagauccagcauagcaaagauagacguacauaauguugaagauauugaacaauauaaaaaggcuauaacccaaaagcuucaaacaagcuugucucuauucaaguaugcaaaaacaaaaaacuugccgcacauuagaccaauuuauaaauacauaacuaugaaggaaacagaaacugcagaagggauagagagcgcauauauugaaucagaagugccugcauuggcugggacaucuguuggguucaaaauuaauucuaaagagggcaaacacuugcuagauguuauagcauauguaaaaagugcaucguacucuucaguauaugcgaaauuauacucaacuggcccaacaucaggaauaaauacuaaacaugaugaauuguguacuggcccaugcccagcaaauaucaaucaucaaguuggguggcucacauuugcaagagagaggacaaguucauggggaugcgaagaguuugguugccuggcuguaagugaugggugcguguucgggucaugccaagacauaauaaaagaagaacuaucugucuauaggaaggagaccgaagaagugaccaauguugagcuauguuuaacauuuucagacaagacauauugcacaaacuuaaacccuguuaccccuauuauaacagaucuauuugagguacaguuuaaaacuguagagacuuacagcuugcccagaauuguugccgugcaaaaccaugagauuaagauugggcaaauaaaugaucuagggguuuacucuaagggaugugggaauguucaaaagguuaauggaacuguuuauggcaaugggguccccagauuugauuacuuaugucacuuagcuaguagaaaggaagucaucguuagaaaaugcuuugauaaugauuaccaagcaugcaaauuccuucaaagcccugcuaguuauagacuugaagaagacagcgguacugugacuauaauugauuauaagaaaauauuaggcacaaucaagaugaaggcaauuuuaggagaugucaaauacaaaacauuugcugacaguguugauauaacugcagaagggucgugugcuggcuguaucaauugcuuucagaauauucauugcgaauuaacgcugcauaccacaauugaagccagcugcccaauuaaaaguucuugcacaguauuccaugauaggauucuuguaaccccaaaugaacacaaauaugcauuaaaaauuguaugcacagaaaagccagggaauacacucaccauuaaagucugcaauacuagaauugaagcuucaauggcccuuguugaugcaaagccuaucauagaauuagcaccaguugaucagacggcauauauaagagaaaaagaugaaagaugcaaaacuuggauguguaggguaagggaugaagggcugcagguuaucuuagagccauuuaaaaacuuguuuggaucuuauauugggauauuuuacacauuuauuauaucuauaauagcauuguugguuaucaucuauguacuacugccuauaugcuucaaauuaagggauacccuuagaaagcacgaugaugcauauaagagagagaugaaaauuagauaa

SEQ ID NO: 4269 - RNA, 4326 nt, Artificial Sequence
  derived and/or modified CDS sequence (wt) from LACV(Craig County/VA/2009)__KP226848.1__GP
augauucgcauacuggugcugauugcaguuacagcugcaagcccaguguaucaaagguguuuccaagauggggcuauagugaagcaaaacccauccaaagaagcaguuacagaggugugccugaaagaugauguuagcaugaucaaaacugaggccagguauguaagaaaugcaacaggaguuuuuucgaacaauguugcaauaaggaaauggcuagucucugauuggcaugauugcaggccuaagaagaucauugggggacacaucaauguaauagaaguuggugaugaccugucacuccauacugaaucauauguuuguagcgcagauuguaccauagguguagacaaagagacugcacaggucaggcuccaaacagauaccacaaaucauuuugaaauugcaggcacuacugugaagucaggaugguucaaaagcacgacauauauaacucuugaucaaaccugcgaacaccuuaaaguuuccugcggcccaaaaucuguacaguuccaugccugcuucaaucagcauaugucuugcgucagauuuuuacacaggacaauauugccuggcuccauagccaauuccauaugucagaauauugaaaucauaauuuuaguuacacuuacucuauuaaucuuuauauuguuaagcauuuuaaguaaaacuuauauauguuauuuauuaaugccuguauucauccccauagcauguauauacgguauaauuuacaauaagucgugcaaaaaaugcaaacuauguggccuaguauaucacccauucacagaguguggcacacacugugucuguggcgcucgcuaugauacuucagauagaaugaaacugcacagagcuucuggauugugcccugguuauaaaagccuaagagcugccagagucaugugcaagucaaaagggccugcaucaauauugucuauaauuacugcaguacuggucuuaaccuuugugacaccaaucaacuccaugguuuuaggggagaguaaagagacuuuugaacuugaagagcuuccagacgacauguuagaaauggcaucgagaauaaauucuuauuauuucaccuguaucuuaaauuaugcuguaagcuggggucuuguuaucauuggauuguugaucgggcugcuauuuaagaaauaucagcacagauuuuuaaauauuuaugcaauguacugugaggaaugugacauguaucaugacaagucuggauugaaaaggcauggugauuucaccaacaaaugcaggcagugcacauguggucaguaugaagaugccgcagguuugauggcccacaggaaaaccuauaacugcuuagugcaguacaaagcaaaauggauaaugaauuucuugauaauuuacauauucuuaauuuuaaucaaagauucugcuauaguuguacaagcugcugggaccgauuucaccacuugccuagagacugagaguauaaauuggaacugcacugggccauuuuuaaaccucgggaauugucaaaagcaacaaaagaaagaaccuuacacuaacauugcaacccaguuaaaaggacuaaaggcaaucuccguacuagauaucccuauaauaacagggauaccagaugauauugcaggugcuuuaagauauauagaagagagggaagauuuccauguccagcuaacuauagaauacgcgaugcugaguaaauacugugacuauuauacccaauucucagacaacucaggauacagucagacaacauggagaguguacuuaaggucucaugauuuugaggcauguauacuauauccaaaucagcauuuuuguagaugugugaaaaauggugagaagugcagcagcuccaauugggacuuugccaauggaaugaaagauuauuacucugggaaacaagcaaaguuugauaaagacuuaaaucuagcccuaacagcuuugcaucaugccuucagggggaccucaucugcauauauagcaacaaugcucucaaaaaaguccaaugaugacuugauuacauacacaaauaagauaaaaacaaaauucccagguaaugcauuguugaaggcuauaauagauuauauagcauauaugaaaaguuugccagguauggcaaauuucaaauaugaugaauucugggaugaauuauuguacaaacccaacccagcaaaggccucaaaccuugcuagaggaaaggagucaucuuacaacuucaaacuagcaauuucaucaaaaucuauaaaaaccugcaagaauguuaaggauguugccugcuugucgccaaggucaggugcuauauaugcuucaauaauugcguguggugaacccaaugggccaaguguguauagaaaaccaucaggugguguauuccaaucuagcacugaucggucuauauacugcuuacuagauagccauugucuagaagaauuugaggcuaucagccaggaggagcuggaugcaguaaaaaaauccaaauguugggaaauugaauauccagacguaaaaccccuccaagaaagugaugggacuaaaagcuguagaaugaaagauucugggaacugcaauguugcaacuaacagauggccaauuauacaaugcgagaaugacaaauuuuacuacucagagcuucagaaagauuaugacaaaacucaagauauuggucauuauugcuuaagcccuggauguacuacuguucgguacccuauuaacccaaagcauaucucuaacuguaauuggcagguaagcagauccagcauagcgaagauagaugugcacaauauugaagauauugaacaauauaagaaggcuauaacucaaaaacuucaaacaagccuaucuuuauuuaaguaugcaaaaacaaaaaacuugccgcacaucaaaccaauuuauaaauauauaacuauagaaggaacagaaacugcagaagguauagagagugcauacauugaaucagagguaccugcauuagcuggggcaucuaucggauucaaaaucaauucuaaagagggcaagcacuugcuagauguuauagcauauguaaaaagcgccucauacucuucaguuuaugcaaaauuguacucaacuggcccaacaucagggauaaauacuaaacaugaugaauuguguacuggcccaugcccagcaaauaucaaucaucaaguuggguggcuaacauuugcaagagagaggacaagcucauggggaugcgaagaguuugguugccuggcuguaagugauggguguguauucggaucaugccaagauauaauaaaagaagaacuaucugucuauagaaaggagaccgaagaagugacugauguagaacuauguuuaacauuuucagacaaaacauacuguacaaacuuaaacccuguuaccccuauuauaacagaucuauuugaggugcaauucaaaacuguagagacuuacagcuugcccagaauuguugcuguacaaaaccaugagauuaagauugggcagauaaaugaucuaggaguuuacucuaaagguuguggaaauguucaaaaggucaauggaacuguuuauggcaauggaguuccuagauuugacuacuuaugccacuuagcuagcagaaaggaagucauuguuagaaagugcuucgacaaugacuaccaagcaugcaaauuucuucaaagccccgccaguuacagacuugaagaagacaguggcacugugacuauaauugauuacaaaaagauauuaggcacaaucaagaugaaggcaauuuuaggagaugucaaguauaaaacguuugcugauagugucgauauaacugcagaagggucauguacugguuguaucaacugcuucgagaauauccauugcgaauuaacauugcauaccacaauugaagccagcugcccaauuaaaagcucgugcacaguauuccacgacaggauucuugugacuccaaaugaacacaaauaugcauuaaaaauggugugcacagaaaagccagggaacacacucacaauuaaaguuugcaauacuaagauugaagcaucuauggcccucgucgacgcaaagccuaucauagaacuagcaccaguugaucagacagcauauauaagagaaaaagaugaaagauguaaaacuuggauguguaggguaagagaugaaggacugcagguuaucuuggagccauuuaaaaauuuauuuggaucuuauauugggauauuuuacacauuuauuauaucuauaguggcaauauugguuaucaucuauguacuauugccuauaugcuuuaaguuaagagauacucuuagaaagcaugaagaugcauauaagagagagaugaaaauuagauaa

SEQ ID NO: 4270 - RNA, 4326 nt, Artificial Sequence
  derived and/or modified CDS sequence (wt) from LACV(Dallas/TX/2009)__GU591165.1__GP
augauucgcauacuagugcugauuguaguuacggcugcaagcccgguguaucagagauguuuccaagauggggcuauagugaagcaaaacccauccaaagaggcagucacagaggugugccuaaaagaugauguuagcaugaucaaaacagaggccagguauguaaaaaaugcaacaggaguuuucucaaacaauguugcaauaaggaagugguuagucucugauuggcaugacugcagaccuaagaagaucguuggggggcacaucaauguaauagaaguuggugaugaccugucgcuccauaccgaaucauauguuugcagugcagauuguaccauagguguagacaaggaaacagcacaggucagacuucaaacagauacuacaaaccauuuugaaauagcagguacuacugugaagucaggaugguucaaaagcacgacauauauaacucuagaucagaccugugaacaccucaaaguuuccugcggcccaaaaucuguacaguuccaugccugcuucaaucagcauaugucuugugucagauucuuacacaggacaauauugccugguuccauagcuaauuccauaugucagaauauugaaaucauaauuuuaguuacacuuaccuuauuaaucuucauacuguuaagcauuuuaaguaagacuuauauauguuauuuguuaaugcccauauucauccccauggcauauauguacgguguaauuuacaauaagucaugcaaaaagugcaagcuauguggccuaguguaucauccauucacagaguguggcacacauugugucuguggugcucgcuaugauacuuccgauagaaugaaacugcacagagcuucuggauugugcccugguuauaaaagccuaagagcugccagagucaugugcaaaucaaaagggccugcaucaauauugucuauaauuacugcagugcugguucugacauuugugacaccaaucaacucuaugguuuuaggggaaaguaaggaaaccuuugaacuugaagagcuuccagacgacaugcuggaaauggcauuaaggauaaauucuuacuacuucaccuguaucuuaaauuaugcuguaagcuggggucuuauuauugcuggauuauugguuggacugauauuuaaaaaguaccagcauagguucuuaaauauuuacgcaauguacugugaagaaugugacauguaucaugacaaaucugggcugaagagacauggugacuucaccagcaaauguagacaaugcacauguggucaauaugaagaugcuacagguuugauaacucacaggaaaaccuauaacugcuuagugcaguacaaagcaaaguggaugaugaauuuccuaauaauuuacauauucuuaauuuugaucaaagauucugccauaguuguacaagcuacugggacagauuucaccaccugccuagagacugagaguauaaauuggaacugcacugggccauuccuaaaccuuggaaacugccaaaagcaacaaaagaaagaaccuuacacaaauauugcaacccagcuaaaagggcuaaaagcaauuuccguacuagauaucccuauaauuacggguaucccagacgacauugcaggugcuuuaagauauauagaggagaaggaagauuuccauguccaacuaacuacagaauaugcaaugcugaguaaguacugugacuauuauacccaguucucagauaacucaggauauagucaaacaacauggagaguauacuugagaucucaugauuuugaggcaugcauacuauauccaaaucagcauuucugcaggugugugaaaaauggugagaaguguagcagcucuaauugggacuuugccaaugaaaugaagaauuauuacucugggaaacaagcaaaauuugauaaagauuuaaaccuagcucuaacagcuuugcaucaugccuucagagggaccucaucugcauauauagcaacaaugcucucaaagaaguccaaugaugauuugguugcauauacaaauaagauaaaagcaaaauucccagguaaugcauuauugaaggcuauaauagauuauauagcauacaugaaagguuugccagauauggcaaauuucaaauaugaugaguucugggaugaauuauuguacaaaccuaacccagcaaaagccucaaaucuugcuagaggaaaagagucauccuacaacuucaaguuggcaguuucgucaaaaucuauaagaaccuguaagaauguuaaggauguugccugcuuaucaccaaggucaggugcuauauacucuucaauaauugcaugcggugaacccaacgggccaaguguguauagaaaaccaucaggugguguauuucaauccaguacugaccggucuauauauuguuugcuagacagccauugucuagaggaguuugaggcuaucagucaagaggaguuggaugcaguaaaaaaauccaaguguugggagauugaauauccugacauaagaccccuccaagaaagugacgggucuaaaagcuguagaaugaaagauucugggaacuguaauguugcaacuaacagauggccaguaaugcaaugcgagaaugacaaauuuuauuacucagaacuucaaaaagauuaugacaaaacucaagauauuggucacuauugcuuaagcccuggauguaccacuauccgguacccuauuaauccaaagcauaucucuaauuguaauuggcagguaagcagauccagcauagcaaagauagacguacauaauguugaagauauugaacaauauaaaaaggcuauaacccaaaagcuucaaacaagccuaucucuauucaaguaugcaaaaacaaaaaaccugccacacauuaagccaauuuauaaauacauaacuauagaaggaacagaaacugcagaagggauagagagcgcauauauugaaucagaggugccugcauuggcugggacaucuauuggguucaaaauuaauucuaaagagggcaaacacuugcuagauguuauagcauauguaaaaagugcaucguauucuucaguauaugcgaaauuauacucaacuggcccaacaucaggaauaaauacuaaacaugaugaauugugcacuggcccaugcccagcaaauaucaaucaucaaguuggguggcuaacauuugcgagagagaggacaaguucauggggaugcgaagaguuugguugccuggcuguaagugaugggugcguguucgggucaugccaagacauaauaaaagaagaacuaucugucuauaggaaggauacugaagaagugaccaauguggagcuaugucuaacauuuucagacaagacauauugcacaaacuuaaacccuguuaccccuauuauaacagaucuauuugagguacaguuuaaaacuguagagacuuacagcuugcccagaauuguugcugugcaaaaccaugagauuaagauugggcaaauaaacgaucuagggguuuacucuaagggcugugggaauguucaaaagguuaauggaacuguuuauggcaaugggguccccagauuugauuacuuaugucauuuagcuaguagaaaggaagucaucguuagaaaaugcuuugauaaugauuaccaagcaugcaaauuccuucaaagcccugcuaguuauagacuugaagaagacagcgguacuguaacuauaauugauuauaagaagauauuaggcacaaucaagaugaaggcaauuuuaggagaugucaaauacaaaacauuugcugacaguguugauauaacugcagaagggucgugugcuggcuguaucaauugcuuugagaauauucauugugaauuaacacugcauaccacaauugaagccagcugcccaauuaaaaguucuugcacaguauuccaugauaggauucuuguaaccccaaaugaacacaaauaugcauuaaaaaugguaugcacagaaaagccagggaauacacucaccauuaaagucugcaauacuagaauugaaguuucaauggcccuuguugaugcaaagccuaucauagaacuagcaccaguugaucagacggcauauauaagagaaaaagaugaaagaugcaaaacuuggauguguagggugagggaugaagggcugcaggucaucuuggagccauuuaaaaauuuauuuggaucuuauauuggaauauuuuacacauuuauuauaucuauaauagcauuauugguuaucaucuauguacuacugccuauaugcuucaaauuaagggauacccuuagaaagcacgaugaugcauauaagagagagaugaaaauuagauaa

SEQ ID NO: 4271 - RNA, 4326 nt, Artificial Sequence
  derived and/or modified CDS sequence (wt) from LACV(Fort Bend County/TX/2009)__GU591168.1__GP
augauucgcaugcuggugcugauuguaguuacggcugcaagcccaguguaucagagauguuuccaagauggggcuauagugaagcaaaacccauccaaagaggcagucacagaggugugccuaaaagaugauguuagcaugaucaaaacagaggccagguauguaaaaaaugcaacaggaguuuucucaaacaauguugcaauaaggaagugguuagucucugauuggcaugacugcagaccuaagaagaucguuggggggcacaucaauguaauagaaguuggugaugaccugucgcuccauaccgaaucauauguuuguagugcagauuguaccauagguguagacaaggaaacagcacaggucagacuucaaacagauaccacaaaccauuuugaaauagcagguacuacugugaagucaggaugguucaaaagcacgacauauauaacucuagaucagaccugugaacaccucaaaguuuccugcggcccaaaaucaguacaguuccaugccugcuucaaucagcauauguccugugucagauucuuacacaggacaauauuaccugguuccauagcuaauucuauaugucagaacauugaaaucauaauuuuaguuacacuuacccuauuaaucuucauacuguuaagcauuuuaaguaggacuuauauauguuauuuguuaaugcccauauucaucccuauagcauauauguacgguguaauuuacaauaagucaugcaaaaagugcaagcuauguggccuaguguaucauccauucacagagugugguacacauugugucuguggugcucgcuaugauacuuccgauagaaugaaacugcacagagcuucuggauugugcccugguuauaagagccuaagagcugccagagucaugugcaaaucaaaagggccugcaucaauauugucuauaauuacugcagugcugguucuaaccuuugugacaccaaucaacuccaugguuuuaggggaaaguaaggaaaccuuugaacuugaagagcuuccagacgacaugcuggaaauggcauuaaggauaaauucuuauuauuucaccuguaucuuaaauuaugcuguaagcuggggucuuauuauugcuggauuauugguuggacugauauuuaaaaaguaccagcauagguucuuaaauauuuacgcaauguacugugaagaaugugacauguaucaugacaaaucugggcugaagagacauggugacuucaccaacaaauguagacaaugcacauguggucaauaugaagaugcugcagguuugauggcucauaggaaaaccuauaacugcuuagugcaguacaaagcaaaguggaugaugaauuuccuaauaauuuacauauucuuaauuuugaucaaagauucugccauaguuguacaagcuacugggacagauuucaccacuugccuagagacugagaguauaaauuggaacugcacugggccauuccuaaaccuuggaaacugccaaaagcaacaaaagaaagagccuuacacaaauauugcaacccaacuaaaagggcuaaaagcaauuuccguacuagauaucccuauaauuacggguaucccagacgacauugcaggcgcuuuaagauauauagaggagaaggaagauuuccauauccaacuaacuacagaauaugcaaugcuaaguaaguacugugacuauuauacccaguucucagauaacucaggauauagucaaacaacauggagaguauacuugagaucucaugauuuugaggcaugcauacuauauccaaaucagcauuucugcaggugugugaaaaauggugagaaguguagcagcuccaauugggacuuugccaaugaaaugaagaauuauuacucuggaaaacaagcaaaauuugauaaagauuuaaaccuagcucuaacagcuuugcaucaugccuucagagggaccucaucugcauauauagcaacaaugcucucaaagaaguccaaugaugauuugaucgcauauacaaauaaaauaaaagcaaaauucccagguaaugcauuauugaaggcuauaauagauuauauagcauacaugaaagguuugccagauauggcaaauuucaaauaugaugaguucugggaugaauuauuguacaaaccuaacccagcaaaagccucaaaucuugcuagaggaaaagaaucauccuacaacuucaaguuagcaauuucgucaaaaucuauaaaaaccuguaagaauguuaaggauguugccugcuuaucaccaaggucaggugcuauauacucuucaauaauugcauguggugaacccaacgggccaaguguguauagaaaaccaucaggugguguauuucaauccaguacugaccggucuauauauuguuugcuagacagucauuguuuagaggaguuugaggcuaucagucaagaggaguuggaugcaguaaaaaaauccaaguguugggagauugaauauccugacguaagaccccuccaagaaagugacggggcuaaaagcuguagaaugaaagauucugggaacuguaauguugcaacuaacagauggccaguaaugcaaugcgagaaugacaaauuuuauuacucagaacuucaaaaagauuaugacaaaacucaagauauuggucauuauugcuuaagcccuggauguaccacuauccgguacccuauuaauccaaagcauaucucuaauuguaauuggcagguaagcagauccagcauagcaaagauagauguacauaauguugaagauauugaacaauauaaaaaggcuauaacccaaaagcuucaaacaagccuaucucuauucaaguaugcaaaaacaaaaaaccugccacacaucaagccaauuuauaaauacauaacuauagaaggaacagaaacugcagaagggauagagagcgcauauauugaaucagaggugccugcauuggcugggacaucuauuggguucaaaauuaauucuaaagagggcaaacacuugcuagauguuauagcauacguaaaaagugcuucguacucuucaguauaugcgaaauuauacucaacuggcccaacaucaggaauaaauacuaaacaugaugaauuguguacuggcccaugcccagcaaauaucaaucaucaaguuggguggcuaacauuugcgagagagaggacaaguucauggggaugcgaagaguuugguugccuggcuguaagugaugggugcguguucgggucaugccaagacauaauaaaagaagaacuaucugucuauagaaaagagaccgaagaagugaccaauguggagcuaugucuaacauuuucagacaagacauauugcacaagcuuaaacccuguuaccccuauuauaacagaucuauuugagguacaguuuaaaacuguagagacuuacagcuugcccagaauuguugcugugcaaaaucaugagauuaagauugggcaaauaaaugaucuagggguuuacucuaagggcugugggaauguucaaaagguuaauggaacuguuuauggcaaugggguccccagauuugauuacuuaugucauuuagcuaguagaaaagaagucaucguuagaaaaugcuuugauaaugauuaccaagcaugcaaauuccuucaaagcccugcuaguuauagacuugaagaagacagcgguacuguaacuauaauugauuauaagaagauauuaggcacaaucaagaugaaggcaauuuuaggagaugucaaauacaaaacauuugcugacaguguugauauaacugcagaagggucgugugccggcuguaucaauugcuuugagaauauucauugugaauuaacgcugcauaccacaauugaagccagcugcccaauuaaaaguucuugcacaguauuccaugauaggauucuuguaaccccaaaugaacacaaauaugcauuaaaaaugguaugcacagaaaagccagggaauacacucaccauuaaagucugcaauacuagaauugaagcuucaauggcccuuguugaugcaaagccuaucauagaacuagcaccaguugaucagacggcauauauaagagaaaaagaugaaagaugcaaaacuuggauguguagggugagggaugaagggcugcagguuaucuuagagccauuuaaaaacuuguuuggaucuuauauugggauauuuuacacauuuauuauaucuauaauagcauuauugguuaucaucuauguacuacugccuauaugcuucaaauuaagggauacccuuagaaagcacgaugaugcauauaagagagagaugaaaauuagauaa

SEQ ID NO: 4272 - RNA, 4326 nt, Artificial Sequence
  derived and/or modified CDS sequence (wt) from LACV(LAC22988-89)__U18980.1__GP
augauuuguauauuggugcuaauuacaguugcagcugcaagcccaguguaucaaagguguuuccaagauggggcuauagugaagcaaaacccauccaaagaagcaguuacagaggugugccugaaagaugauguuagcaugaucaaaacagaggccagguauguaagaaaugcaacaggaguuuuuucaaauaaugucgcaauaaggaaauggcuagucucugauuggcaugauugcaggccuaagaagaucguugggggacacaucaauguaauagaaguuggugaugaccugucacuccauacugaaucauauguuugcagcgcagauuguaccauagguguagacaaagagacugcacaggucaggcuucagacagauaccacaaaucauuuugaaauugcaggcacuacugugaagucaggaugguucaagagcacgacauauauaacucuugaucaaacuugcgaacaccuuaaaguuuccugcggcccaaaaucuguacaguuccaugccugcuucaaucagcauaugucuugcgucagauuuuuacacaggacaauauugccuggcucuauagccaauuccauaugucagaauaucgaaaucauaauuuuaguuacacuuacucuauuaaucuuuauauuguuaagcauuuuaaguaagacuuauauauguuauuuauuaaugccuauauucauccccauagcauauauauacgguauaauuuacaauaagucgugcaaaaaaugcaaauuauguggcuuaguguaucauccauucacagaguguggcacacauugugucuguggugcccgcuaugauacuucagauagaaugaaacugcauagagcuucuggauugugcccugguuauaaaagccuaagagcugccagagucaugugcaagucgaaagggccugcaucaauauugucuauaauuacugcgguacuggucuuaaccuuugugacaccaaucaacuccaugguuuuaggagagaguaaagaaaccuuugaacuugaagaucuuccagacgacauguuggaaauggcaucgagaauaaauucuuauuaucucaccuguaucuugaauuaugcuguaagcuggggucuuguuaucauuggauuguugaucgggcugcuuuuuaagaaauaccagcacagauucuuaaauguuuacgcaauguacugugaagaaugugacauguaucaugacaagucuggguugaaaagacauggugauuucaccaacaaaugcagacagugcacauguggucaauaugaagaugcugcagguuugauggcucacaggaaaaccuauaacugcuuagugcaguacaaagcaaaguggaugaugaacuuccugauaauuuacauauucuuaauuuugaucaaagauucugcuauaguuguacaagcugcuggaacugacuucaccaccugccuagagacugagaguauaaauuggaacugcacugggccauuuuugaaccucgggaauugccaaaagcaacaaaagaaagaaccuuacaccaacauugcaacucaguuaaagggacuaaaggcaauuuccguacuagaugucccuauaauaacagggauaccagaugauauugcaggugcuuuaagauauauagaagagaaggaagauuuccauguccagcuaacuauagaauaugcgauguuaaguaaauacugugacuauuauacccaauucucagauaacucaggauacagucagacaacauggagaguguacuuaaggucucauaauuuugaagccuguauacuauauccaaaucagcacuuuugcagauguguaaaaaauggugagaagugcagcagcuccaauugggacuuugccaaugaaaugaaagauuauuacucugggaaacaaacaaaguuugacaaggacuuaaaucuagcccuaacagcuuugcaucaugccuucagggggaccucaucugcauauauagcaacaaugcucucaaaaaaguccaaugaugacuugauugcauacacaaauaagauaaaaacaaaauucccagguaaugcauuguugaaggcuauaauagauuauauagcauauaugaaaaguuugccagguauggcaaauuucaaauaugaugaauucugggaugaauuacuguacaaacccaacccagcaaaggccucaaaccuugcuagaggaaaggagucaucuuacaacuucaaacuagcaauuucaucaaagucuauaaaaaucugcaagaauguuaaggauguugccugcuuaucgccaaggucaggugcuauauaugcuucaauaauugcguguggugaacccaaugggccaaguguguauaggaaaccaucaggugguguauuccaaucuagcacugaucggucuauauacugcuugcuggauagccauugucuagaagaauuugaggccaucggccaggaggagcuggaugcgguaaagaaauccaaauguugggaaauugaauauccugacguaaagcucauccaagaaggcgaugggacuaaaagcuguagaaugaaagauucugggaacugcaauguugcaacuaacagauggccagugauacaaugugagaaugacaaauuuuacuacucagagcuucaaaaagauuaugacaaagcucaagauauuggucacuauugcuuaagcccuggauguacuacuguccgguacccuauuaauccaaagcacaucucuaacuguaauuggcaaguaagcagaucuagcauagcgaagauagaugugcacaauauugaggauauugagcaauauaagaaagcuauaacucagaaacuucaaacgagccuaucucuauucaaguaugcaaaaacaaaaaacuugccgcacaucaaaccaauuuauaaauauauaacuauagaaggaacagaaacugcagaagguauagagagugcauacauugaaucagaaguaccugcauuggcugggacaucuaucggauucaaaaucaauucuaaagagggcaagcacuugcuagauguuauagcauauguaaaaagugccucauacucuucaguguauacaaaauuguacucaacuggcccaacaucagggauaaauacuaaacaugaugaauuguguacuggcccaugcccagcaaauaucaaucaucagguuggguggcugacauuugcaagagagaggacaagcucauggggaugcgaagaguuugguugccuggcuguaagugauggguguguauuuggaucaugccaagauauaauaaaagaagaacuaucugucuauaggaaggagaccgaggaagugacugauguagaacuguguuugacauuuucagacaaaacauacuguacaaacuuaaacccuguuaccccuauuauaacagaucuauuugagguacaguucaaaacuguagagaccuacagcuugccuagaauuguugcugugcaaaaccaugagauuaaaauugggcaaauaaaugauuuaggaguuuacucuaaggguugugggaauguucaaaaggucaauggaacuauuuauggcaauggaguucccagauuugacuacuuaugccauuuagcuagcaggaaggaagucauuguuagaaaaugcuucgacaaugauuaccaagcaugcaaauuucuucaaagcccugcuaguuacagacuugaagaagacaguggcacugugaccauaauugacuacaaaaagauuuuaggaacaaucaagaugaaggcaauuuuaggagaugucaaauauaaaacauuugcugauagugucgauauaaccgcagaagggucaugcaccggcuguauuaacugcuucgaaaauauccauugcgaauuaacgcugcacaccacaauugaagccagcugcccaauuaaaagcucgugcacaguauuucaugacaggauucuugugacuccaaaugaacacaaauaugcauugaaaauggugugcacagaaaagccagggaacacacucacaauuaaagucugcaauacuaaaguugaagcaucuauggcccuuguagacgcaaagccuaucauagaacuagcaccaguugaucagacagcauauauaagagaaaaagaugaaagguguaaaacuuggauguguaggguaagagaugaaggacugcaggucaucuuggagccauuuaaaaauuuauuuggaucuuauauugggauauuuuacacauuuauuauaucuauaguaguauuauugguuauuaucuauguacuacuaccuauaugcuuuaaguuaagggauacccuuagaaagcaugaagaugcauauaagagagagaugaaaauuagauag

SEQ ID NO: 4273 - RNA, 4326 nt, Artificial Sequence
  derived and/or modified CDS sequence (wt) from LACV(LAC30928-31)__U18979.1__GP
augauuuguauauuggugcuaauuacaguugcagcugcaagcccaguguaucaaagguguuuccaagauggggcuauagugaagcaaaacccauccaaagaagcaguuacagaggugugccugaaagaugauguuagcaugaucaaaacagaggccagguauguaagaaaugcaacaggaguuuuuucaaauaaugucgcaauaaggaaauggcuagucucugauuggcaugauugcaggccuaagaagaucguugggggacacaucaauguaauagaaguuggugaugaccugucacuccauacugaaucauauguuugcagcgcagauuguaccauagguguagacaaagagacugcacaggucaggcuucagacagauaccacaaaucauuuugaaauugcaggcacuacugugaagucaggaugguucaagagcacgacauauauaacucuugaucaaacuugcgaacaccuuaaaguuuccugcggcccaaaaucuguacaguuccaugccugcuucaaucagcauaugucuugcgucagauuuuuacacaggacaauauugccuggcucuauagccaauuccauaugucagaauaucgaaaucauaauuuuaguuacacuuacucuauuaaucuuuauauuguuaagcauuuuaaguaagacuuauauauguuauuuauuaaugccuauauucauccccauagcauauauauacgguacaauuuacaauaagucgugcaaaaaaugcaaauuauguggcuuaguguaucacccauucacagaguguggcacacauugugucuguggugcccgcuaugauacuucagauagaaugaaacugcauagagcuucuggauugugcccugguuauaaaagccuaagagcugccagagucaugugcaagucgaaagggccugcaucaauauugucuauaauuacugcgguacuggucuuaaccuuugugacaccaaucaacuccaugguuuuaggagagaguaaagaaaccuuugaacuugaagaucuuccagacgacauguuggaaauggcaucgagaauaaauucuuauuaucuuaccuguaucuugaauuaugcuguaagcuggggucuuguuaucauuggauuguugaucgggcugcuuuuuaagaaauaccagcacagauucuuaaauguuuacgcaauguacugugaagaaugugacauguaucaugacaagucuggguugaaaagacauggugauuucaccaacaaaugcagacagugcacauguggucaauaugaagaugcugcagguuugauggcucacaggaaaaccuauaacugcuuagugcaguacaaagcaaaguggaugaugaacuuccugauaauuuacauauucuuaauuuugaucaaagauucugcuauaguuguacaagcugcuggaacugacuucaccaccugccuagagacugagaguauaaauuggaacugcacugggccauuuuugaaccucgggaauugccaaaagcaacaaaagaaagaaccuuacaccaacauugcaacucaguuaaagggacuaaaggcaauuuccguacuagaugucccuauaauaacagggauaccagaugauauugcgggugcuuuaagauauauagaagagaaggaagauuuccauguccagcuaacuauagaauaugcgauguuaaguaaauacugugacuauuauacccaauucucagauaacucaggauacagucagacaacauggagaguguacuuaaggucucaugauuuugaagccuguauacuauauccaaaucagcacuuuugcagauguguaaaaaauggugagaagugcagcagcuccaaucgggacuuugccaaugaaaugaaagauuauuacucugggaaacaaacaaaguuugacaaggauuuaaaucuagcccuaacagcuuugcaucaugccuucagggggaccucaucugcauauauagcaacaaugcucucaaaaaaguccaaugaugacuugauugcauacacaaauaagauaaaaacaaaauucccagguaaugcauuguugaaggcuauaauagauuauauagcauauaugaaaaguuugccagguauggcaaauuucaaauaugaugaauucugggaugaauuauuguacaaacccaacccagcaaaggccucaaaccuugcuagaggaaaggagucaucuuacaacuucaaacuagcaauuucaucaaagucuauaaagaucugcaagaauguuaaggauguugccugcuuaucgccaaggucaggugcuauauaugcuucaauaauugcguguggugaacccaaugggccaaguguguauaggaaaccaucaggugguguauuccaaucuagcacugauccgucuauauacugcuugcuggauagccauugucuagaagaauuugaggccaucggccaggaggagcuggaugcgguaaagaaauccaaauguugggaaauugaauauccugacguaaagcucauccaagaaggcgaugggacuaaaagcuguagaaugaaagauucugggaacugcaauguugcaacuaacagauggccagugauacaaugugagaaugacaaauuuuacuacucagagcuucaaaaagauuaugacaaaacucaagauauuggucacuauugcuuaagcccuggauguacuacuguccgguacccuauuaauccaaagcacaucucuaacuguaauuggcaaguaagcagaucuagcauagcgaagauagaugugcacaauauugaggauauugagcaauauaagaaagcuauaacucagaaacuucaaacaagccuaucucuauucaaguaugcaaaaacaaaaaacuugccgcacaucaaaccaauuuauaaauauauaacuauagaaggaacagaaacugcagaagguauagagagugcauacauugaaucagaaguaccugcauuggcugggacaucuaucggauucaaaaucaauucuaaagagggcaagcacuugcuagauguuauagcauauguaaaaagugccucauacucuucaguguauacaaaauuguacucaacuggcccaacaucagggauaaauacuaaacaugaugaauuguguacuggcccaugcccagcaaauaucaaucaucagguuggguggcugacauuugcaagagagaggacaagcucauggggaugcgaagaguuugguugccuggcuguaagugauggguguguauuuggaucaugccaagauauaauaaaagaagaacuaucugucuauaggaaggagaccgaggaagugacugauguagaacuguguuugacauuuucagacaaaacauacuguacaaacuuaaacccuguuaccccuauuauaacagaucuauuugagguacaguucaaaacuguagagaccuacagcuugcccagaauuguugcugugcaaaaccaugagauuaagauugggcaaauaaaugauuuaggaguuuacucuaaggguugugggaauguucaaaaggucaauggaacuauuuauggcaauggaguucccagauuugacuacuuaugccauuuagcuagcaggaaggaagucauuguuagaaaaugcuucgacaaugauuaccaagcaugcaaauuccuucaaagcccugcuaguuacagacuugaagaagacaguggcacugugaccauaauugacuacaaaaagauuuuaggaacaaucaagaugaaggcaauuuuaggagaugucaaauauaaaacauuugcugauagugucgauauaaccgcagaagggucaugcaccggcuguauuaacugcuucgaaaauauccauugcgaauuaacguugcacaccacaauugaagccagcugcccaauuaaaagcucgugcacaguauuucaugacaggauucuugugacuccaaaugaacacaaauaugcauugaaaauggugugcacagaaaagccagggaacacacucacaauuaaagucugcaauacuaaaauugaagcaucuauggcccuugucgaugcaaagccuaucauagaacuagcaccaguugaucagacagcauauauaagagaaaaagaugaaagguguaaaacuuggauguguaggguaagagaugaaggacugcaggucaucuuggagccauuuaaaaauuuauuuggaucuuauauugggauauuuuacacauuuauuauaucuauaguagcauuauugguuauuaucuauguacuacuaccuauaugcuuuaaguuaagggauacccuuagaaagcaugaagaugcauauaagagagagaugaaaauuagauag

SEQ ID NO: 4274 - RNA, 4326 nt, Artificial Sequence
  derived and/or modified CDS sequence (wt) from LACV(LAC76-40)__U70206.1__GP
augauuuguauauuggugcugauuacaguugcagcugcaagcccaguguaucaaagguguuuccaagauggggcuauagugaagcaaaacccauccaaagaagcaguuacagaggugugccugaaagaugaugucagcaugaucaaaacagaggccagguauguaagaaaugcaacaggaguuuuuucaaauaaugucgcaauaaggaaauggcuagucucugauuggcaugauugcaggccuaagaagaucguugggggacacaucaauguaauagaaguuggugaugaccugucacuccauacugaaucauauguuugcagcgcagauuguaccauagguguagacaaagagacugcacaggucaggcuucagacagauaccacaaaucauuuugaaauugcaggcacuacugugaagucaggaugguucaagagcacgacauauauaacucuugaucaaacuugcgaacaccuuaaaguuuccugcggcccaaaaucuguacaguuccaugccugcuucaaucagcauaugucuugcgucagauucuuacacaggacaauauugccuggcucuauagccaauuccauaugucagaauaucgaaaucauaauuuuaguuacacuuacucuauuaaucuuuauauuguuaagcauuuuaaguaagacuuauauauguuauuuauuaaugccuauauucauccccauagcauauauauacggcauaauuuacaauaagucgugcaaaaaaugcaaauuauguggcuuaguguaucauccauucacagaguguggcacacauugugucuguggugcccgcuaugauacuucggauagaaugaaacugcacagagcuucuggauugugcccugguuauaaaagccuaagagcugccagagucaugugcaagucgaaagggccugcaucaauauugucuauaauuacugcgguacuggucuuaaccuuugugacaccaaucaacuccaugguuuuaggagagaguaaagaaaccuuugaacuugaagaucuuccagacgacauguuggaaauggcaucgagaauaaauucuuauuaucucaccuguaucuugaauuaugcuguaagcuggggucuuguuaucauuggauuguugaucgggcugcuauuuaagaaauaccagcacagauucuuaaauguuuacgcaauguacugugaagaaugugacauguaucaugacaagucuggguugaaaagacauggugauuucaccaacaaaugcagacagugcacauguggucaauaugaagaugcugcagguuugauggcucacaggaaaaccuauaacugcuuagugcaguacaaagcaaaguggaugaugaacuuccugauaauuuacauauucuuaauuuugaucaaagauucugcuauaguuguacaagcugcuggaacugacuucaccaccugccuagagacugagaguauaaauuggaacugcacugggccauuuuugaaccucgggaauugccaaaagcaacaaaagaaagaaccuuacaccaacauugcaacucaguuaaagggacuaaaggcaauuuccguacuagaugucccuauaauaacagggauaccagaugauauugcgggugccuuaagauauauagaagagaaggaagauuuccauguccagcuaacuauagaauaugcgauguuaaguaaauacugugacuauuauacccaauucucagauaacucaggauacagucagacaacauggagaguguacuuaaggucucaugauuuugaagccuguauacuauauccaaaucagcacuuuugcagauguguaaaaaauggugagaagugcagcagcuccaauugggacuuugccaaugaaaugaaagauuauuacucugggaaacaaacaaaguuugacaaggacuuaaaucuagcccuaacagcuuugcaucaugccuucagggggaccucaucugcauauauagcaacaaugcucucaaaaaaguccaaugaugacuugauugcauacacaaauaagauaaaaacaaaauucccagguaaugcauuguugaaggcuauaauagauuauauagcauauaugaaaagcuugccagguauggcaaauuucaaauaugaugaauucugggaugaauuauuguacaaacccaacccagcaaaggccucaaaccuugcuagaggaaaggagucaucuuacaacuucaaacuagcaauuucaucaaagucuauaaaaaccugcaaggauguuaaggauguugccugcuuaucgccaaggucaggugcuauauaugcuucaauaauugcguguggugaacccaaugggccaaguguguauaggaaaccaucaggugguguauuccaaucuagcacugaucggucuauauacugcuugcuggauagccauugucuagaagaauuugaggccauuggccaggaggagcuggaugcgguaaagaaauccaaauguugggaaauugaauauccugacguaaagcucauccaagaaggugaugggacuaaaagcuguagaaugaaagauucugggaacugcaauguugcaacuaacagauggccagugauacaaugugagaaugacaaauuuuacuacucagagcuucaaaaagauuaugacaaaacucaagauauuggucacuauugcuuaagcccuggauguacuacuguccgguacccuauuaauccaaagcacaucucuaacuguaauuggcaaguaagcagaucuagcauagcgaagauagaugugcacaauauugaggauauugagcaauauaagaaagcuauaacucaaaaacuucaaacgagccuaucucuauucaaguaugcaaaaacaaaaaacuugccgcacaucaaaccaauuuauaaauacauaacuauagaaggaacagaaacugcagaagguauagagagugcauacauugaaucagaaguaccugcauuggcugggacaucuaucggauucaaaaucaauucuaaagagggcaagcacuugcuagauguuauagcauauguaaaaagugccucauacucuucaguguaugcaaaauuguacucaacuggcccaacaucagggauaaauacuaaacaugaugaauuguguacuggcccaugcccagcaaauauuaaucaucagguuggguggcugacauuugcaagagagaggacaagcucauggggaugcgaagaguuugguugccuggcuguaagugauggguguguauuugggucaugccaagauauaauaaaagaagaacugucugucuauaggaaggagaccgaggaagugacugauguagaacuguguuugacauuuucagacaaaacauacuguacaaacuuaaacccuguuaccccuauuauaacagaucuauuugagguacaguucaaaacuguagagaccuacagcuugcccagaauuguugcugugcaaaaccaugagauuaagauugggcaaauaaaugauuuaggaguuuacucuaaggguugugggaauguucaaaaggucaauggaacuauuuauggcaauggaguucccagauuugacuacuuaugccauuuagcuagcaggaaggaagucauuguuagaaaaugcuucgauaaugauuaccaagcaugcaaauuucuucaaagcccugcuaguuacagacuugaagaagacaguggcacugugaccauaauugacuacaaaaagauuuuaggaacaaucaagaugaaggcaauuuuaggagaugucaaauauaaaacauuugcugauagugucgauauaaccgcagaagggucaugcaccggcuguauuaacugcuucgaaaauauccauugcgaauuaacguugcacaccacaauugaagccagcugcccaauuaaaagcucgugcacaguauuucaugacaggauucuugugacuccaaaugaacacaaauaugcauugaaaauggugugcacagaaaagccagggaacacacucacaauuaaagucugcaauacuaaaauugaagcaucuauggcccuugucgacgcaaagccuaucauagaacuagcaccaguugaucagacagcauauauaagagaaaaagaugagagguguaaaacuuggauguguaggguaagagaugaaggacugcaggucaucuuggagccauuuaaaaauuuauucggaucuuauauugggauauuuuacacauuuauuauaucuauaguagcauuauugguuauuaucuauguacuacuaccuauaugcuuuaaguuaagggacacccuuagaaagcaugaagaugcauauaagagagagaugaaaauuagauag

SEQ ID NO: 4275 - RNA, 4326 nt, Artificial Sequence
  derived and/or modified CDS sequence (wt) from LACV(LAC79-283)__U70207.1__GP
augauucgcauacuggugcugauugcaguuacagcugcaagcccaguguaucaaaggugcuuccaagauggggcuauagugaagcaaaacccauccaaagaagcagucacagaggugugccugaaagaugauguuagcaugaucaaaacagaggccagguauauaagaaaugcaacagggguuuuuucaaacaauguugcaauaaggaaauggcuagucucugauuggcaugauugcaggccuaagaggaucauugggggacacaucaauguaauagaaguuggugaugaccuaucgcugcauacugaaucauauguuugcagcgcagauuguacaauagguguagacaaagagacugcgcaggucagacuucagacagauacuacaaaucauuuugaaauugcaggcacuacugugaagucaggaugguucaaaagcacgacauauauaacucuugaucaaaccugcgaacaccuuaaaguuuccuguggcccaaaaucuguacaauuccaugccugcuucaaucagcauaugucuugcgucagauuuuuacacagaacaauauugccuggcuccauugccaauuccauaugucagaauauugaaaucauaauuuuaguuacacuuacucuauuaaucuuuauauuguuaaguauucuaaguaagacuuauauauguuauuuauuaaugccuauauuuauccccauagcauauauauacgguauaauuuacaauaagucgugcaaaaaaugcaaacuaugcggccuaguguaucauccauucacagaguguggcacgcauugugucuguggugcccgcuaugauacuucagauagaaugaaacugcacagagcuucuggauugugcccugguuauaaaagccuaagagcugccagagucaugugcaagucgaaagggccugcaucaauauuaucuauaauuacugcaguacuagucuuaaccuuuguaacaccaaucaacucuaugguuuuaggagaaaguaaagaaacguuugagcuugaagagcuuccagaugacauguugggaauggcaucuaggauaaacucuuauuauuuuaccugcaucuuaaauuaugcuguaagcuggggucuuguuaucauuggguuguugaccggacugcuuuuuaagaaauaccaacacagauuuuuaaauguuuaugcaauguacugugaggaaugugacauguaucaugacaagucuggguugaaaagacauggugacuucacuaacaaaugcaggcagugcacaugcggccaauaugaagaugccacaggcuugauggcccacaggaaaaccuauaacugcuuagugcaguacaaagcaaaguggaugaugaauuuccugguaauuuacauauucuuaauuuuaaucaaagauucugcuauaguuguacaagcugcuggaaccgauuucaccaccugccuagagacugagaguauaaauuggaacugcacugggccguuuuugaaccucgggaauugucaaaagcagcaaaagaaggaaccuuacaccaacauugcaacccaauuaaaggggcuaaaggcaauuuccguacuagauaucccuauaauaacagggauuccggaugauauugcaggugcuuuaagauauauagaagaaagggaagauuuccauguccagcuaacuauagaauacgcaaugcugaguaaguacugugacuauuacacccaauucucagauaacucaggauacagucagacaacauggaggguguacuuaaggucucaugauuuugaggcauguauacuauauccaaaucagcauuuuugcagaugugugaaaaauggugaaaagugcagcagcuccaauugggauuuugccaaugaaaugaaggauuuuuacucugggaaacaaacaaaguuugauaaagacuuaaaucuagcccuaacagcuuugcaucaugcuuucagggggaccucaucugcauauauagcaacaaugcucucaaaaaaguccaaugaugacuugauugcauacacaaauaagauaaaaacaaaauuuccagguaaugcauuguugaaggcuauaauagauuauauagcauauaugaaaaguuugccagguauggcaaauuucaaacaugaugaguucugggaugaauuauuguacaaacccaacccagcaaaagccucaaaccuugcuagaggaaaggagucuucuuacaacuuuaaacuagcaauuucaucaaaaucuauaaaaaccugcaagaauguuaaggaugucgccugcuuaucaccaaggucaggugcuauauaugcuucaauaauugcguguggugaaccuaaugggccaaguguguauagaaaaccaucaggugguguauuccaaucuagcacugaucggucuauauacugcuuacuagauagccauugucuagaagaguuugaggcuaucagccaggaagagcuggacgcagugaaaaaauccaaauguugggaaauugaauauccugacguaaaaccccuccaagaaggcgaugggacuaaaagcuguaggaugaaagauucugggaacugcaauguugcaacuaacagauggccagugauacaaugcgagaaugacaaauuuuacuacucagagcuucaaaaagauuaugauaaaacucaagauauuggucauuauugcuuaagcccuggauguacuacuguccgguacccuauuaauccaaagcauaucucuaacuguaauuggcagguaaguagauccaguauagcgaagauagacgugcacaauauugaagacauugaacaguauaagaaggcuauaacucaaaaacuccaaacaagccuaucucuauucaaguaugcaaaaacaaaaaacuugccacacaucaaaccaauuuauaaauauauaacuauagaaggaacagaaacugcagaagguauagagagugcauacauugaaucagaggugccugcauuagcugggacaucuaucggguucaaaaucaauucuaaagagggcaaacacuuacuagauguuauagcauauguaaaaagcgccucauacucuucaguguaugcaaaauuguacucaacuggcccaacaucaggaauaaacacuaaacaugaugaauuguguacuggcccaugcccagcaaauaucaaucaucagguuggguggcuaacauuugcaagagagaggacaaguucauggggaugugaagaauuugguugccuagcuguaagugauggguguguauuugggucaugccaagauauaauaaaagaagaacuaucugucuauaggaaggagaccgaagaaguaacugauguagaacuauguuuaacauuuucagacaaaacauauuguacaaacuugaacccuguuacuccuauuauaacagaccuauuugaaguacaguucaacacuguagagacuuacagcuugcccagaauuguugcugugcaaaaccacgagauuaagauugggcaaauaaaugaccuaggaguuuacucuaaagguuguggaaauguucaaaaggucaauggaacuguuuauggcaauggaguucccagauuugauuacuuaugccauuuagcuagcaggaaggaagucauuguuagaaaaugcuucgacaaugauuaccaggcaugcaaauuccuucaaagcccugcuaguuacagacuugaagaagacagugguacugugacuauaauugauuacaaaaagauauuaggcacaaucaagaugaaggcaauuuuaggagaugucaaauauaagacauuugcugacagugucgauauaacugcagaagggucaugcacuggcuguaucaauugcuuugagaauauucauugugaauuaacguugcauaccacaauugaagcuagcugcccaauuaaaagcucgugcacaguauuccaugacaggauucuugugacuccaaaugaaccccaauaugcauuaaaaauggugugcacagaaaggccagggaauacccucacaauuaaaguuugcaauacuaagauugaggcaucuauggcccuugucgaugcaaaaccuaucauagaacuagcaccaguugaucagacagcauacauaagagaaaaagaugaaagguguaaaacuuggauguguaggguaagagaugaaggauugcaagucauccuggaaccauucaaaaauuuauuuggaucuuauauugggauauuuuacacauuuauuauaucuaugguggcauuauugguuaucauauaugugcuauugccuauaugcuuuaaguuaagagauacccuuagaaagcaugaagaugcauauaagagagagaugaagauuagauag

SEQ ID NO: 4276 - RNA, 4326 nt, Artificial Sequence
  derived and/or modified CDS sequence (wt) from LACV(LAC81-4)__U70208.1__GP
augauucgcauacuggugcugauugcaguuacagcugcaagcccaguguaucaaagguguuuccaagauggggcuauagugaagcaaaacccauccaaagaagcagucacagaggugugccugaaagaugauguuagcaugaucaaaacagaggccagguauauaagaaaugcaacagggguuuuuucaaacaauguugcaauaaggaaauggcuagucucugauuggcaugauugcaggccuaagaagaucauugggggacacaucaauguaauagaaguuggugaugaccuaucgcugcauacugaaucauauguuugcagcgcagauuguacaauagguguagacaaagagacugcgcaggucagacuucagacagauacuacaaaucauuuugaaauugcaggcacuacugugaagucaggaugguucaaaagcacgacauauauaacucuugaucaaaccugcgaacaccuuaaaguuuccuguggcccaaaaucuguacaauuccaugccugcuucaaucagcauaugucuugcgucagauuuuuacacagaacaauauugccuggcuccauugccaauuccauaugucagaauauugaaaucauaauuuuaguuacacuuacucuauuaaucuuuauauuguuaaguauucuaaguaagacuuauauauguuauuuauuaaugccuauauuuauccccauagcauauguauacgguauaauuuacaauaagucgugcaaaaaaugcaaacuaugcggccuaguguaucauccauucacagaguguggcacacauugugucuguggugcccgcuaugauacuucagauagaaugaaacuucacagagcuucuggauugugcccugguuauaaaagccuaagagcugccagagucaugugcaagucgaaagggccugcaucaauauuaucuauaauuacugcaguacuagucuuaaccuuuguaacaccaaucaacucuaugguuuuaggagaaagcaaagaaacguuugagcuugaagagcuuccagaugacauguugggaauggcaucuaggauaaacucuuauuauuuuaccugcaucuuaaauuaugcuguaagcuggggucuuguuaucauuggguuguugaccggacugcuuuuuaagaaauaccaacacagauuuuuaaauguuuaugcaauguacugugaggaaugugacauguaucaugacaagucuggguugaaaagacauggugacuucacuaacaaaugcaggcagugcacaugcggccaauaugaagaugccacaggcuugauggcccacaggaaaaccuauaacugcuuagugcaguacaaagcaaaguggaugaugaauuuccugguaauuuacauauucuuaauuuuaaucaaagauucugcuauaguuguacaagcugcuggaaccgauuucaccaccugccuagagacugagaguauaaauuggaacugcacugggccguuuuugaaccucgggaauugucaaaagcagcaaaagaaggaaccuuacaccaacauugcaacccaauuaaaggggcuaaaggcaauuuccguacuagauaucccuauaauaacagggauuccggaugauauugcaggugcuuuaagauauauagaagaaagggaagauuuccauguccagcuaacuauagaauacgcaaugcugaguaaguacugugacuauuacacccaauucucagauaacucaggauacagucagacaacauggaggguguacuuaaggucucaugauuuugaggcauguauacuauauccaaaucagcauuuuugcagaugugugaaaaauggugaaaagugcagcagcuccaauugggauuuugccaaugaaaugaaggauuuuuacucugggaaacaaacaaaguuugauaaagacuuaaaucuagcccuaacagcuuugcaucaugcuuucagggggaccucaucugcauauauagcaacaaugcucucaaaaaaguccaaugaugacuugauugcauacacaaauaagauaaaaacaaaauuuccagguaaugcauuguugaaggcuauaauagauuauauagcauauaugaaaaguuugccagguauggcaaauuucaaacaugaugaguucugggaugaauuauuguacaaacccaacccagcaaaagccucaaaccuugcuagaggaaaggagucuucuuacaacuuuaaacuagcaauuucaucaaaaucuauaaaaaccugcaagaauguuaaggaugucgccugcuuaucaccaaggucaggugcuauauaugcuucaauaauugcguguggcgaaccuaaugggccaaguguguauagaaaaccaucaggugguguauuccaaucuagcacugaucggucuauauacugcuuacuagauagccauugucuagaagaguuugaggcuaucagccaggaagagcuggaugcagugaaaaaauccaaauguugggaaauugaauauccugacguaaaaccccuccaagaaggugaugggacuaaaagcuguaggaugaaagauucugggaacugcaauguugcaacuaacagauggccagugauacaaugcgagaaugacaaauuuuacuacucagagcuucaaaaagauuaugauaaaacucaagauauuggucauuauugcuuaagcccuggauguacuacuguccgguacccuauuaauccaaagcauaucucuaacuguaauuggcagguaaguagauccaguauagcgaagauagacgugcacaauauugaagacauugaacaguauaagaaggcuauaacucaaaaacuccaaacaagccuaucucuauucaaguaugcaaaaacaaaaaacuugccacacaucaaaccaauuuauaaauauauaacuauagaaggaacagaaacugcagaagguauagagagugcauacauugaaucagaggugccugcauuagcugggacaucuaucggguucaaaaucaauucuaaagagggcaaacacuuacuagauguuauagcauauguaaaaagcgccucauacucuucaguguaugcaaaauuguacucaacuggcccaacaucaggaauaaacacuaaacaugaugaauuguguacuggcccaugcccagcaaauaucaaucaucagguuggguggcuaacauuugcaagagagaggacaaguucauggggaugugaagaauuugguugccuagcuguaagugauggguguguauuugggucaugccaagauauaauaaaagaagaacuaucugucuauaggaaggagaccgaagaaguaacugauguagaacuauguuuaacauuuucagauaaaacauauuguacaaacuugaacccuguuacuccuauuauaacagaccuauuugaaguacaguucaaaacuguagagacuuacagcuugcccagaauuguugcugugcaaaaccacgagauuaagauugggcaaauaaaugaccuaggaguuuacucuaaagguuguggaaauguucaaaaggucaauggaacuguuuauggcaauggaguucccagauuugauuacuuaugccauuuagcuagcagaaaggaagucauuguuagaaaaugcuucgacaaugauuaccaggcaugcaaauuccuucaaagcccugcuaguuacagacuugaagaagacagugguacugugacuauaauugauuacaaaaagauauuaggcacaaucaagaugaaggcaauuuuaggagaugucaaauauaagacauuugcugacagugucgauauaacugcagaagggucaugcacuggcuguaucaauugcuuugagaauauucauugugaauuaacguugcauaccacaauugaagcuagcugcccaauuaaaagcucgugcacaguauuccaugacaggauucuugugacuccaaaugaaccccaauaugcauuaaaaauggugugcacagaaaggccagggaauacccucacaauuaaaguuugcaauacuaagauugaggcaucuauggcccuugucgaugcaaaaccuaucauagaacuagcaccaguugaucagacagcauacauaagagaaaaagaugaaagguguaaaacuuggauguguaggguaagagaugaaggauugcaagucauccuggaaccauucaaaaauuuauuuggaucuuauauugggauauuuuacacauuuauuauaucuaugguggcauuauugguuaucauauaugugcuauugccuauaugcuuuaaguuaagagacacccuuagaaagcaugaagaugcauauaagagagagaugaagauuagauag

SEQ ID NO: 4277 - RNA, 4326 nt, Artificial Sequence
  derived and/or modified CDS sequence (wt) from LACV(LACR56869)__U70205.1__GP
augauuuguauauuggugcugauuacaguugcagcugcaagcccaguguaucaaagguguuuccaagauggggcuauagugaagcaaaacccauccaaagaagcaguuacagaggugugccugaaagaugauguuagcaugaucaaaacagaggccagguauguaagaaaugcaacaggaguuuuuucaaacaaugucgcaauaaggaaauggcuagucucugauuggcaugauugcaggccuaagaagaucguugggggacacaucaauguaauagaaguuggugacgaccugucacuccauacugaaucauauguuugcagcgcagauuguaccauagguguagacaaagagacugcacaggucaggcuucagacagauaccacaaaucauuuugaaauugcaggcacuacugugaagucaggaugguucaagagcacgacauauauaacucuugaucaaacuugcgaacaccuuaaaguuuccuguggcccaaaaucuguacaguuccaugccugcuucaaucagcauaugucuugcgucagauuuuuacacaggacaauauugccuggcucuauagccaauuccauaugucagaauaucgaaaucauaauuuuaguuacacuuacucuauuaaucuuuauauuguuaagcauuuuaaguaagacuuauauauguuauuuauuaaugccuauauucauccccauagcauauauauacgguauaauuuacaauaagucgugcaaaaaaugcaaauuauguggcuuaguguaucauccauucacagaguguggcacacauugugucuguggugcccgcuaugauacuucagauagaaugaaauugcacagagcuucuggauuaugcccugguuauaaaagccuaagagcugccagagucaugugcaagucgaaagggccugcaucaauauugucuauaauuacugcgguacuagucuuaaccuuugugacaccaaucaacuccaugguuuuaggagagaguaaagaaaccuuugaacuugaagaucuuccagacgacauguuggaaauggcaucgagaauaaauucuuauuaucucaccuguaucuugaauuaugcuguaagcuggggucuuguuaucauuggauuguugaucgggcugcuauuuaagaaauaccagcacagauucuuaaauauuuacgcaauguacugugaagaaugugacauguaucaugacaagucuggguugaaaagacauggugauuucaccaacaaaugcagacagugcacauguggucaauaugaagaugcugcagguuugauggcucacaggaaaaccuauaacugcuuagugcaguacaaagcaaaguggaugaugaacuuccugauaauuuacauauucuuaauuuugaucaaagauucugcuauaguuguacaagcugcuggaacugacuucaccaccugccuagagacugaaaguauaaauuggaacugcacugggccauuuuugaaccucgggaauugccaaaagcaacaaaagaaagaaccuuacaccaacauugcaacucaguuaaagggacuaaaggcaauuuccguacuagaugucccuauaauaacagggauaccagaugauauugcgggugcuuuaagauauauagaagagaaggaagauuuccauguccagcuaacuauagaauaugcgauguuaaguaaauacugugauuauuauacccaauucucagauaacucaggauacagucagacaacauggagaguguacuuaaggucucaugauuuugaagccuguauacuauauccaaaucagcacuuuugcagauguguaaagaauggugagaagugcagcagcuccaauugggacuuugccaacgaaaugaaagauuauuacucugggaaacaaacaaaguuugacaaggacuuaaaucuagcccuaacagcuuugcaucaugccuucagggggaccucaucugcauauauggcaacaaugcucucaaaaaaguccaaugaugacuugauugcauacacaaauaagauaaaaacaaaauucccagguaaugcauuguugaaggcuauaauagauuauauagcauauaugaaaaguuugccagguauggcaaauuucaaauaugaugaauucugggaugaauuauuguacaaacccaacccagcaaaggccucaaaccuugcuagaggaaaggagucaucuuacaacuucaaacuagcaauuucaucaaagucuauaaaaaccugcaagaauguuaaggauguugccugcuuaucgccaaggucaggugcuauauaugcuucaauaauugcguguggugaacccaaugggccaaguguguauaggaaaccaucaggugguguauuccaaucuagcacugaucggucuauauacugcuugcuggauagccauugucuagaagaauuugaggccaucggccaggaggagcuggaugcgguaaagaagucuaaauguugggaaauugaauauccugacguaaagcucauccaagaaggcgaugggacuaaaagcuguagaaugaaagauucugggaacugcaauguugcaacuaacagauggccagugauacaaugugagaaugacaaauuuuacuacucagagcuucaaaaagauuaugacaaaacucaagauauuggucacuauugcuuaagcccuggauguacuacuguccgguacccuauuaauccaaagcacaucucuaacuguaauuggcaaguaagcagaucuagcauagcgaagauagaugugcacaauauugaggauauugaacaauauaagaaagcuauaacucagaaacuucaaacgagccuaucucuauucaaguaugcaaaaacaaaaaacuugccgcacaucaaaccaauuuauaaauauauaacuauagaaggaacagaaacugcagaagguauagagagugcauacauugaaucagaaguaccugcauuggcugggacaucuaucggauucaaaaucaauucuaaagagggcaagcacuuacuagauguuauagcauaugugaaaagugccucauacucuucaguguauacaaaauuguacucaacuggcccaacaucagggauaaauacuaaacaugaugaauuguguacuggcccaugcccagcaaauaucaaucaucaggauggguggcugacauuugcaagagagaggacaagcucauggggaugcgaagaguuugguugccuggcuguaagugauggguguguauuugggucaugccaagauauaauaaaagaagaacuaucugucuauaggaaggagaccgaggaagugacugauguagaacuguguuugacauuuucagacaaaacauacuguacaaacuuaaacccuguuaccccuauuauaacagaucuauuugagguacaguucaaaacuguggagaccuacagcuugcccagaauuguugcugugcaaaaccaugagauuaagauugggcaaauaaaugauuuaggaguuuacucuaaggguugugggaauguucaaaaggucaauggaacuauuuauggcaauggaguucccagauuugacuacuuaugccauuuagcuagcaggaaggaagucauuguuagaaaaugcuucgacaaugauuaucaagcaugcaaauuucuucaaagcccugcuaguuacagacuugaagaagacaguggcacugugaccauaauugacuacaaaaagauuuuaggaacaaucaagaugaaggcaauuuuaggagaugucaaauauaaaacauuugcugauagugucgauauaaccgcagaagggucaugcaccggcuguauuaauugcuucgaaaauauccauugcgaauuaacguugcacaccacaauugaagccagcugcccaauuaaaagcucgugcacaguauuucaugacaggauucuuguuacuccaaaugaacacaaauaugcauuaaaaauggugugcacagaaaagccagggaacacacucacaauugaagucugcaauacuaaaauugaagcaucuauggcccuugucgacgcaaagccuaucauagaacuagcaccaguugaucagacaacauauauaagagaaaaagaugaaagguguaaaacuuggauguguaggguaagagaugaaggacugcaggucaucuuggagccauuuaaaaauuuauuuggaucuuauauugggauauuuuacacauuuauuauaucuauaguagcauuauugguuauuaucuauguacuacuaccuauaugcuuuaaguuaagggauacccuuagaaagcaugaagaugcauauaagagagagaugaaaauuagauaa

SEQ ID NO: 4278 - RNA, 4326 nt, Artificial Sequence
  derived and/or modified CDS sequence (wt) from LACV(NAT_Crawford_WI_2007)__GU596383.1__GP
augauucgcauacuggugcugauugcaguuacagcugcaagcccaguguaucaaagauguuuccaagauggggcuauagugaagcaaaacccauccaaagaagcagucacagaggugugccugaaagaugauguuagcaugaucaaaacagaggccagguauguaagaaaugcaacagggguuuuuucaaacaauguugcaauaaggaaauggcuagucucugauuggcaugauugcaggccuaagaagaucauugggggacacaucaauguaauagaaguuggugaugaccuaucgcugcauacugaaucauauguuugcagcgcagauuguacaauagguguagacaaagagacugcgcaggucagacuucagacagauacuacaaaucauuuugaaauugcaggcacuacuguaaagucaggaugguucaaaagcacgacauauauaacucuugaucaaaccugcgaacaccuuaaaguuuccuguggcccaaaaucuguacaauuccaugccugcuucaaucagcauaugucuugcgucagauuuuuacacagaacaauauugccuggcuccauugccaauuccauaugucaaaauauugaaaucauaauuuuaguuacacuuacucuauugaucuuuauauuguuaaguauuuuaaguaagacuuauauauguuauuuauuaaugccuauauuuauccccauagcauauguauacgguauaauuuacaauaagucgugcaaaaaaugcaaacuaugcggccuaguguaucauccauucacagaguguggcacacauugugucuguggugcccgcuaugauacuucagauagaaugaaacugcacagagcuucuggauugugcccugguuauaaaagccuaagagcugccagagucaugugcaagucgaaagggccugcaucaauuuuaucuauaauuacugcaguacuggucuuaaccuuuguaacaccaaucaacucuaugguuuuaggggaaaguaaagaaacguuugaacuugaagagcuuccagaugacauguuggaaauggcaucgaggauaaauucuuauuauuuuaccugcaucuugaauuaugcuguaagcuggggucuuguuaucauuggguuguugaccggacugcuauucaagaaauaccaacacagauuuuuaaauguuuaugcaauguacugugaggaaugugacauguaucaugacaagucuggguuaaaaagacauggugacuuuaccaacaaaugcaggcaguguacauguggccaauaugaagaugccacaggcuugauggcccacaggaaaaccuauaacugcuuagugcaguacaaagcaaaguggaugaugaauuuccuaauaauuuacauauucuuaauuuuaaucaaagauucugcuauaguuguacaagcugcuggaaccgauuucaccacuugccuagagacugagaguauaaauuggaacugcacugggccguuuuugaaccucgggaauugucaaaagcagcaaaagaaggaaccuuacaccaacauugcaacccaauuaaaggggcuaaaggcaauuuccguacuggauaucccuauaauaacagggauuccagaugauauugcaggugcuuuaagguauauagaagaaagggaagauuuccauguccagcuaacuauagaauacgcaaugcugaguaaguacugugacuauuacacccaauucucagauaacucaggauacagucaggcaacauggaggguguacuuaaggucucaugauuuugaggcauguauacuauauccaaaucagcauuuuugcagaugugugaaaaauggugaaaagugcagcagcuccaauugggauuuugccaaugaaaugaaggauuuuuacucuggaaaacaaacaaaguuugauaaagacuuaaaucuggcccuaacagcuuugcaccaugccuucagggggaccucaucugcauauauagcaacaaugcucucaaaaaaguccaaugaugacuugauugcauacacaaauaagauaaaaacaaaauuuccagguaaugcauuguugaaggcuauaauagauuauauagcauauaugaaaaguuugccagguauggcaaauuucaaauaugaugaguucugggaugaauuauuguacaaacccaacccagcaaaagccucaaaccuugcuagaggaaaggagucuucuuacaacuuuaaacuagcaauuucaucaaaaucuauaaaaaccugcaagaauguuaaggaugucgccugcuuaucaccaaggucaggugcuauauaugcuucaauaauugcguguggcgaacccaaugggccaaguguguauagaaaaccaucaggugguguauuccaaucuagcacugaucggucuauauacugcuuacuagauagccauugucuagaagaguuugaggcuaucagccaggaagagcuggaugcagugaaaaaauccaaauguugggaaauugaauauccugacguaaaaccccuccaagaaagugauggaacuaaaagcuguaggaugaaagauucugggaacugcaauguugcaacuaacagauggccagugauacaaugcgagaaugacaaauuuuacuacucagagcuucaaaaagauuaugauaaaacucaagauauuggucauuauugcuuaagcccuggauguacuacuguccgguacccuauuaauccaaagcauaucucuaacuguaauuggcagguaagcagauccaguauagcgaagauagacgugcacaauauugaagacauugagcaguauaagaaggcuauaacucaaaaacuccaaacaagccuaucucuauucaaguaugcaaaaacaaaaaacuugccacacauuaaaccaauuuauaaauauauaacuauagaaggaacagaaacugcagaagguauagagagugcauacauugaaucagaggugccugcauuagcugggacaucuaucggguucaaaaucaauucuaaagagggcaaacacuuacuagauguuauagcauauguaaaaagcgccucauacucuucaguguaugcaaaauuguacucaacuggcccaacaucaggaauaaacacuaagcaugaugaauuguguacuggcccaugcccagcaaauaucaaucaccagguuggguggcuaacauuugcaagagagaggacaaguucauggggaugugaagaauuugguugccuagcuguaagugauggguguguauuuggaucaugccaagauauaauaaaagaagaacuaucugucuauaggaaggagaccgaagaagugacugauguagaacuauguuuaacauuuucagauaaaacauauuguacaaacuugaacccuguuaccccuauuauaacagaucuauuugaaguacaguucaaaacuguagagacuuacagcuugcccagaauuguugcugugcaaaaccaugagauuaagauugggcaaauaaaugaccuaggaguuuacucuaaagguuguggaaauguucaaaaggucaauggaacuguuuauggcaauggaguucccagauuugauuacuuaugccacuuagcuagcagaaaggaagucauuguuagaaaaugcuucgacaaugauuaccaagcaugcaaauuccuucaaagcccugcuaguuacagacuugaagaagacagugguacuguaacuauaauugauuacaagaagauauuaggcacaaucaagaugaaggcaauuuuaggagaugucaaauauaaaacauuugcugacagugucgauauaacugcagaagggucaugcacuggcuguaucaauugcuuugagaauauucauugugaauuaacguuacauaccacaauugaagcuagcugcccaauuaaaagcucgugcacaguauuccaugacaggauucuugugacuccaaaugaacacaaauaugcauuaaaaauggugugcacagaaaggccagggaauacacucacaauuaaaguuugcaacacuaagauugaggcaucuauggcccuugucgaugcaaagccuaucauagaacuagcaccaguugaucagacagcauacauaagagaaaaggaugaaagguguaaaacuuggauguguaggguaagagaugaaggauugcaagucauccuggagccauucaaaaauuuguuuggaucuuauauugggauauuuuacacauuuauuauaucuauaguggcauuauugguuaucaucuaugugcuauugccuauaugcuucaaguuaagagauacccuuagaaagcaugaagaugcauauaagagagagaugaaaauuagauag

SEQ ID NO: 4279 - RNA, 4326 nt, Artificial Sequence
  derived and/or modified CDS sequence (wt) from LACV(77)__DQ196119.1__GP
augauuuguauauuggugcuaauuacaguugcagcugcaagcccaguguaucaaagguguuuccaagauggggcuauagugaagcaaaacccauccaaagaagcaguuacagaggugugccugaaagaugauguuagcaugaucaaaacagaggcuagguauguaagaaaugcaacaggaguuuuuucaaauaaugucgcaauaaggaaauggcuagucucugauuggcaugauugcaggccuaagaagaucguugggggacacaucaauguaauagaaguuggugaugaccugucacuccauacugaaucauauguuugcagcgcagauuguaccauagguguagacaaagagacugcacaggucaggcuucagacagauaccacaaaucauuuugaaauugcaggcacuacugugaagucaggaugguucgagagcacgacauauauaacucuugaucaaacuugcgaacaccuuaaaguuuccugcggcccaaaaucuguacaguuccaugccugcuucaaucagcauaugucuugcgucagauuuuuacacaggacaauauugccuggcucuauagccaauuccauaugucagaauaucgaaaucauaauuuuaguuacacuuacucuauuaaucuuuauauuguuaagcauuuuaaguaagacuuauauauguuauuuauuaaugccuauauucauccccauagcauauauauacgguacaauuuacaauaagucgugcaaaaaaugcaaauuauguggcuuaguguaucacccauucacagaguguggcacacauuguaucuguggugcccgcuaugauacuucagauagaaugaaacugcauagagcuucuggauugugcccugguuauaaaagccuaagagcugccagagucaugugcaagucgaaagggccugcaucaauauugucuauaauuacugcgguacuggucuuaaccuuugugacaccaaucaacuccaugguuuuaggagagaguaaagaaaccuuugaacuugaagaucuuccagacgacauguuggaaauggcaucgagaauaaauucuuauuaucuuaccuguaucuugaauuaugcuguaagcuggggucuuguuaucauuggauuguugaucgggcugcuuuuuaagaaauaccagcacagauucuuaaauguuuacgcaauguacugugaagaaugugacauguaucaugacaagucuggguugaaaagacauggugauuucaccaacaaaugcagacagugcacauguggucaauaugaagaugcugcagguuugauggcucacaggaaaaccuauaacugcuuagugcaguacaaagcaaaguggaugaugaacuuccugauaauuuacauauucuuaauuuugaucaaagauucugcuauaguuguacaagcugcuggaacugacuucaccaccugccuagagacugagaguauaaauuggaacugcacugggccauuuuugaaccucgggaauugccaaaagcaacaaaagaaagaaccuuacaccaacauugcaacucaguuaaagggacuaaaggcaauuuccguacuagaugucccuauaauaacagggauaccagaugauauugcgggugcuuuaagauauauagaagagaaggaagauuuccauguccagcuaacuauagaauaugcgauguuaaguaaauacugugacuauuauacccaauucucagauaacucaggauacagucagacaacauggagaguguacuuaaggucucaugauuuugaagccuguauacuauauccaaaucagcacuuuugcagauguguaaaaaauggugagaagugcagcagcuccaaucgggacuuugccaaugaaaugaaagauuauuacucugggaaacaaacaaaguuugacaaggauuuaaaucuagcccuaacagcuuugcaucaugccuucagggggaccucaucugcauauauagcaacaaugcucucaaaaaaguccaaugaugacuugauugcauacacaaauaagauaaaaacaaaauucccagguaaugcauuguugaaggcuauaauagauuauauagcauauaugaaaaguuugccagguauggcaaauuucaaauaugaugaauucugggaugaauuauuguacaaacccaacccagcaaaggccucaaaccuugcuagaggaaaggagucaucuuacaacuucaaacuagcaauuucaucaaagucuauaaaaaccugcaagaauguuaaggauguugccugcuuaucgccaaggucaggugcuauauaugcuucaauaauugcguguggugaacccaaugggccaaguguguauaggaaaccaucaggugguguauuccaaucuagcacugaucagucuauauacugcuugcuggauagccauugucuagaagaauuugaggccaucggccaggaggagcuggaugcgguaaagaaauccaaauguugggaaauugaauauccugacguaaagcucauccaagaaggcgaugggacuaaaagcuguagaaugaaagauucugggaacugcaauguugcaacuaacagauggccagugauacaaugugagaaugacaaauuuuacuacucagagcuucaaaaagauuaugacaaaacucaagauauuggucacuauugcuuaagcccuggauguacuacuguccgguacccuauuaauccaaagcacaucucuaacuguaauuggcaaguaagcagaucuagcauagcgaagauagaugugcacaauauugaggauauugagcaauauaagaaagcuauaacucagaaacuucaaacaagccuaucucuauucaaguaugcaaaaacaaaaaacuugccgcacaucaaaccaauuuauaaauauauaacuauagaaggaacagaaacugcagaagguauagagagugcauacauugaaucagaaguaccugcauuggcugggacaucuaucggauucaaaaucaauucuaaagagggcaagcacuugcuagauguuauagcauauguaaaaagugccucauacucuucaguguauacaaaauuguacucaacuggcccaacaucagggauaaauacuaaacaugaugaauuguguacuggcccaugcccagcaaauaucaaucaucagguuggguggcugacauuugcaagagagaggacaagcucauggggaugcgaagaguuugguugccuggcuguaagugauggguguguauuuggaucaugccaagauauaauaaaagaagaacuaucugucuauaggaaggagaccgaggaagugacugauguagaacuguguuugacauuuucagacaaaacauacuguacaaacuuaaacccuguuaccccuauuauaacagaucuauuugagguacaguucaaaacuguagaggccuacagcuugcccagaauuguugcugugcaaaaccaugagauuaagauugggcaaauaaaugauuuaggaguuuacucuaaggguugugggaauguucaaaaggucaauggaacuauuuauggcaauggaguucccagauuugacuacuuaugccauuuagcuagcaggaaggaagucauuguuagaaaaugcuucgacaaugauuaccaagcaugcaaauuccuucaaagcccugcuaguuacagacuugaagaagacaguggcacugugaccauaauugacuacaaaaagauuuuaggaacaaucaagaugaaggcaauuuuaggagaugucaaauauaaaacauuugcugauagugucgauauaaccgcagaagggucaugcaccggcuguauuaacugcuucgaaaauauccauugcgaauuaacguugcacaccacaauugaagccagcugcccaauuaaaagcucgugcacaguauuucaugacaggauucuugugacuccaaaugaacacaaauaugcauugaaaauggugugcacagaaaagccagggaacacacucacaauuaaagucugcaauacuaaaauugaagcaucuauggcccuugucgaugcaaagccuaucauagaacuagcaccaguugaucagacagcauauauaagagaaaaagaugaaagguguaaaacuuggauguguaggguaagagaugaaggacugcaggucaucuuggagccauuuaaaaauuuauuuggaucuuauauugggauauuuuacacauuuauuauaucuauaguagcauuauugguuauuaucuauguacuacuaccuauaugcuuuaaguuaagggauacccuuagaaagcaugaagaugcauauaagagagagaugaaaauuagauag

SEQ ID NO: 4280 - RNA, 4326 nt, Artificial Sequence
  derived and/or modified CDS sequence (wt) from LACV(LACV/00/NC-M (NC00-283))__GU206112.1__GP
augauucgcauacuggugcugauugcaguuacagcugcaagcccaguguaucaaagguguuuccaagauggggcuauagugaagcagaacccauccaaagaagcaguuacagaggugugccugaaagaugauguuagcaugaucaaaacagaggccagguacguaagaaaugcaacaggaguuuuuucaaacaacguugcaauaaggaaauggcuagucucugauuggcaugauugcaggccuaagaagaucauugggggacacaucaauguaauagaaguuggugaugaccugucacuccauacugagucauauguuuguagcgcagauuguaccauagguguugacaaagagacugcacaggucaggcuucagacagauaccacaaaucauuuugaaauugcaggcacuacugugaagucaggaugguucaaaagcacgacguauauaacucuugaucaaaccugcgaacaccuuaaaguuuccugcggcccaaaaucuguacaguuccaugccugcuucaaucagcacaugucuugcgucagauuuuuacacaggacaauauugccugguucuauagccaauucuauaugucagaauauugaaaucauaauuuuaguuacacuuacucuauuaaucuuuauauuguuaagcauuuuaaguaagacuuauauauguuauuuauuaaugccuauauuuaucccuauagcauacauguacgguauaauuuacaauaagucgugcaaaaaaugcaaacuaugcggccuaguguaucauccauucacagaguguggcacacauugcgucuguggugcucgcuaugauacuucagauagaaugaaacugcacagagcuucuggauugugccccgguuauaaaagccuaagagcugccagaguuaugugcaagucaaaagggccugcaucaauacugucuauaauuacugcaguacuggucuuaaccuuugugacaccaaucaauucuaugguuuuaggggagaguaaagaaacuuuugaacuugaagagcuuccagacgacauguuggaaauggcaucaagaauaaauucuuauuauuucaccuguaucuuaaacuaugcugugagcuggggucuuguuaucauuggauuguugaccgggcugcuauuuaagaaauaucagcacagauuuuuaaauguuuacgcaauguacugugaggaaugugauauguaucaugacaaaucuggguugaaaaggcauggugauuucaccaacaaaugcaggcagugcacaugcggucaauaugaagaugcugcagguuugauggcccauaggaaaaccuauaacugcuuagugcaauacaaagcaaaauggaugaugaauuuccugauaauuuacauauucuuaauuuuaaucaaagauucugcuauaguuguacaagcugcuggaaccgauuucaccacuugccuagagacugagaguauaaauuggaacugcacugggccguucuugaaccucgggaauugucaaaagcaacaaaagaaagaaccuuacaccaacauugcaacccaguuaaagggacuaaaggcaauuuccguacuagauaucccuauaauaacagggauaccagaugauaucgcaggugcuuuaaaauauauagaagagagggaagauuuccauguccagcuaacuauagaauacgcaaugcugaguaaauacugugacuauuauacccaauucucagacaacucaggauacagucaaacaacauggagaguguacuuaaggucucaugauuuugaggcauguauacuauauccaaaucagcauuuuugcagaugugugaaaaauggugagaagugcagcagcuccaauugggacuuugccaaugaaaugaaagauuauuauucagggaaacaaacaaaguuugauaaagacuuaaaucuagccuuaacagccuugcaucaugcuuucagggggacuucaucugcauauauagcaacaaugcucucaaaaaaaucuaaugaugacuugauugcauacacaaauaagauaaaaacaaaauucccagguaaugcauuguugaaggcuauaauagauuauauagcauauaugaaaagucugccagguaugacaaauuucaaauaugauaaauucugggaugagcuauuguacaaacccaacccagcaaaggcuucaaaccuugcuagaggaaaggagucaucuuacaacuucaaacuagcaauuucaucaaaaucuauaaaaaccugcaagaauguuaaggauguugccugcuuaucgccaaggucaggugcuauauaugcuucaauaauugcauguggugaacccaauggaccaaguguguauagaaaaccaucaggugguguauuccaaucuagcacugaucggucuauauacugcuuacuagauagccauugucuagaagaauuugaggcuaucaaccaggaggaacuggaugcaguaaaaaaauccaaauguugggaaauugaauauucugauguaaaaccccuccaagaaggugaugggacuaaaagcuguagaaugaaagauucugggaacugcaauguugcaacuaacagauggccagugauacaaugcgagaaugacaaauuuuacuacucagagcuucaaaaagauuaugacaaaacucaagauauuggucacuauugcuuaagcccuggaugcacuacuguucgguacccuauuaauccaaagcauaucucuaacuguaauuggcaggugagcagauccagcauagcgaagauagaugugcacaauauugaagauauugaacaguauaagaaggcuauaacucagaaacuucaaacaagcuuaucucuauucaaguaugcaaaaacaaaaaacuugccgcacaucaaaccaauuuauaaauauauaacuauagaaggaacagaaacugcagaagguauagagagugcauacaucgaaucagagguaccugcacuggcugggacaucuauuggauucaaaaucaauucuaaagagggcaaacacuugcuagauguuauagcauauguaaaaagcgccucauacucuucaguguaugcaaaauuguacucaacuggcccaacaucagggauaaauacuaaacaugaugaauuguguacuggcccaugcccggcaaauaucaaucaucagguuggguggcuaacauuugcaaaagagaggacaagcucauggggaugcgaagaauuugguugccuggcuguaagugauggguguguauuugggucaugccaagauauaauaaaggaagaacuaucugucuauaggaaggagaccgaagaagugacugauguggaacuauguuuaacauuuucagacaaaacauacuguacaaacuuaaacccuguuaccccuauuauaacggaccuauuugagguacaguucaagacuguagagacuuacagcuugcccagaauuguugcugugcaaaaucaugagauuaagauugggcaaauaaaugaucuaggaguuuacucuaaggguuguggaaauguucaaaaggucaaugggacuguuuaugguaauggaguucccagauuugacuaccuaugccauuuagcuagcagaaaggaagucauuguuagaaaaugcuucgacaaugauuaccaagcaugcaaauuucuucagagcccugcuaguuacagacuugaagaagacaguggcacugugacuauaauugauuacaaaaagauauuaggcacaaucaagaugaaggcaauuuuaggagaugucaaauauaaaacauuugcugauaaugucgauauaacugcagaagggucaugcacuggcuguaucaacugcuucgagaauauccauugcgaauuaacguugcauacuacaauugaagccagcugcccaauuaaaagcucaugcacaguauuccaugacaggauucuugugacuccaagugaacacaaauaugcauuaaaaauggugugcacagaaaagccggggaacacacucacaauuaaaguuugcaauacuaagauugaagcaucuauggcccuugucgaugcaaagccuaucauagaacuagcaccaguugaucagacagcauauauaagagaaaaagaugaaagguguaaaacuuggauguguaggguaagagaugaaggacugcaagucaucuuggagccauuuaaaaauuuauuugggucuuauauugggauauuuuacacauuuauuauaucuauaauggcauuauugguuaucaucuaugugcuauugccuauaugcuuuaaguuaagagauacccuuagaaagcaugaagaugcauauaagagagagaugaaaauuagauag

SEQ ID NO: 4281 - RNA, 4326 nt, Artificial Sequence
  derived and/or modified CDS sequence (wt) from LACV(LACV/00/WV-M (WV00-3178))__GU206148.1__GP
augauucgcauacugguacugauugcaauuacagcugcaagcccaguguaucaaagguguuuccaagauggggcuauagugaagcaaaacccauccaaagaagcaguuacagaggugugccugaaagaugauguuagcaugaucaaaacagaggccagguauguaagaaaugcaacaggaguuuuuucaaacaauguugcaauaaggaaauggcuagucucugauuggcaugauugcaggccuaagaagaucauugggggacacaucaauguaauagaaguuggugaugaccugucgcuccauacugaaucauauguuugcagcucagauuguaccauagguguggacaaagagacugcgcaggucagacuucagacagauaccacaaaucauuucgaaauugcaggcaccacugugaagucaggaugguucaaaagcacgacguacauaacucuugaucaaaccugcgaacaucuuaaaguuuccugcggcccaaaaucuguacaguuccaugccuguuucaaucagcauaugucuuguguuagauuuuuacacaggacaauauugccuggcucuauagccaauuccauaugucagaauauugaaaucauaauuuuaguuacacuuacucuauuaaucuucauauuguuaagcauuuuaaguaagacauauauaugcuauuuauuaaugccuauauucauccccauagcauauauauacgguauaauuuacaauaagucguguaaaaaaugcaaacuaugcggccuaguguaucauccauuuacagaguguggcacacauugugucuguggugcucgcuaugacacuucagauagaaugaaacuucacagagcuucuggauugugcccugguuacaaaagccuaagagcugccagagucaugugcaagucgaaagggccugcaucaauauugucuauaauuacugcaguacugguccuaaccuuugugacaccaaucaacuccaugguuuugggggaaaguaaagaaacuuuugaacuugaagagcuuccagacgacauguuagaaauggcaucgaggauaaauucuuauuaucuuaccuguaucuuaaauuaugcuguaagcuggggucuuguuaucauuggguuguugaccgggcugcuauuuaagaaauaucagcacagauuuuuaaauacuuacgcaauguauugugaggaaugugacauguaucaugacaagucuggguugaaaagacauggugauuucaccaacaaaugcaggcaguguacauguggucaauaugaagaugccgcaggguugaugacccacaggaaaaccuacaacugcuuagugcaguacaaagcaaaguggaugaugaauuuccugauaauuuacauauucuuaauuuuaaucaaagauucugcuauaauuguacaagcugcuggaacugauuucaccaccugccuagagacugaaaguauaaauuggaacuguacugggccauuuuugaaccucgggaauugucaaaaacaacaaaagaaagaaccuuacaccaacauugcaacccaguugaagggguuaaaggcaauuucugugcuagauaucccuauaauaacagggauuccggaugauauugcaggugcuuuaagauauauagaagagagggaagauuuccauguccagcuaacuacagaauaugcaaugcugagcagguacugugacuauuacacccaauucucagacaacucaagauacagccagacaacguggagaguguacuuaaggucucaugauuuugaggcauguauacuauauccaaaucagcauuuuugcagaugugugaaaaauggugagaagugcagcagcuccaauugggacuuugccaaugaaaugaaggauuauuacucugggaaacaaacaaaguuugauaaagacuuaaaucuagcccuaacagcuuugcaccaugccuucagggggaccucaucugcauauauagcaacaaugcucucaaaaaaguccaaugacgacuugauuacauacacaaauaagauaaaaacaaaauucccagguaaugcauuguugaaggcuauaauagauuauauagcauauaugaaaaguuugccagguauggcaaauuucaaauaugaugaguuuugggaugaauuauuguacaaacccaacccagcaaagaccucaaaccuugcuagaggaaaagagucaacuuacaacuucaaacuagcaauuucaucaaaaucuauaaaaaccugcaagaauguuaaggauguugccugccuaucgccgaggucaggugcuauauaugcuucaauaauugcguguggugaaccuaaugggccaaguguguauagaaaaccaucaggugguguauuccaaucuaguacugaucggucuauauacugcuuacuagauagccauugucuagaggaguuugaggcuaucagucaggaagagcuggaugcaguaaaaaaaucuaaauguugggagacugaauauccugaggugaaaccccuccaagaaagugaugggacuaaaagcugcagaaugaaagauucugggaacugcaacguugcaacuaacagauggccaguaauacaaugcgagaaugauaaauuuuacuacucagagcuucaaaaagauuaugacaaaacucaagauauuggucauuauugcuuaagcccuggauguacuacuguuagauacccuauuaauccaaagcauaucuccaacuguaauuggcagguaagcagauccagcauagcgaagauagaugugcacaauauugaagacauugaacaauauaagaaggcuauaacucaaaaacuucaaacaagccuaucucuauuuaaguaugcaaaaacaaaaaacuugccgcauaucaaaccaauuuauaaauauauaacuauagaaggaacagaaacugcagaagguauagagagugcauacauugaaucagaggugccugcauuggcugggacaucuaucggguucaaaaucaauucuaaagagggcaagcacuugcuagauguuauagcauauguaaaaagcgccucauacucuucaguauaugcaaaauuguauucaacuggcccaacaucagggauaaauacuaaacaugaugaauuguguacuggcccaugcccagcaaauaucaaucaucaaauuggguggcuaacauuugcaaaagagaggacaagcucauggggaugcgaagaguucgguugccuggcuguaagugauggguguguauuugggucaugccaagauauaauaaaagaagaacuaucugucuauaggaaagagaccgaagaagugacugauguagaacuauguuuaacauuuucagacaaaacauauuguacaaacuuaaacccuguuaccccuauuauaacagaucuauucgagguacaguucaaaacuguggagacuuacagcuuacccagaauuguugcugugcaaaaccaugaaauuaaaauugggcaaauaaaugaccuagggguuuacucuaaggguuguggaaauguucaaaaggucaauggaacuguuuaugguaauggaguucccagauuugauuacuuaugccauuuagcuagcagaaaggaagucauuguuagaaaaugcuucgacaaugauuaccaagcaugcaaauuucuucaaagcccugcuaguuacagacuugaagaagacaguggcacugugacuauaauugacuacaagaagauauuaggcacaaucaagaugaaggcaauuuuaggagaugucaaauacaaaacauuugcugaaagugucgauauaacugcagaagggucaugcacuggcuguaucaauugcuuugagaauauccauugugaauuaacguugcauaccacaauugaagccagcugcccaauuaaaagcucaugcacaguauuucaugacaggauucuugugacuccaaaugaacacaaauaugcauuaaaaauggugugcacagaaagaccggggaauacacucacaauuaagguuugcaauacuaagauugaggcuucaaugacccuugucgaugcaaagccuaucauagaacuagcaccaguugaucaaacagcauacauaagagaaaaagaugaaagguguaaaacuuggauguguaggguaagagacgaaggacugcaagucaucuuggagccauuuaaaaauuuauuuggaucuuauauugggauauuuuauacauucauuauaucuauaguggcauuauugguuaucaucuaugugcuauugccuauaugcuuuaaguuaagagacacacuuagaaagcaugaagaugcauauaagagagaaaugaaaauuagguag

SEQ ID NO: 4282 - RNA, 4326 nt, Artificial Sequence
  derived and/or modified CDS sequence (wt) from LACV(LACV/03/NY-M (41030016))__GU206130.1__GP
augauuuacauacuggugcuaauugcaguuacggcugcaaguccaguguaucaaagguguuuccaagauggggcuauagugaagcaaaacccauccaaagaggcagucacagaggugugccuaaaagaugaugucagcaugaucaaaacagaggccagauacauaagaaaugcaacaggggucuuuucaaacaauguugcaauaaggaaauggcuggucucugauuggcacgacugcaggcccaaaaaaauuguugggggacauauuaauguaauagagguaggugaugaucugucacuucacacugagucauauguuugcagcgcagacuguacuauagguguggauaaagaaacugcgcaaguuagacuucaaacagacacuacaaaucauuuugagauugcaggcacuacugugaagucaggaugguucaaaaguacaacauauauuacucuugaucaaacuugugaacaucucaaaguuuccugcgguccgaaauccauacaauuccaugcuuguuuuaaccagcacauguccuguguuagauuuuuacauagaacaauacugccugguucuauagcuaacuccauaugucaaaauauugagaucauaauuuuagucacacucacucuauuaaucuucauauuauuaaguauccuaagcaagacuuauauauguuaccuauugaugccuguauuuauuccuauagcauauguguaugguaucauuuacaauaagucguguaaaaaaugcaaacuauguggcuugguauaccacccauuuacagaguguggcacacauuguguuugcggugcucgcuaugauacuucugauagaaugaaacugcauagagcuucugggcuauguccugguuauaaaagcuuaagagcugccaggguuaugugcaaaucaaaagggccugcaucaauauuaucuauaauuacugcaguauugguuuuaaccuuuguaacaccgaucaauucuaugguccugggggagaguaaagaggucuucgagcuggaggagcuuccagaugauauguuggaaauggcacugaggauaaauuuuuacuauuucaccugcauucuaaauuaugcugugagcuggagucuuguuaucauuggucuacugacugggcuacuauucaaaagguaccagcauaaguuuuugaauauuuaugcaauguauugugaagaaugcgauauguaucaugacaaaucugggcugaaacggcauggugacuucacuaauaagugcaggcaauguacaugcggccaauaugaggaugcaacaggguugaugacccauaggaaaaccuacaauugccuagugcaauauaaagcaaaauggauaaugaacuuccugauaauuuacauauuuuugguauuaauaaaggauucugcuauaaucgugcaagcugcugggacugacuuuagcuccugcuuagaaaccgaaaguauaaauuggaauugcaccgggccguucuugaaucucgggaauugucagaaacaacaaaagaaggagcccuauacuaacaucgcagcucaguugaaagggcugagggcaauuucagugcuugauauuccuaugauaacagagauuccagaugauauugcaagugccuuaagauauauagaagaaagggaggccuuccacguccaauugacugcagaauaugcaauguugacuagguacugugauuauuacacccaauuuucagacaauucaggauacagccaaacaacauggagaguguacuuaagaucccaugauuuugaggcauguauaauguauccgaaccagcacuucugcagguguguaaaaaauggugagaagugcagcagcuccaauugggauuuugccaacgaaaugaaggauuauuacuccgggaaacaagcaaaguuugacaaagauuuaaaucuggcucuaacagcuuugcaccaugcuuuuaggggaacuucaucugcauacauagcagcaaugcuuucaaaaaaaucaaacgaugacuugauuacauauacaaacaagauaaagacaaaguuuccagguaaugcauuacuaaaggcuauaauagauuauauagcauacaugaagggccuaccggguauggcaagcuuuaaacaugacgaguuuugggaugaauuauuauacaaaccuacaccaacaaaggccccgaaucuugcuagagggagagagucaucuuauaauuucaagcuagcaauuucaucaaaguccauaaaaaccugcaaaaauguuaaagauguugcuugcuuaucaccuagaucaggugccauauaugcuucaauaauagcauguggcgaaccuaauggaccaaguguauauagaaaaccaucaaacgguguauuucaaucuagcacugaucaauccauguauugucuuuuagauagccauugcuuagaagaauuugaggcuauuagccaagaagaauuggaugcagugaaaaaguccaaauguugggagauagaauacccugacauaaagccucuucaagaaagugaugggaccaaaagcugcagaaugaaggauucugggaauugcaauguugcaaccaacagauggccaguaauacaaugugagaaugauaaauucuacuacucagaacuccagaaagauuaugauaagacucaagauaucggccauuacugcuugaguccugggugcacuaccguucgcuaucccaucaauccaaagcauaucucuaauugcaauuggcaggugaguagaucuagcauagcgaaaauagaugugcauaauauugaagauauugagcaauacaaaaaagcuauaacucaaaaacuccaaacaagucugucccuuuuuaaauaugcuaaaacaaagaacuugccacacaucaaaccaauuuauaaguauauaaccauagaagggacugaaacugcagaaggaauagagagcgcauacaucgagucagaaguaccugcguuagcuggaacaucaauuggauucaaaaucaacuccaaagaggguaagcacuuacuagauguuauagcauauguaaaaagugccucauauucuucaguuuacacaaaguuauacucaacuggaccaacaucaggcauaaauacgaaacaugaugaauugugcacuggaccauguccagcaaacauuaaucaucagguuggauggcucacauuugcaaaggaaaggacaagcucauggggcugugaggaguuugguugccuggcuguaagugauggauguguauuugguucaugccaagauauaauaaaagaagagcuauccgucuauaggaaggagacugaagaagugacugauguagaauuauguuuaacauuuucugacaaaacauauuguacaaacuuaaauccugucaccccuauuauaacagaucuguuugaaguacaauucaaaacuguggagacuuacagcuuaccuagaauugucgcugugcagaaucaugagaucaagauuggacaaauaaaugauuuagggguauauucuaaaggaugcggaaacguucaaaaaguuaaugggacuguuuauggcaaugggguuccuagauucgauuauuuaugccauuuagcuaguagaaaagaagucauugucagaaaauguuuugacaaugacuaucaagcauguaaauuccuccagaguccugccaguuacagacuugaggaggauagugggacuguaacuguaauugauuauaaaaaaauacuaggcacaauuaagaugaaggcaauauugggagauguuaaauacaaaacguuugcugacaauguugacauaacugcagaaggaucgugcacuggcugcaucaauuguuuugaaaacauucacugugaauuaacauugcauacaacaauugaggcuaguugcccgauuaaaagcucaugcacaguauuccaugacaggauacuugugacuccaaaugagcauaaguaugcauuaaaaguagugugcacagaaaagccaggaaauacacuaacaaucaagguuuguaacacaaagauugaagcuucaauggcucuuguugaugcaaaaccuaucauagaauuggcaccaguugaccagacggcauauauaagggaaaaagaugaaagauguaaaacauggaugugcagaguaagagaugaaggauuacaaguuauccuagagccauuuaaaaauuuauuugguuccuauauugggauauuuuacacauuuauaauauccauaguagcauuauuagucaucaucuacaucuuauugccuauauguuucaagcuaagagauacccuuaggaagcaugaagaugcauauaagagagagaugaaaauuagauag

SEQ ID NO: 4283 - RNA, 4326 nt, Artificial Sequence
  derived and/or modified CDS sequence (wt) from LACV(LACV/06/NY(1)-M (06MS2900303))__GU206118.1__GP
augaucuacauacuggugcuaauugcaguuacggcugcaaguccgguguaucaaagguguuuccaagauggggcuauagugaagcaaaacccauccaaagaggcagucacagaagugugccuaaaagaugaugucagcaugaucaaaacagaggccagauauauaagaaaugcaacaggaguuuuuucaaacaauguugcaauaaggaaauggcuggucucugauuggcacgacugcaggcccaaaaaaauuguugggggacauauuaauguaauagagguuggugaugaucugucacuccacacugagucauauguuugcagcgcagauuguacuauagguguagacaaggaaacugcgcaaguuaggcuucaaacagacacuacaaaucauuuugagauugcaggcacuacugugaagucaggaugguucaaaagcacaacauauauuacucuugaucaaacuugugaacaucucaaaguuuccugcgguccgaaaucuauacaauuccaugcuuguuuuaaccaacacauguccuguguuagauuuuuacauagaacgauacugccugguucuauagccaauuccauaugucagaauauugagaucauaauuuuagucacacucgcucuauuaaucuuuauauuauuaaguaucuuaagcaagacuuauauauguuacuuauuaaugccuguauucauuccuauagcauauguguauggugucauuuauaauaagucguguaaaaaaugcaaacuauguggucuaguuuaccacccauuuacagaguguggcacacauuguguuugcggugcucgcuaugauacuucugauagaaugaaacugcauagagcuucugggcuauguccugguuauaaaagcuuaagagcugccagaguuaugugcaaaucaaaagggccugcaucaauauugucuauaauuacugcaguguuggucuuaaccuuugucacaccgaucaauuccauggucuugggggaaaguaaagaggucuucgagcuugaggagcuuccagaugauaugcuggaaauggcacugaggauaaauuuuuacuauuucaccugcauucuaaauuaugcugugagcuggagucuuguuaucauuggccuacugacugggcuacuauucaaaagguaccagcauaaguuuuuaaauauuuaugcaauguauugugaagaaugcgauauguaccaugacaaaucugggcugaaacgacauggugacuucacuaauaagugcaggcaaugcacaugcggccaauaugaggaugcaacgggguugaugacccauaggaaaaccuacaauugccuagugcaauauaaagcgaaauggauaaugaauuuccugauaaucuacauauuuuugguauuaauaaaggauucugcuauaaucgugcaagcugcuggaaccgacuuuagcuccugcuuagaaaccgaaaguauaaauuggaauugcaccgggccauucuugaaucucgggaauugucaaaaacaacaaaagaaggagcccuaugcuaacaucgcagcucagcuaaaagggcugaaggcaauuucagugcuugauauuccuaugauaacagaaaucccagaugauauugcaagugcuuuaagauauauagaagagagggaggcuuuccacguccaauugacugcagaauaugcaauguugacuagguacugugauuauuauacccaauuuucagacaauucaggguacagccaaacaacauggagaguguacuugagaucccaugacuuugaggcguguauaauguauccaaaccagcacuuuugcagauguguaaaaaauggugagaagugcagcagcuccaauugggauuuugccaacggaaugaaggacuauuacuccggaaaacaagcaaaguuugacaaagauuugaaucuggcucuaacagcucugcaccaugcuuuuaggggaacuucaucugcauacauagcaacaaugcuuucaaaaaaaucaaacgaugacuugauugcauauacaaacaagauaaagacaaaguucccaggcaaugcauuacuaaaagcuauaauagauuauauagcauacaugaagggcuuaccagguauggcaaacuuuaaacaugacgaguuuugggaugaauuauuguacaaaccuacaccaacaaaggccccgaaucuugcuagagggagagaaucaucuuauaauuucaagcuagcaauuucaucaaaguccauaaaaaccugcaaaaauguuaaagauguugcuugcuuaucacccagaucaggugccauauaugcuucaauaauagcauguggcgaaccuaauggaccaaguguauauagaaaaccauuaaaugguguauuucaaucuaguacugaccaaucaauguauugucuguuagacagccauugcuuagaagaauuugaggcuaucagccaagaagaauuggaugcagugaaaaaguccaaauguugggagauagaauacucugacauaaagccucuucaagaaagugauggaaccaaaagcugcagaaugaaggauucuggaaauugcaauguugcaaccaacagauggccagugauacaaugugaaaaugauaaauucuacuauucagaacuccagaaagauuaugauaagacucaagauauuggccauuacugcuuaaguccugggugcacuacuguucgcuaccccaucaauccaaagcauaucucuaauugcaauuggcagguaaguagaucuagcauagcgaaaauagaugugcauaauauugaagauauugagcaguacaaaaaagcuauaacucaaaaacuccaaacaagucugucccuuuuuaaauaugcuaaaacaaagaacuugccacacaucaaaccaauuuauaaguauauaaccauagaagggaccgaaacugcagaaggaauagagagcgcauacaucgagucagaaguaccugcauuagcuggaacaucaauuggauucaaaaucaacuccaaagaggguaagcacuuacuagauguuauagcauauguaaaaagugccucauauucuucaguguacacaaaguuauacucaacuggaccaacaucaggcauaaauacgaaacaugaugaauugugcaccggaccauguccagcaaacauuaaucaucagguuggauggcucacauuugcaaaggagaggacaagcucauggggcugugaagaguuugguugccuggcuguaagugauggauguguauuugguucgugccaagauauaauaaaagaagagcuauccgucuauaggaaagaaacugaagaagugacugauguagaauuaugcuuaacauuuucugacaaaacauauuguacaaacuuaaacccagucacuccuaucauaacagaccuguuugagguacaguucaagacuguagagacuuacagcuuaccuagaauugucgcuguacagaaucaugagaucaagauuggacaaauaaaugauuuagggguauauucuaaaggaugcggaaauguucaaaaagucaaugggacuguuuauggcaauggaguuccuagauucgauuauuuaugccauuuagcuaguagaaaagaagucauuguuagaaaauguuuugacaaugauuaucaggcauguaaauuccuccagaguccugccaguuacagacuugaggaggauagugggacuguaacuguaaucgauuauaaaaaaauacuagguacaauuaagaugaaggcaauauugggagauguuaaauacaaaacguuugcugauaauguugacauaacugcagaaggaucaugcacuggcugcaucaauuguuuugaaaacauucacugugaauuaacauugcauaccacaauugaggcuaguugcccgauuaaaagcucaugcacaguguuccaugacaggauacucgugacuccaaaugagcauaaguaugcauuaaaaguaguaugcacagaaaagccaggaaauacacuaacaaucaagguuuguaacacuaagauugaagcuucaauggcccucguugaugcaaaaccuaucauagaauuagcaccaguugaccaaacggcauauauaagggaaaaagacgaaagauguaagacuuggaugugcagaguaagagaugaaggauuacaaguuaucuuagagccauuuaaaaauuuauuugguuccuauauugggauauuuuacacauuuauaauaucuauaguaacauuauuggucaucauuuauaucuuauugccuauauguuucaagguaagagauacucuuaggaagcaugaagaugcauauaagagagagaugaaaauuagauag

SEQ ID NO: 4284 - RNA, 4326 nt, Artificial Sequence
  derived and/or modified CDS sequence (wt) from LACV(LACV/06/NY(2)-M (06MS350140))__GU206109.1__GP
augaucuacauacuggugcuaauugcaguuacggcugcaaguccgguguaucaaagguguuuccaagauggggcuauagugaagcaaaacccauccaaagaggcagucacagaagugugccuaaaagaugaugucagcaugaucaaaacagaggccagauauauaagaaaugcaacaggaguuuuuucaaacaauguugcaauaaggaaauggcuggucucugauuggcacgacugcaggcccaaaaaaauuguugggggacauauuaauguaauagagguuggugaugaucugucacuccacacugagucauauguuugcagcgcagauuguacuauagguguagacaaggaaacugcgcaaguuaggcuucaaacagacacuacaaaucauuuugagauugcaggcacuacugugaagucaggaugguucaaaagcacaacauauauuacucuugaucaaacuugugaacaucucaaaguuuccugcgguccgaaaucuauacaauuccaugcuuguuuuaaccaacacauguccuguguuagauuuuuacauagaacgauacugccugguucuauagccaauuccauaugucagaauauugagaucauaauuuuagucacacucgcucuauuaaucuuuauauuauuaaguaucuuaagcaagacuuauauauguuacuuauuaaugccuguauucauuccuauagcauauguguauggugucauuuauaauaagucguguaaaaaaugcaaacuauguggucuaguuuaccacccauuuacagaguguggcacacauuguguuugcggugcucgcuaugauacuucugauagaaugaaacugcauagagcuucugggcuauguccugguuauaaaagcuuaagagcugccagaguuaugugcaaaucaaaagggccugcaucaauauugucuauaauuacugcaguguuggucuuaaccuuugucacaccgaucaauuccauggucuugggggaaaguaaagaggucuucgagcuugaggagcuuccagaugauaugcuggaaauggcacugaggauaaauuuuuacuauuucaccugcauucuaaauuaugcugugagcuggagucuuguuaucauuggccuacugacugggcuacuauucaaaagguaccagcauaaguuuuuaaauauuuaugcaauguauugugaagaaugcgauauguaccaugacaaaucugggcugaaacgacauggugacuucacuaauaagugcaggcaaugcacaugcggccaauaugaggaugcaacgggguugaugacccauaggaaaaccuacaauugccuagugcaauauaaagcgaaauggauaaugaauuuccugauaaucuacauauuuuugguauuaauaaaggauucugcuauaaucgugcaagcugcuggaaccgacuuuagcuccugcuuagaaaccgaaaguauaaauuggaauugcaccgggccauucuugaaucucgggaauugucaaaaacaacaaaagaaggagcccuaugcuaacaucgcagcucagcuaaaagggcugaaggcaauuucagugcuugauauuccuaugauaacagagaucccagaugauauugcaagugcuuuaagauauauagaagagagggaggcuuuccacguccaauugacugcagaauaugcaauguugacuagguacugugauuauuauacccaauuuucagacaauucaggguacagccaaacaacauggagaguguacuugagaucccaugacuuugaggcguguauaauguauccaaaccagcacuuuugcagauguguaaaaaauggugagaagugcagcagcuccaauugggauuuugccaacgaaaugaaggacuauuacuccggaaaacaagcaaaguuugacaaagauuugaaucuggcucuaacagcucugcaccaugcuuuuaggggaacuucaucugcauacauagcaacaaugcuuucaaaaaaaucaaacgaugacuugauugcauauacaaacaagauaaagacaaaguucccaggcaaugcauuacuaaaagcuauaauagauuauauagcauacaugaagggcuuaccagguauggcaaacuuuaaacaugacgaguuuugggaugaauuauuguacaaaccuacaccaacaaaggccccgaaucuugcuagagggagagaaucaucuuauaauuucaagcuagcaauuucaucaaaguccauaaaaaccugcaaaaauguuaaagauguugcuugcuuaucacccagaucaggugccauauaugcuucaauaauagcauguggcgaaccuaauggaccaaguguauauagaaaaccauuaaaugguguauuucaaucuaguacugaccaaucaauguauugucuguuagacagccauugcuuagaagaauuugaagcuauuagccaagaagaauuggaugcagugaaaaaguccaaauguugggagauagaauacccugacauaaagccucuucaagaaagugauggaaccaaaagcugcagaaugaaggauucuggaaauugcaauguugcaaccaacagauggccagugauacaaugugaaaaugauaaauucuacuauucagaacuccagaaagauuaugauaagacucaagauauuggccauuacugcuuaaguccugggugcacuacuguucgcuaccccaucaauccaaagcauaucucuaauugcaauuggcagguaaguagaucuagcauagcgaaaauagaugugcauaauauugaagauauugagcaguacaaaaaagcuauaacucaaaaacuccaaacaagucugucccuuuuuaaauaugcuaaaacaaagaacuugccacacaucaaaccaauuuauaaguauauaaccauagaagggaccgaaacugcagaaggaauagagagcgcauacaucgagucagaaguaccugcauuagcuggaacaucaauuggauucaaaaucaacuccaaagaggguaagcacuuacuagauguuauagcauauguaaaaagugccucauauucuucaguguacacaaaguuauacucaacuggaccaacaucaggcauaaauacgaaacaugaugaauugugcaccggaccauguccagcaaacauuaaucaucagguuggauggcucacauuugcaaaggagaggacaagcucauggggcugugaagaguuugguugccuggcuguaagugauggauguguauuugguucgugccaagauauaauaaaagaagagcuauccgucuauaggaaagaaacugaagaagugacugauguagaauuaugcuuaacauuuucugacaaaacauauuguacaaacuuaaacccagucacuccuaucauaacagaccuguuugagguacaguucaagacuguagagacuuacagcuuaccuagaauugucgcuguacagaaucaugagaucaagauuggacaaauaaaugauuuagggguauauucuaaaggaugcggaaauguucaaaaagucaaugggacuguuuauggcaauggaguuccuagauucgauuauuuaugccauuuagcuaguagaaaagaagucauuguuagaaaauguuuugacaaugauuaucaggcauguaaauuccuccagaguccugccaguuacagacuugaggaggauagugggacuguaacuguaaucgauuauaaaaaaauacuagguacaauuaagaugaaggcaauauugggagauguuaaauacaaaacguuugcugauaauguugacauaacugcagaaggaucaugcacuggcugcaucaauuguuuugaaaacauucacugugaauuaacauugcauaccacaauugaggcuaguugcccgauuaaaagcucaugcacaguguuccaugacaggauacucgugacuccaaaugagcauaaguaugcauuaaaaguaguaugcacagaaaagccaggaaauacacuaacaaucaagguuuguaacacuaagauugaagcuucaauggcccucguugaugcaaaaccuaucauagaauuagcaccaguugaccaaacggcauauauaagggaaaaagacgaaagauguaagacuuggaugugcagaguaagagaugaaggauuacaaguuaucuuagagccauuuaaaaauuuauuugguuccuauauugggauauuuuacacauuuauaauaucuauaguaacauuauuggucaucauuuauaucuuauugccuauauguuucaagcuaagagauacucuuaggaagcaugaagaugcauauaagagagagaugaaaauuagauag

SEQ ID NO: 4285 - RNA, 4326 nt, Artificial Sequence
  derived and/or modified CDS sequence (wt) from LACV(LACV/06/NY(3)-M (06MS270036))__GU206121.1__GP
augaucuacauacuggugcuaauugcaguuacggcugcaaguccgguguaucaaagguguuuccaagauggggcuauagugaagcaaaacccauccaaagaggcagucacagaagugugccuaaaagaugaugucagcaugaucaaaacagaggccagauauauaagaaaugcaacaggaguuuuuucaaacaauguugcaauaaggaaauggcuggucucugauuggcacgacugcaggcccaaaaaaauuguugggggacauauuaauguaauagagguuggugaugaucugucacuccacacugagucauauguuugcagcgcagauuguacuauagguguagacaaggaaacugcgcaaguuaggcuucaaacagacacuacaaaucauuuugagauugcaggcacuacugugaagucaggaugguucaaaagcacaacauauauuacucuugaucaaacuugugaacaucucaaaguuuccugcgguccgaaaucuauacaauuccaugcuuguuuuaaccaacacauguccuguguuagauuuuuacauagaacgauacugccugguucuauagccaauuccauaugucagaauauugagaucauaauuuuagucacacucgcucuauuaaucuuuauauuauuaaguaucuuaagcaagacuuauauauguuacuuauuaaugccuguauucauuccuauagcauauguguauggugucauuuauaauaagucguguaaaaaaugcaaacuauguggucuaguuuaccacccauuuacagaguguggcacacauuguguuugcggugcucgcuaugauacuucugauagaaugaaacugcauagagcuucugggcuauguccugguuauaaaagcuuaagagcugccagaguuaugugcaaaucaaaagggccugcaucaauauugucuauaauuacugcaguguuggucuuaaccuuugucacaccgaucaauuccauggucuugggggaaaguaaagaggucuucgagcuugaggagcuuccagaugauaugcuggaaauggcacugaggauaaauuuuuacuauuucaccugcauucuaaauuaugcugugagcuggagucuuguuaucauuggccuacugacugggcuacuauucaaaagguaccagcauaaguuuuuaaauauuuaugcaauguauugugaagaaugcgauauguaccaugacaaaucugggcugaaacgacauggugacuucacuaauaagugcaggcaaugcacaugcggccaauaugaggaugcaacgggguugaugacccauaggaaaaccuacaauugccuagugcaauauaaagcgaaauggauaaugaauuuccugauaaucuacauauuuuugguauuaauaaaggauucugcuauaaucgugcaagcugcaggaaccgacuuuagcuccugcuuagaaaccgaaaguauaaauuggaauugcaccgggccauucuugaaucucgggaauugucaaaaacaacaaaagaaggagcccuaugcuaacaucgcagcucagcuaaaagggcugaaggcaauuucagugcuugauauuccuaugauaacagagaucccagaugauauugcaagugcuuuaagauauauagaagagagggaggcuuuccacguccaauugacugcagaauaugcaauguugacuagguacugugauuauuauacccaauuuucagacaauucaggguacagccaaacaacauggagaguguacuugagaucccaugacuuugaggcguguauaauguauccaaaccagcacuuuugcagauguguaaaaaauggugagaagugcagcagcuccaauugggauuuugccaacggaaugaaggacuauuacuccggaaaacaagcaaaguuugacaaagauuugaaucuggcucuaacagcucugcaccaugcuuuuaggggaacuucaucugcauacauagcaacaaugcuuucaaaaaaaucaaacgaugacuugauugcauauacaaacaagauaaagacaaaguucccaggcaaugcauuacuaaaagcuauaauagauuauauagcauacaugaagggcuuaccagguauggcaaacuuuaaacaugacgaguuuugggaugaauuauuguacaaaccuacaccaacaaaggccccgaaucuugcuagagggagagaaucaucuuauaauuucaagcuagcaauuucaucaaaguccauaaaaaccugcaaaaauguuaaagauguugcuugcuuaucacccagaucaggugccauauaugcuucaauaauagcauguggcgaaccuaauggaccaaguguauauagaaaaccauuaaaugguguauuucaaucuaguacugaccaaucaauguauugucuguuagacagccauugcuuagaagaauuugaagcuauuagccaagaagaauuggaugcagugaaaaaguccaaauguugggagauagaauacucugacauaaagccucuucaagaaagugauggaaccaaaagcugcagaaugaaggauucuggaaauugcaauguugcaaccaacagauggccagugauacaaugugaaaaugauaaauucuacuauucagaacuccagaaagauuaugauaagacucaagauauuggccauuacugcuuaaguccugggugcacuacuguucgcuaccccaucaauccaaagcauaucucuaauugcaauuggcagguaaguagaucuagcauagcgaaaauagaugugcauaauauugaagauauugagcaguacaaaaaagcuauaacucaaaaacuccaaacaagucugucccuuuuuaaauaugcuaaaacaaagaacuugccacacaucaaaccaauuuauaaguauauaaccauagaagggaccgaaacugcagaaggaauagagagcgcauacaucgagucagaaguaccugcauuagcuggaacaucaauuggauucaaaaucaacuccaaagaggguaagcacuuacuagauguuauagcauauguaaaaagugccucauauucuucaguguacacaaaguuauacucaacuggaccaacaucaggcauaaauacgaaacaugaugaauugugcaccggaccauguccagcaaacauuaaucaucagguuggauggcucacauuugcaaaggagaggacaagcucauggggcugugaagaguuugguugccuggcuguaagugauggauguguauuugguucgugccaagauauaauaaaagaagagcuauccgucuauaggaaagaaacugaagaagugacugauguagaauuaugcuuaacauuuucugacaaaacauauuguacaaacuuaaacccagucacuccuaucauaacagaccuguuugagguacaguucaagacuguagagacuuacagcuuaccuagaauugucgcuguacagaaucaugagaucaagauuggacaaauaaaugauuuagggguauauucuaaaggaugcggaaauguucaaaaagucaaugggacuguuuauggcaauggaguuccuagauucgauuauuuaugccauuuagcuaguagaaaagaagucauuguuagaaaauguuuugacaaugauuaucaggcauguaaauuccuccagaguccugccaguuacagacuugaggaggauagugggacuguaacuguaaucgauuauaaaaaaauacuagguacaauuaagaugaaggcaauauugggagauguuaaauacaaaacguuugcugauaauguugacauaacugcagaaggaucaugcacuggcugcaucaauuguuuugaaaacauucacugugaauuaacauugcauaccacaauugaggcuaguugcccgauuaaaagcucaugcacaguguuccaugacaggauacucgugacuccaaaugagcauaaguaugcauuaaaaguaguaugcacagaaaagccaggaaauacacuaacaaucaagguuuguaacacuaagauugaagcuucaauggcccucguugaugcaaaaccuaucauagaauuagcaccaguugaccaaacggcauauauaagggaaaaagacgaaagauguaagacuuggaugugcagaguaagagaugaaggauuacaaguuaucuuagagccauuuaaaaauuuauuugguuccuauauugggauauuuuacacauuuauaauaucuauaguaacauuauuggucaucauuuauaucuuauugccuauauguuucaagcuaagagauacucuuaggaagcaugaagaugcauauaagagagagaugaaaauuagauag

SEQ ID NO: 4286 - RNA, 4326 nt, Artificial Sequence
  derived and/or modified CDS sequence (wt) from LACV(LACV/65/OH-M (W17258))__GU206124.1__GP
augauucgcauacuggugcugauugcaguuacagcugcaaacccaguguaucaaagguguuuccaagauggggcuauagugaagcaaaacccauccaaagaagcagucacagaagugugccugaaagaugauguuagcaugaucaaaacagaagccagguauauaagaaaugcaacagggguuuuuucaaacaauguugcaauaaggaaauggcuagucucugauuggcaugauugcaggccuaagaagaucauugggggacacaucaaugugauagaaguuggugaugaccuaucgcugcauacugaaucauauguuugcagcgcagauuguacaauagguguagacaaagagacugcgcaggucagacuucagacagauacuacaaaucauuuugaaauugcagguacuacugugaagucaggaugguucaaaagcacgacauauauaacucuugaucaaaccugcgaacaccuuaaaguuuccuguggcccaaaaucuguacaauuccaugccugcuucaaucagcauaugucuugcgucagauuuuuacacagaacaguauugccuggcuccauugccaauuccauaugucagaauauugaaaucauaauuuuaguuacacuuacucuauuaaucuuuauauuguuaaguauuuuaaguaagacuuauauauguuauuuauuaaugccuauauuuauccccauagcauauguauacgguauaauuuauaauaagucgugcaaaaaaugcaaacuaugcggccuaguguaucauccauucacagaguguggcacacauugugucuguggugcccgcuaugauacuucagauagaaugaaacugcacagagcuucuggauugugcccugguuauaaaagccuaagagcugccagaguuaugugcaagucgaaagggccugcaucaauauuaucuauaauuacugcaguacuggucuuaaccuuuguaacaccaaucaacucuaugguuuuaggggaaaguaaagaaacguuugaacuugaagagcuuccagaugacauguuggaaauggcaucgaggauagauucuuauuauuucaccugcaucuugaauuaugcuguaagcuggggucuuguuaucauuggguuguugaccggacugcuauuuaagaaauaccaacacagauuuuuaaauguuuaugcaauguacugugaggaaugugacauguaucaugacaagucuggguugaaaagacauggugacuucaccaacaaaugcaggcaguguacauguggccaauaugaagaugccacaggcuugauggcccacaggaaaaccuauaacugcuuagugcaguacaaagcaaaguggaugaugaauuuccuaauaauuuacauauuuuuaauuuuaaucaaagauucugcuauaguuguacaagcugcuggaaccgauuucaccaccugccuagagacugagaauauaaacuggaacugcacugggccguuuuugaaccucgggaauugucaaaagcagcaaaagaaggaaccuuacaccaacauugcaacccaauuaaagggccuaaaggcaauuuccguacuagauaucccuauaauaacagggauuccggaugauauugcaggugcuuuaagauauauagaagaaaaggaagauuuccauguccagcuaacuauagaauacgcaaugcugaguaaauacugugacuauuacacccaauucucagauaacucaggauacagucagacaacauggaggguguacuuaaggucccaugauuuugaggcauguauacuauauccaaaucagcauuuuugcagaugugugaaaaauggugaaaagugcagcagcuccaauugggauuuugccaaugaaaugaaggauuuuuacucugggaaacaaacaaaguuugauaaagacuuaaaucuagcccuaacagcuuugcaucaugccuucagggggaccucaucugcauauauagcaacaaugcucucaaaaaaguccaaugaugauuugauugcauacacaaauaagauaaaaacaaaauuuccagguaaugcauuguugaaggcuauaauagauuauauagcauauaugaaaaguuuaccagguauggcaaauuucaaauaugaugaguucugggaugaauuauuguacaaacccaacccagcaaaagccucaaaccuugcuagaggaaaggagucaucuuacaacuuuaaacuagcaauuucaucaaaaucuauaaaaaccugcaagaauguuaaggaugucgccugcuuaucaccaaggucaggugcuauauaugcuucaauaauugcuugcggcgaacccaaugggccaaguguguauagaaaaccaucaggugguguauuccaaucuagcacugaucggucuauauacugcuuacuagauagccauugucuagaagaguuugaggcuaucagccaggaagagcuggaugcagugaaaaaauccaaauguugggaaauugaauauccugacguaaaaccccuccaagaaggugauggaacuaaaagcuguaggaugaaagauucugggaacugcaauguugcaacuaacagauggccagugauacaaugcgagaaugacaaauuuuauuacucagagcuucaaaaagauuaugauaaaacucaagauauuggucauuauugcuuaagcccuggauguacuacuguccgguacccuauuaauccaaagcauaucucuaacuguaauuggcagguaagcagauccaguauagcgaagauagacgugcacaauauugaagacauugaacaguauaagaaggcuauaacucaaaaacuccaaacaagccuaucucuauucaaguaugcaaaaacaaaaaacuugccacacaucaaaccaauuuauaaauauauaacuauagaaggaacagaaacugcagaagguauagagagugcauacauugaaucagaggugccugcauuagcugggacaucuaucggguucaaaaucaauucuaaagagggcaaacacuuacuagauguuauagcauauguaaaaagcgccucauacucuucaguguaugcaaaauuguacucuacuggcccaacaucaggaauaaacacuaaacaugaugaauuguguacuggcccaugcccagcgaauaucaaucaucagguuggauggcuaacauuugcaagagagaggacaaguucauggggaugugaagaauuugguugccuagcuguaagugauggguguguauuugggucaugccaagauauaauaaaagaagaacuaucugucuauaggaaggagaccgaagaagugacugauguagaacuauguuuaacauuuucagauaaaacauauuguacaaacuugaacccuguuacuccuauuauaacagaucuauuugaaguacaguucaaaacuguagagacuuacagcuugcccagaauuguugcugugcaaaaccaugagauuaagauugggcaaauaaaugaccuaggaguuuacucuaaagguuguggaaauguucaaaaggucaauggaacuguuuauggcaauggaguucccagauuugauuacuuaugccacuuagcuagcagaaaggaagucauuguuagaaaaugcuucgacaaugauuaccaggcaugcaaauuccuucaaagcccugcuaguuacagacuugaggaagacagugguacuguaacuauaauugauuacaagaagauauuaggcacaaucaagaugaaggcaauuuuaggagaugucaaauauaagacauuugcugacagugucgauauaacugcagaagggucaugcacuggcuguaucaauugcuuugagaauauucauugugaauuaacguugcauaccacaauugaagcuagcugcccaaucaaaagcucgugcacaguauuccaugacaggauucuugugacuccaaaugaacacaaauaugcauuaaaaauggugugcacagaaaagccaggaaauacacucacaauuaaaguuugcaacacuaagauugaggcaucuauggcccuugucgaugcaaagccuaucauagaacuagcaccaguugaucagacagcauacauaagagaaaaggaugaaagguguaaaacuuggauguguaggguaagagaugaaggauugcaagucauccuggagccauucaaaaauuuguuuggaucuuauauugggauauuuuacacauuuauuauaucuauaguggcauuauugguuaucaucuaugugcuauugccuauaugcuuuaaguuaagagauacccuuagaaagcaugaagaugcauauaagagagagaugaaaauuagauag

SEQ ID NO: 4287 - RNA, 4326 nt, Artificial Sequence
  derived and/or modified CDS sequence (wt) from LACV(LACV/67/NY-M (67-8109))__GU206115.1__GP
augauuuguauauuggugcuaauuacaguugcagcugcaagcccaguguaucaaagguguuuccaagauggggcuauagugaagcaaaacccauccaaagaagcaguuacagaggugugccugaaagaugauguuagcaugaucaaaacagaggccagguauguaagaaaugcaacaggaguuuuuucaaauaaugucgcaauaaggaaauggcuagucucugauuggcaugauugcaggccuaagaagaucguugggggacacaucaauguaauagaaguuggugaugaccugucacuccauacugaaucauauguuugcagcgcagauuguaccauagguguagacaaagagacugcacaggucaggcuucagacagauaccacaaaucauuuugaaauugcaggcacuacugugaagucaggaugguucaagagcacgacauauauaacucuugaucaaacuugcgaacaccuuaaaguuuccugcggcccaaaaucuguacaguuccaugccugcuucaaucagcauaugucuugcgucagauuuuuacacaggacaauauugccuggcucuauagccaauuccauaugucagaauaucgaaaucauaauuuuaguuacacuuacucuauuaaucuuuauauuguuaagcauuuuaaguaagacuuauauauguuauuuauuaaugccuauauucauccccauagcauauauauacgguacaauuuacaauaagucgugcaaaaaaugcaaauuauguggcuuaguguaucacccauucacagaguguggcacacauugugucuguggugcccgcuaugauacuucagauagaaugaaacugcauagagcuucuggauugugcccugguuauaaaagccuaagagcugccagagucaugugcaagucgaaagggccugcaucaauauugucuauaauuacugcgguacuggucuuaaccuuugugacaccaaucaacuccaugguuuuaggagagaguaaagaaaccuuugaacuugaagaucuuccagacgacauguuggaaauggcaucgagaauaaauucuuauuaucuuaccuguaucuugaauuaugcuguaagcuggggucuuguuaucauuggauuguugaucgggcugcuuuuuaagaaauaccagcacagauucuuaaauguuuacgcaauguacugugaagaaugugacauguaucaugacaagucuggguugaaaagacauggugauuucaccaacaaaugcagacagugcacauguggucaauaugaagaugcugcagguuugauggcucacaggaaaaccuauaacugcuuagugcaguacaaagcaaaguggaugaugaacuuccugauaauuuacauauucuuaauuuugaucaaagauucugcuauaguuguacaagcugcuggaacugacuucaccaccugccuagagacugagaguauaaauuggaacugcacugggccauuuuugaaccucgggaauugccaaaagcaacaaaagaaagaaccuuacaccaacauugcaacucaguuaaagggacuaaaggcaauuuccguacuagaugucccuauaauaacagggauaccagaugauauugcgggugcuuuaagauauauagaagagaaggaagauuuccauguccagcuaacuauagaauaugcgauguuaaguaaauacugugacuauuauacccaauucucagauaacucaggauacagucagacaacauggagaguguacuuaaggucucaugauuuugaagccuguauacuauauccaaaucagcacuuuugcagauguguaaaaaauggugagaagugcagcagcuccaaucgggacuuugccaaugaaaugaaagauuauuacucugggaaacaaacaaaguuugacaaggauuuaaaucuagcccuaacagcuuugcaucaugccuucagggggaccucaucugcauauauagcaacaaugcucucaaaaaaguccaaugaugacuugauugcauacacaaauaagauaaaaacaaaauucccagguaaugcauuguugaaggcuauaauagauuauauagcauauaugaaaaguuugccagguauggcaaauuucaaauaugaugaauucugggaugaauuauuguacaaacccaacccagcaaaggccucaaaccuugcuagaggaaaggagucaucuuacaacuucaaacuagcaauuucaucaaagucuauaaaaaccugcaagaauguuaaggauguugccugcuuaucgccaaggucaggugcuauauaugcuucaauaauugcguguggugaacccaaugggccaaguguguauaggaaaccaucaggugguguauuccaaucuagcacugaucagucuauauacugcuugcuggauagccauugucuagaagaauuugaggccaucggccaggaggagcuggaugcgguaaagaaauccaaauguugggaaauugaauauccugacguaaagcucauccaagaaggcgaugggacuaaaagcuguagaaugaaagauucugggaacugcaauguugcaacuaacagauggccagugauacaaugugagaaugacaaauuuuacuacucagagcuucaaaaagauuaugacaaaacucaagauauuggucacuauugcuuaagcccuggauguacuacuguccgguacccuauuaauccaaagcacaucucuaacuguaauuggcaaguaagcagaucuagcauagcgaagauagaugugcacaauauugaggauauugagcaauauaagaaagcuauaacucagaaacuucaaacaagccuaucucuauucaaguaugcaaaaacaaaaaacuugccgcacaucaaaccaauuuauaaauauauaacuauagaaggaacagaaacugcagaagguauagagagugcauacauugaaucagaaguaccugcauuggcugggacaucuaucggauucaaaaucaauucuaaagagggcaagcacuugcuagauguuauagcauauguaaaaagugccucauacucuucaguguauacaaaauuguacucaacuggcccaacaucagggauaaauacuaaacaugaugaauuguguacuggcccaugcccagcaaauaucaaucaucagguuggguggcugacauuugcaagagagaggacaagcucauggggaugcgaagaguuugguugccuggcuguaagugauggguguguauuuggaucaugccaagauauaauaaaagaagaacuaucugucuauaggaaggagaccgaggaagugacugauguagaacuguguuugacauuuucagacaaaacauacuguacaaacuuaaacccuguuaccccuauuauaacagaucuauuugagguacaguucaaaacuguagagaccuacagcuugcccagaauuguugcugugcaaaaccaugagauuaagauugggcaaauaaaugauuuaggaguuuacucuaaggguugugggaauguucaaaaggucaauggaacuauuuauggcaauggaguucccagauuugacuacuuaugccauuuagcuagcaggaaggaagucauuguuagaaaaugcuucgacaaugauuaccaagcaugcaaauuccuucaaagcccugcuaguuacagacuugaagaagacaguggcacugugaccauaauugacuacaaaaagauuuuaggaacaaucaagaugaaggcaauuuuaggagaugucaaauauaaaacauuugcugauagugucgauauaaccgcagaagggucaugcaccggcuguauuaacugcuucgaaaauauccauugcgaauuaacguugcacaccacaauugaagccagcugcccaauuaaaagcucgugcacaguauuucaugacaggauucuugugacuccaaaugaacacaaauaugcauugaaaauggugugcacagaaaagccagggaacacacucacaauuaaagucugcaauacuaaaauugaagcaucuauggcccuugucgaugcaaagccuaucauagaacuagcaccaguugaucagacagcauauauaagagaaaaagaugaaagguguaaaacuuggauguguaggguaagagaugaaggacugcaggucaucuuggagccauuuaaaaauuuauuuggaucuuauauugggauauuuuacacauuuauuauaucuauaguagcauuauugguuauuaucuauguacuacuaccuauaugcuuuaaguuaagggauacccuuagaaagcaugaagaugcauauaagagagagaugaaaauuagauag

SEQ ID NO: 4288 - RNA, 4326 nt, Artificial Sequence
  derived and/or modified CDS sequence (wt) from LACV(LACV/74/NY-M (74-32813))__GU206142.1__GP
augauucgcaugcuggugcugauuguaguuacggcugcaagcccaguguaucagagauguuuccaagauggggcuauagugaagcaaaacccauccaaagaggcagucacagaagugugccuaaaagaugauguuagcaugaucaaaacagaggccagguauguaaaaaaugcaacaggaguuuucucaaacaauguugcaauaaggaagugguuagucucugauuggcaugacugcagaccuaagaagaucguuggggggcacaucaauguaauagaaguuggugaugaccugucgcuucauacugaaucauauguuugcagugcagauuguaccauagguguagacaaggaaacagcacaggucagacuucaaacagauaccacaaaccauuuugaaauagcagguacuacugugaagucaggaugguucaaaagcacaacauauauaacucuagaucagaccugugaacaccucaaaguuuccugcggcccaaaaucuguacaguuccaugccugcuucaaucagcauauguccugugucagauucuuacacaggacaauauugccugguuccauagcuaauuccauaugucagaauauugaaaucauaauuuuaguuacacuuaccuuauuaaucuucauacuguuaagcauuuuaaguaagacuuauauauguuauuuguuaaugcccauauucauccccauagcauauauguacgguguaauuuacaauaagucaugcaaaaagugcaagcuaugcggccuaguguaucauccauucacagaguguggcacgcauugugucuguggugcucgcuaugauacuuccgauagaaugaaacuacacagagcuucuggauugugcccugguuauaaaagccuaagagcugccagagucaugugcaaaucaaaagggccugcaucaauauugucuauaauuacugcagugcugguucuaaccuuugugacaccaaucaacuccaugguuuuaggggaaaguaaggaaaccuuugaacuugaagagcuuccagacgacaugcuggaaauggcauuaaggauaaauucuuauuacuucaccuguaucuuaaauuaugcuguaagcuggggucuuauuauugcuggauuauugguuggacugauauuuaaaaaauaccagcauagguucuuaaauauuuaugcaauguacugugaagaauguaacauguaucaugacaaaucugggcugaagagacacggugacuucaccaacaaauguagacaaugcacauguggucaauaugaagaugcuacagguuugauaacucacaggaaaaccuauaacuguuuagugcaguacaaagcaaaguggaugaugaauuuccuaauaauuuacauauucuuaauuuugaucaaagauucugccauaguuguacaagcuacugggacagauuucaccaccugccuagagacugagaguauaaauuggaacugcacugggccauuccuaaaccuuggaaacugccaaaagcaacaaaagaaagaaccuuacacaaauauugcaacccagcuaaaagggcuaaaagcaauuuccguacuagauaucccuauaauuacgaguaucccagacgacauugcaggugcuuuaagauauauagaggaaaaggaagauuuccauguccaacuaacuacagaauaugcaaugcugaguaaguacugugacuauuauacccaguucucagauaacucaggauauagucaaacaacauggagaguauacuugagaucucaugauuuugaggcaugcauacuauauccaaaucagcauuucugcaagugugugaaaaauggugaaaaguguagcagcuccaauugggacuuugccaaugaaaugaagaauuauuacucugggaaacaagcaaaauuugauaaagauuuaaaccuagcucuaacagcuuugcaucaugccuucagagggaccucaucugcauauauagcagcaaugcucucaaagaaguccaaugaugauuugauugcauauacaaauaagauaaaagcaaaauuuccagguaaugcacuauugaaggcuauaauagauuauauagcauacaugaaagguuugccagaaauggcaaauuucaaauaugacgaguucugggaugaauuauuguacaaaccuaacccagcaaaagccucaaaucuugcuaggggaaaagagucauccuacaacuucaaguuagcaauuucgucaaaaucuauaaaaaccuguaagaauguuaaggauguugccugcuuaucaccaaggucaggugcuauauacucuucaauaauugcaugcggugaacccaacgggccaaguguguauagaaaaccaucaggugguguauuucaauccaguacugaccggucuauauauuguuugcuagacagccauugucuagaggaguuugaggcuaucagucaagaggaacuggaugcaguaaaaaaauccaaguguugggagauugaauauccugacguaagaccccuccaagaaagugacggggcuaaaagcuguagaaugaaagauucugggaauuguaauguugcaacuaacagauggccaguaaugcaaugcgagaaugacaaauuuuauuauucagaacuucaaaaagauuaugacaaaacucaagauauuggucauuauugcuuaagcccuggauguaccacuauccgguacccuauuaauccaaagcauaucucuaauuguaauuggcagguaagcagauccagcauagcaaagauagacguacauaauguugaagauauugaacaauauaaaaaggcuauaacccaaaagcuucaaacaagcuugucucuauucaaguaugcaaaaacaaaaaaucugccgcacauuaagccaauuuauaaauacauaacuauagaaggaacagaaacugcagaagggauagagagcgcauauauugaaucagaagugccugcauuggcugggacaucuguuggguucaaaauuaauucuaaagagggcaaacacuugcuagauguuauagcauauguaaaaagugcaucguacucuucaguauaugcgaaauuauacucaacuggcccaacaucaggaauaaauacuaaacaugaugaauuguguacuggcccaugcccagcaaauaucaaucaucaaguuggguggcucacauuugcaagagagaggacaaguucauggggaugcgaagaguuugguugccuggcuguaagugaugggugcguguucgggucaugccaagacauaauaaaagaagaacuaucugucuauaggaaggagaccgaagaagugaccaauguugagcuauguuuaacauuuucagacaagacauauugcacaaacuuaaacccuguuaccccuauuauaacagaucuauuugagguacaguuuaaaacuguagagacuuacagcuugcccagaauuguugccgugcaaaaccaugagauuaagauugggcaaauaaaugaucuagggguuuacucuaagggaugugggaauguucaaaagguuaauggaacuguuuauggcaaugggguccccagauuugauuacuuaugucacuuagcuaguagaaaggaagucaucguuagaaaaugcuuugauaaugauuaccaagcaugcaaauuccuucaaagcccugcuaguuauagacuugaagaagacagcgguacugugacuauaauugauuauaagaaaauauuaggcacaaucaagaugaaggcaauuuuaggagaugucaaauacaaaacauuugcugacaguguugauauaacugcagaagggucgugugcuggcuguaucaauugcuuugagaauauucauugugaauuaacgcugcauaccacaauugaagccagcugcccaauuaaaaguucuugcacaguauuccaugauaggauucuuguaaccccaaaugaacacaaauaugcauuaaaaaugguaugcacagaaaagccagggaauacacucaccauuaaagucugcaauacuagaauugaagcuucaauggcccuuguugaugcaaagccuaucauagaauuagcaccaguugaucagacggcauauauaagagaaaaagaugaaagaugcaaaacuuggauguguaggguaagggaugaagggcugcagguuaucuuagagccauuuaaaaacuuguuuggaucuuauauugggauauuuuacacauuuauuauaucuauaauagcauuguugguuaucaucuauguacuacugccuauaugcuucaaauuaagggauacccuuagaaagcacgaugaugcauauaagagagagaugaaaauuagauaa

SEQ ID NO: 4289 - RNA, 4326 nt, Artificial Sequence
  derived and/or modified CDS sequence (wt) from LACV(LACV/93/MO-H)__GU206139.1__GP
augauuuguauauuggugcugauuacaguugcagcugcaagcccaguguaucaaagguguuuccaagauggggcuauagugaagcaaaacccauccaaagaagcaguuacagaggugugccugaaagaugauguuagcaugaucaaaacagaggccagguauguaagaaaugcaacaggaguuuuuucaaacaaugucgcaauaaggaaauggcuagucucugauuggcaugauugcaggccuaagaagaucguugggggacacaucaauguaauagaaguuggugacgaccugucacuccauacugaaucauauguuugcagcgcagauuguaccauagguguagacaaagagacugcacaggucaggcuucagacagauaccacaaaucauuuugaaauugcaggcacuacugugaagucaggaugguucaagagcacgacauauauaacucuugaucaaacuugcgaacaccuuaaaguuuccuguggcccaaaaucuguacaguuccaugccugcuucaaucagcauaugucuugcgucagauuuuuacacaggacaauauugccuggcucuauagccaauuccauaugucagaauaucgaaaucauaauuuuaguuacacuuacucuauuaaucuuuauauuguuaagcauuuuaaguaagacuuauauauguuauuuauuaaugccuauauucauccccauagcauauauauacgguauaauuuacaauaagucgugcaaaaaaugcaaauuauguggcuuaguguaucauccauucacagaguguggcacacauugugucuguggugcccgcuaugauacuucagauagaaugaaauugcacagagcuucuggauuaugcccugguuauaaaagccuaagagcugccagagucaugugcaagucgaaagggccugcaucaauauugucuauaauuacugcgguacuagucuuaaccuuugugacaccaaucaacuccaugguuuuaggagagaguaaagaaaccuuugaacuugaagaucuuccagacgacauguuggaaauggcaucgagaauaaauucuuauuaucucaccuguaucuugaauuaugcuguaagcuggggucuuguuaucauuggauuguugaucgggcugcuauuuaagaaauaccagcacagauucuuaaauauuuacgcaauguacugugaagaaugugacauguaucaugacaagucuggguugaaaagacauggugauuucaccaacaaaugcagacagugcacauguggucaauaugaagaugcugcagguuugauggcucacaggaaaaccuauaacugcuuagugcaguacaaagcaaaguggaugaugaacuuccugauaauuuacauauucuuaauuuugaucaaagauucugcuauaguuguacaagcugcuggaacugacuucaccaccugccuagagacugaaaguauaaauuggaacugcacugggccauuuuugaaccucgggaauugccaaaagcaacaaaagaaagaaccuuacaccaacauugcaacucaguuaaagggacuaaaggcaauuuccguacuagaugucccuauaauaacagggauaccagaugauauugcgggugcuuuaagauauauagaagagaaggaagauuuccauguccagcuaacuauagaauaugcgauguuaaguaaauacugugauuauuauacccaauucucagauaacucaggauacagucagacaacauggagaguguacuuaaggucucaugauuuugaagccuguauacuauauccaaaucagcacuuuugcagauguguaaagaauggugagaagugcagcagcuccaauuggggcuuugccaacgaaaugaaagauuauuacucugggaaacaaacaaaguuugacaaggacuuaaaucuagcccuaacagcuuugcaucaugccuucagggggaccucaucugcauauauggcaacaaugcucucaaaaaaguccaaugaugacuugauugcauacacaaauaagauaaaaacaaaauucccagguaaugcauuguugaaggcuauaauagauuauauagcauauaugaaaaguuugccagguauggcaaauuucaaauaugaugaauucugggaugaauuauuguacaaacccaacccagcaaaggccucaaaccuugcuagaggaaaggagucaucuuacaacuucaaacuagcaauuucaucaaagucuauaaaaaccugcaagaauguuaaggauguugccugcuuaucgccaaggucaggugcuauauaugccucaauaauugcguguggugaacccaaugggccaaguguguauaggaaaccaucaggugguguauuccaaucuagcacugaucggucuauauacugcuugcuggauagccauugucuagaagaauuugaggccaucggccaggaggagcuggaugcgguaaagaagucuaaauguugggaaauugaauauccugacguaaagcucauccaagaaggcgaugggacuaaaagcuguagaaugaaagauucugggaacugcaauguugcaacuaacagauggccagugauacaaugugauaaugacaaauuuuacuacucagagcuucaaaaagauuaugacaaaacucaagauauuggucacuauugcuuaagcccuggauguacuacuguccgguacccuauuaauccaaagcacaucucuaacuguaauuggcaaguaagcagaucuagcauagcgaagauagaugugcacaauauugaggauauugaacaauauaagaaagcuauaacucagaaacuucaaacgagccuaucucuauucaaguaugcaaaaacaaaaaacuugccgcacaucaaaccaauuuauaaauauauaacuauagaaggaacagaaacugcagaagguauagagagugcauacauugaaucagaaguaccugcauuggcugggacaucuaucggauucaaaaucaauucuaaagagggcaagcacuuacuagauguuauagcauaugugaaaagugccucauacucuucaguguauacaaaauuguacucaacuggcccaacaucagggauaaauacuaaacaugaugaauuguguacuggcccaugcccagcaaauaucaaucaucaggauggguggcugacauuugcaagagagaggacaagcucauggggaugcgaagaguuugguugccuggcuguaagugauggguguguauuugggucaugccaagauauaauaaaagaagaacuaucugucuauaggaaggagaccgaggaagugacugauguagaacuguguuugacauuuucagacaaaacauacuguacaaacuuaaacccuguuaccccuauuauaacagaucuauuugagguacaguucaaaacuguggagaccuacagcuugcccagaauuguugcugugcaaaaccaugagauuaagauugggcaaauaaaugauuuaggaguuuacucuaaggguugugggaauguucaaaaggucaauggaacuauuuauggcaauggaguucccagauuugacuacuuaugccauuuagcuagcaggaaggaagucauuguuagaaaaugcuucgacaaugauuaucaagcaugcaaauuucuucaaagcccugcuaguuacagacuugaagaagacaguggcacugugaccauaauugacuacaaaaagauuuuaggaacaaucaagaugaaggcaauuuuaggagaugucaaauauaaaacauuugcugauagugucgauauaaccgcagaagggucaugcaccggcuguauuaauugcuucgaaaauauccauugcgaauuaacguugcacaccacaauugaagccagcugcccaauuaaaagcucgugcacaguauuucaugacaggauucuuguuacuccaaaugaacacaaauaugcauuaaaaguggugugcacagaaaagccagggaacacacucacaauugaagucugcaauacuaaaauugaagcaucuauggcccuugucgacgcaaagccuaucauagaacuagcaccaguugaucagacaacauauauaagagaaaaagaugaaagguguaaaacuuggauguguaggguaagagaugaaggacugcaggucaucuuggagccauuuaaaaauuuauuuggaucuuauauugggauauuuuacacauuuauuauaucuauaguagcauuauugguuauuaucuauguacuacuaccuauaugcuuuaaguuaagggauacccuuagaaagcaugaagaugcauauaagagagagaugaaaauuagauaa

SEQ ID NO: 4290 - RNA, 4326 nt, Artificial Sequence
  derived and/or modified CDS sequence (wt) from LACV(LACV/95/OH-H (CCH-MB96))__GU206136.1__GP
augauucgcauacuggugcugauugcaguuacagcugcaagcccaguguaucaaaggugcuuccaagauggggcuauagugaagcaaaacccauccaaagaagcaguuacagaggugugccugaaagaugauguuagcaugaucaaaacagaggccagguauauaaggaaugcaacagggguuuuuucaaacaauguugcaauaaggaaauggcuagucucugauuggcaugauugcaggccuaagaagaucauugggggacacaucaauguaauagaaguuggugaugaccuaucgcuccauacugaaucauauguuugcagugcagauuguacuauagguguagacaaagagacugcgcaggucagacuucagacagauaccacaaaucauuuugaaauugcaggcacuacugugaagucaggaugguucaagagcacgacauauauaacucuugaucaaaccugcgaacaccuuaaaguuuccugcggcccaaaaucuguacaguuccaugccugcuucaaucagcauaugucuugugucagauuuuuacacaggacaauauugccuggcuccauugccaauuccauaugucagaauauugaaaucauaauuuuaguuacacuuacucuauuaaucuuuauauuguuaagcauuuuaaguaagacuuauauauguuauuuauuaaugccuauauucauccccauagcauauguauacgguauaauuuacaacaagucgugcaaaaaaugcaaacuaugcggccuaguguaucacccauucacagaguguggcacacauugugucuguggugcucgcuaugauacuucagauagaaugaaacugcacagagcuucuggacugugcccugguuauaaaagucuaagagcugccagagucaugugcaagucgaaagggccugcaucaauauuaucuaugauuacugcaguacuggucuuaaccuuugugacgccaaucaacucuaugguuuuaggggaaaguaaagaaacguuugaacuugaagagcucccagacgacauguuggaaaugguaucgaggauaaauucuuauuauuuuaccuguaucuugaauuaugcuguaagcuggggucuuauaaucauuggguuguugacuggacugcuauuuaagaaauaccagcacagauuuuuaaauguuuacgcaauguacugugaggaaugugacauguaucaugacaagucugggcugaaaagacauggugauuucaccaacaaaugcaggcaauguacauguggucaauaugaagaugccgcaggcuugauggcccacaggaaaaccuauaacugcuuagugcaguacaaagcaaaauggaugaugaauuuccugauaauuuacauauucuuaauuuuaaucaaagauucugcuauaguuguacaagcugcuggaacugauuucaccaccugccuagagacugagaguauaaauuggaacugcacugggccauuuuugaaccucgggaacugucaaaagcagcaaaagaaggaaccuuacaccaacauugcaacccaauuaaaggggcuaaaggcaauuuccguacuagauauuccuauaauaacagggauuccggaugauauugcaggugcuuuaagauauauagaagaaagggaagauuuccauguccagcuaacuauagaauacgcaaugcugaguaaguacugugacuauuacacccaauucucagacaacucaggauacagucagacaacauggaggguguacuuaaggucucaugauuuugaggcauguauacuauauccaaaucaacauuucugcaggugugugaaaaauggugagaagugcagcagcuccaauuggggcuuugccaaugaaaugaaggauuuuuacucugggaaacaaacaaaguuugauaaagacuuaaaccuagcccuaacagcuuugcaucaugccuucagggggaccucaucugcauauauagcaacagugcuuucaaaaaaguccaaugaugacuugauugcauacacaaacaagauaaaaacaaaauucccagguaaugcauuguugaaggcuauaauagauuauauagcauauaugaaaaguuugccagguauggcaaauuucaaauaugaugaguucugggaugaauuauuguacaaacccaacccagcaaaagccucaaaccuugcuagaggaaaggagucaucuuacaauuuuaaacuagcaauuucaucaaaaucuauaaaaaccugcaagaauguuaaggauguugccuguuuaucaccaaggucaggugcuauauaugcuucaauaauugcauguggugaacccagugggccaaguguguauagaaaaccaccaggugguguauuccaaucuagcacugaucggucuauauacugcuuacuagauagccauugucuagaagaauuugaagcuaucagccaggaggagcuagaugcagugaaaaaauccaaauguugggagauugaauauccugauguaaagccccuccaagaaagugaugggacuaaaagcuguagaaugaaagauucuggaaacugcaauguugcaacuaacagauggccagugauacaaugcgagaaugacaaauuuuacuacucagagcuucaaaaagauuaugauaaaacucaagauauuggucauuauugcuuaagcccuggauguacuacuguccgguacccuauuaauccaaagcauaucucuaacuguaauuggcagguaagcagauccagcauagcgaagauagaugugcauaauauugaagacauugaacaauauaagaaggcuauaacucaaaaacuucaaacaagccuaucucuauucaaguaugcaaaaacaaaaaacuugccgcacaucaaaccaauuuauaaauauauaacuauagaaggaacagaaacugcagaagguauagagagugcauacauugaaucagaagugccugcauuggcugggacaucuaucggguucaaaaucaauucuaaagagggcaagcacuugcuagauguuauagcauauguaaaaagcgccucauacucuucaguguauacaaaauuguacucaacuggcccaacaucaggaauaaauacuaaacaugaugaauuauguacuggcccgugcccagcaaauaucaaucaucagguuggguggcuaacauuugcaagagagaggacaagcucauggggaugugaagaauuugguugccuggcuguaagugauggauguguauuugggucaugccaggauauaauaaaagaagaacuaucugucuauaggaaggagaccgaagaagugacugauguagaacuauguuuaacauuuucagauaaaacauauuguacaaacuugaacccuguaaccccuauuauaacagaucuauucgaaguacaguucaaaacuguagagacuuacagcuugcccagaauugucgcugugcaaaaccaugaaauuaagauugggcaaauaaaugaccuaggaguuuacucuagggguuguggaaauguucaaaaggucaauggaaccguuuauggcaauggaguuccuagauuugauuacuuaugccauuuagcuagcagaaaggagguuauuguuagaaaaugcuuugacaaugauuaccaagcgugcaaauuucuucaaagcccugcuaguuacagacuugaagaagacagugguacugugacuauaauugauuacaagaagauauuaggcacaaucaagaugaaggcaauuuuaggagaugucaaauauaagacauuugcugacagugucgauauaacugcagaagggucaugcacuggcuguaucaauugcuuugagaauauccauugugaauuaacguugcauaccacaauugaagccagcuguccaauuaaaagcucaugcacaguauuccaugacaggauucuugugacuccaaaugaacacaaauaugcauuaaaaauggugugcacagaaaagccagggaauacacucacaauuaaaguuugcaauacuaagauugaggcaucuauggcccuugucgacgcaaagccuauuauagaacuagcaccaguugaucagacagcauauauaagagaaaaagaugaaagguguaaaaccuggauguguaggguaagagaugaaggauugcaggucauccuggagccauucaaaaauuuauuuggaucuuauauugggauauuuuacacauuuauuauaucuauaguggcauuauugguuaucaucuaugugcuauugccuauaugcuuuaaguuaagagauacccuuagaaagcaugaagaugcauauaagagagagaugaaaauuagauag

SEQ ID NO: 4291 - RNA, 4326 nt, Artificial Sequence
  derived and/or modified CDS sequence (wt) from LACV(LACV/95/WV-H)__GU206133.1__GP
augauuuguauauuggugcuaauuacaguugcagcugcaagcccaguguaucaaagguguuuccaagauggggcuauagugaagcaaaacccauccaaagaagcaguuacagaggugugccugaaagaugauguuagcaugaucaaaacagaggccagguauguaagaaaugcaacaggaguuuuuucaaauaaugucgcaauaaggaaauggcuagucucugauuggcaugauugcaggccuaagaagaucguugggggacacaucaauguaauagaaguuggugaugaccugucacuccauacugaaucauauguuugcagcgcagauuguaccauagguguagacaaagagacugcacaggucaggcuucagacagauaccacaaaucauuuugaaauugcaggcacuacugugaagucaggaugguucaagagcacgacauauauaacucuugaucaaacuugcgaacaccuuaaaguuuccugcggcccaaaaucuguacaguuccaugccugcuucaaucagcauaugucuugcgucagauuuuuacacaggacaauauugccuggcucuauagccaauuccauaugucagaauaucgaaaucauaauuuuaguuacacuuacucuauuaaucuuuauauuguuaagcauuuuaaguaagacuuauauauguuauuuauuaaugccuauauucauccccauagcauauauauacgguacaauuuacaauaagucgugcaaaaaaugcaaauuauguggcuuaguguaucacccauucacagaguguggcacacauugugucuguggugcccgcuaugauacuucagauagaaugaaacugcauagagcuucuggauugugcccugguuauaaaagccuaagagcugccagagucaugugcaagucgaaagggccugcaucaauauugucuauaauuacugcgguacuggucuuaaccuuugugacaccaaucaacuccaugguuuuaggagagaguaaagaaaccuuugaacuugaagaucuuccagacgacauguuggaaauggcaucgagaauaaauucuuauuaucuuaccuguaucuugaauuaugcuguaagcuggggucuuguuaucauuggauuguugaucgggcugcuuuuuaagaaauaccagcacagauucuuaaauguuuacgcaauguacugugaagaaugugacauguaucaugacaagucuggguugaaaagacauggugauuucaccaacaaaugcagacagugcacauguggucaauaugaagaugcugcagguuugauggcucacaggaaaaccuauaacugcuuagugcaguacaaagcaaaguggaugaugaacuuccugauaauuuacauauucuuaauuuugaucaaagauucugcuauaguuguacaagcugcuggaacugacuucaccaccugccuagagacugagaguauaaauuggaacugcacugggccauuuuugaaccucgggaauugccaaaagcaacaaaagaaagaaccuuacaccaacauugcaacucaguuaaagggacuaaaggcaauuuccguacuagaugucccuauaauaacagggauaccagaugauauugcgggugcuuuaagauauauagaagagaaggaagauuuccauguccagcuaacuauagaauaugcgauguuaaguaaauacugugacuauuauacccaauucucagauaacucaggauacagucagacaacauggagaguguacuuaaggucucaugauuuugaagccuguauacuauauccaaaucagcacuuuugcagauguguaaaaaauggugagaagugcagcagcuccaauugggacuuugccaaugaaaugaaagauuauuacucugggaaacaaacaaaguuugacaaggauuuaaaucuagcccuaacagcuuugcaucaugccuucagggggaccucaucugcauauauagcaacaaugcucucaaaaaaguccaaugaugacuugauugcauacacaaauaagauaaaaacaaaauucccagguaaugcauuguugaaggcuauaauagauuauauagcauauaugaaaaguuugccagguauggcaaauuucaaauaugaugaauucugggaugaauuauuguacaaacccaacccagcaaaggccucaaaccuugcuagaggaaaggagucaucuuacaacuucaaacuagcaauuucaucaaagucuauaaaaaccugcaagaauguuaaggauguugccugcuuaucgccaaggucaggugcuauauaugcuucaauaauugcguguggugaacccaaugggccaaguguguauaggaaaccaucaggugguguauuccaaucuagcacugaucagucuauauacugcuugcuggauagccauugucuagaagaauuugaggccaucggccaggaggagcuggaugcgguaaagaaauccaaauguugggaaauugaauauccugacguaaagcucauccaagaaggcgaugggacuaaaagcuguagaaugaaagauucugggaacugcaauguugcaacuaacagauggccagugauacaaugugagaaugacaaauuuuacuacucagagcuucaaaaagauuaugacaaaacucaagauauuggucacuauugcuuaagcccuggauguacuacuguccgguacccuauuaauccaaagcacaucucuaacuguaauuggcaaguaagcagaucuagcauagcgaagauagaugugcacaauauugaggauauugagcaauauaagaaagcuauaacucagaaacuucaaacaagccuaucucuauucaaguaugcaaaaacaaaaaacuugccgcacaucaaaccaauuuauaaauauauaacuauagaaggaacagaaacugcagaagguauagagagugcauacauugaaucagaaguaccugcauuggcugggacaucuaucggauucaaaaucaauucuaaagagggcaagcacuugcuagauguuauagcauauguaaaaagugccucauacucuucaguguauacaaaauuguacucaacuggcccaacaucagggauaaauacuaaacaugaugaauuguguacuggcccaugcccagcaaauaucaaucaucagguuggguggcugacauuugcaagagagaggacaagcucauggggaugcgaagaguuugguugccuggcuguaagugauggguguguauuuggaucaugccaagauauaauaaaagaagaacuaucugucuauaggaaggagaccgaggaagugacugauguagaacuguguuugacauuuucagacaaaacauacuguacaaacuuaaacccuguuaccccuauuauaacagaucuauuugagguacaguucaaaacuguagagaccuacagcuugcccagaauuguugcugugcaaaaccaugagauuaagauugggcaaauaaaugauuuaggaguuuacucuaaggguugugggaauguucaaaaggucaauggaacuauuuauggcaauggaguucccagauuugacuacuuaugccauuuagcuagcaggaaggaagucauuguuagaaaaugcuucgacaaugauuaccaagcaugcaaauuccuucaaagcccugcuaguuacagacuugaagaagacaguggcacugugaccauaauugacuacaaaaagauuuuaggaacaaucaagaugaaggcaauuuuaggagaugucaaauauaaaacauuugcugauagugucgauauaaccgcagaagggucaugcaccggcuguauuaacugcuucgaaaauauccauugcgaauuaacguugcacaccacaauugaagccagcugcccaauuaaaagcucgugcacaguauuucaugacaggauucuugugacuccaaaugaacacaaauaugcauugaaaauggugugcacagaaaagccagggaacacacucacaauuaaagucugcaauacuaaaauugaagcaucuauggcccuugucgaugcaaagccuaucauagaacuagcaccaguugaucagacagcauauauaagagaaaaagaugaaagguguaaaacuuggauguguaggguaagagaugaaggacugcaggucaucuuggagccauuuaaaaauuuauuuggaucuuauauugggauauuuuacacauuuauuauaucuauaguagcauuauugguuauuaucuauguacuacuaccuauaugcuuuaaguuaagggauacccuuagaaagcaugaagaugcauauaagagagagaugaaaauuagauag

SEQ ID NO: 4292 - RNA, 4326 nt, Artificial Sequence
  derived and/or modified CDS sequence (wt) from LACV(LACV/96/WV-M (WV96-3955))__GU206145.1__GP
augauuuacauacuggugcuaauugcaguuacagcugcaaguccaguauaucaaagguguuuucaggauggggcuauagugaagcaaaacccauccaaagaggcagucacggaggugugccuaaaggaugaugucaguaugaucaaaacagaagccagauacauaagaaaugcgacaggaguuuuuucaaacaauguugcaauaaggaaaugguuggucucugauuggcaugacugcaggcccaagaaaaucacugggggacauauuaaugugauagagguuggugaugaucuaucacuccacacugaaucauauguuugcagugcagacuguacuauagguguagacaaggagacggcgcaagucaggcuucaaacagauaccacgaaccauuuugaaauugcagguaccacuguaaaaucaggaugguucaaaagcacaacauauaucacucuugaccagacuugugaacaucuuaaggugucuugcggcccaaaaucugugcaguuccaugccugcuucaaucagcauauguccuguguuagauuuuuacauaggacaauacugcccgguucuauagcuaauucuauaugccagaauauugaaaucauaauuuuagucacacucacucuauuaaucuuuauauuguuaaguauucuaaguaagacuuauauauguuauuuacuaaugccuauauucaucccuauagcauauguguaugguauaaucuacaauaagucaugcaaaaaaugcaaacuaugcggucugguguaucauccauucacagaaugcggcacacacugugucuguggugcucgcuaugauacuuccgauagaaugaaacugcauagagccucuggacuguguccugguuauaaaagcuugagagcugcuagggucauguguaagucaaaagggccugcauccauauuaucuauaauuacugcaguacuagucuuaacauuugugacaccaaucaauuccaugguuuuaggggaaaguaaagaagucuucgaacuugaagagcuuccggacgacauguuagagauggcauugaggauaaauuccuauuauuucaccuguauucuaaauuaugcugugagcuggggccuuauuaucauuggauuguugacugggcuacuauuuaaaaaguaccaacauagauuuuugaauauuuaugcgauguauugugaagagugugacauguaucaugauaaauccgggcugaaaaggcauggugauuucacuaacaaaugcaggcaauguacaugcggccaauaugaagaugcugcaggauuaaugacucacagaaaaacuuacaauuguuuggugcaauauaaagcaaaauggauaaugaauuuuuugauaguuuacauauuuuugauucuaaucaaggauucugccauaauuguacgagcugccggaacugacuuuagcuccugcuuagaaacagaaaucauaaauuggaacugcacugggccauuuuugaaucucgggaauugccaaaggcaacaaaaaaaggagccuuaugcuaacauugcagcucaauuaaaaggauugaaagcaauuucagugcuugacaucccuaugauaacagaaauaccagaugacaucgcaagugcauuaagauauauagaagagagagaggcuuuccauguccaauugacugcagaauacgcaaugcugaguagauauugugauuauuauacccaauucucagacaacucaggauauagucagacaacauggagaguauauuugaggucucacgauuucgaggcauguauacuauacccuaaucaacacuuuugcagaugugugaaaaacggugagaaaugcagcagugccaauugggauuuugccaaugaaaugaaagauuauuauucuggaaaacaagcaaaguuugauaaagacuuaaacuuggcucugacagcuaugcaccaugccuucagggggacuucaucugcauauauggcagcaaugcucucaaagaagucaaaugaugacuugaucacauauacaaauaaauuaaagacaaaguuccccgguaaugcguugcugaaggccauaauagacuauauagcauauaugaaaggcuuaccagguauggcaaauuuuaaacaugaugaauuuugggaugaauuacuauacaaacccacaccaacaaaggccccaaaucuugcuagaggaagagaaucauccuacaauuuugaauuggcaauuucaucaaaauccauaaaaaccugcaaaaauguuaaagauguugcuuguuuaucacccagaucaggcgccauauaugcaucaauaauagcauguggugaacccaaugggccaaguguauacaggaagccaucaggcggugucuuccaguccagcacugaccaaucuauguauuguuugcuggauagucauugcuuggaagaauuugaagcuaucagccaggaagaauuggaugcggugaagaaaucgaaauguugggaaauagaauacccugacguaaagcuccuccaagaaaaugauggaaccaaaagcuguagaaugaaagacucuggaaauuguaauguugcaaccaacagauggccaguaauacaaugugaaaaugacaaauuuuacuacucagagcuucaaaaagauuaugauaagacccaggauauuggccacuauugcuugaguccugggugugcuacuauccgguaccccauuaauccaaagcauaucucuaauugcaauuggcaagugaguagaucuagcauagcaaaaauagaugugcauaauauugaagacauugagcaauauaaaaaagccauaacucaaaaacuucaaacaagucuaucccuuuuuaaauaugccaaaacaaaaaacuugccgcacaucaaaccuauuuacaaauauauaacuauagaaggaaccgaaacugcagagggaauagaaagcgcguauauugaaucagaagugccugcauuagcugggacauccauuggauucaaaaucaacuccaaggagggcaaacauuuauuagauguuauagcuuaugugaaaagugccucauacucuucaguauacacaaaauuguauucaaccggcccaacaucagguguaaacacuaagcaugaugaauugugcacuggcccaugcccagcaaauauuaaccaucagguuggaugguuaacauuugcaagagagagaacaaguucauggggcugugaagaguuugguugccuagcaguaagugauggaugcguauuugggucaugccaagauauaauaaaagaagagcugucugucuauaggaaggaaaccgaggaaguaacugauguggagcuauguuuaacauucucagacaaaacauacuguacaaauuuaaaucccgucaccccuauuauaacagaucuauuugaggugcaauucaaaacuguagagacuuacagcuugcccaggauuguugccguacaaaaucaugagaucaagauuggucaaauaaaugauuuaggaguguauucuaaaggguguggaaauguucagaaggucaaugggaccauuuaugguaauggagucccuagauuugauuacuugugucauuuagcuaguagaaaagagguuauuguuaggaaauguuuugauaaugacuaucaagcauguaaauuccuccagagcccugcuaguuacagacuugaggaggauagugggacugugacuauaaucgauuacaaaaaaauacuagguacaauuaagaugaaggcaauuuuaggggauguuaaauacaaaacauuugcugauaauguugauauaacugcagaagggucuugcacuggcuguauuaauugcuuugagaauauccacugugaauugacauugcauaccacaauugaagccagcuguccaauuaaaagcucaugcacaguguuucaugauaggauccuugugacuccaaacgaacauaaauaugcuuugaaaguagugugcacugaaaagccagggaauacgcucacaaucaaaguguguaacacaaagauugaagcugcaauggcucuuguugacgcaaaacccaucauagaauuggcaccgguugaucaaacagcauacauaagggaaaaggaugagagauguaaaacuuggaugugcagaguacgggacgaaggauuacaggucauuuuggaaccauuuaaaaacuuauuuggauccuauauugggauauuuuauacauuuauuauauccauaguggcauuauuagucaucauuuacaucuuauugccuauauguuucaaauuaagagauacucucaggaagcaugaggaugcauauaagagagagaugaaaauuagguaa

SEQ ID NO: 4293 - RNA, 4326 nt, Artificial Sequence
  derived and/or modified CDS sequence (wt) from LACV(LACV/97/NC-M (NC97-7306))__GU206127.1__GP
augauucgcauacuggugcugauugcaguuacagcugcaagcccaguguaucaaaggugcuuccaagauggggcuauagugaagcaaaacccauccaaagaagcaguuacagaggugugccugaaagaugauguuagcaugaucaaaacagaggccagguauauaaggaaugcaacagggguuuuuucaaacaauguugcaauaaggaaauggcuagucucugauuggcaugauugcaggccuaagaagaucauugggggacacaucaauguaauagaaguuggugaugaccuaucgcuccauacugaaucauauguuugcagugcagacuguacuauagguguagacaaagagacugcgcaggucagacuucagacagauaccacaaaucauuuugaaauugcaggcacuacugugaagucaggaugguucaagagcacgacauauauaacucuugaucaaaccugcgaacaccuuaaaguuuccugcggcccaaaaucuguacaguuccaugccugcuucaaucagcauaugucuugugucagauuuuuacacaggacaauauugccuggcuccauugccaauuccauaugucagaauauugaaaucauaauuuuaguuacacuuacucuauuaaucuuuauauuguuaagcauuuuaaguaagacuuauauauguuauuuauuaaugccuauauucauccccauagcauauguauacgguauaauuuacaauaagucgugcaaaaaaugcaaacuaugcggccuaguguaucauccauucacagaguguggcacacauugugucuguggugcucgcuaugauacuucagauagaaugaaacuacacagagcuucuggacugugcccugguuauaaaagucuaagagcugccagagucaugugcaagucgaaagggccugcaucaauauuaucuaugauuacugcaguacuggucuuaaccuuugugacgccaaucaacucuaugguuuuaggggaaaguaaagaaacguuugaacuugaagagcuuccagacgacauguuggaaaugguaucgaggauaaauucuuauuauuuuaccuguaucuugaauuaugcuguaagcuggggucuuauuaucauuggguuguugacuggacugcuauuuaagaaauaccagcacagauuuuuaaauguuuacgcaauguacugugaggaaugugacauguaucaugacaagucuggguugaaaagacauggcgauuucaccaacaaaugcaggcaauguacauguggucaauaugaagaugccgcaggcuugauggcccacaggaaaaccuauaacugcuuagugcaguacaaagcaaaguggaugaugaauuuccugauaauuuacauauucuuaauuuuaaucaaagauucugcuauaguuguacaagcugcuggaacugauuucaccaccugccuagagacugagaguauaaauuggaacugcacugggccauuuuugaaccucgggaauugucaaaaacagcaaaagaaggaaccuuacaccaacauugcaacccaauuaaaggggcuaaaggcaauuuccguacuagauaucccuauaauaacagggauuccggaugauauugcaggugcuuuaagauauauagaagaaagggaagauuuccauguccagcuaacuauagaauacgcaaugcugaguaaguacugugacuauuacacccaauucucagacaacucaggauacagucagacaacauggaggguauacuuaaggucucaugauuuugaggcauguauacuauauccaaaucaacauuucugcaggugugugaaaaauggugagaagugcagcagcuccaauugggacuuugccaaugaaaugaaggauuuuuacucugggaaacaaacaaaguuugauaaagacuuaaaccuagcccuaacagcuuugcaucaugccuucagggggaccucaucuguauauauagcaacaaugcuuucaaaaaaguccaaugaugacuugauugcauacacaaacaagauaaaaacaaaauucccagguaaugcauuguugaaggcuauaauagauuauauagcauauaugaaaaguuugccagguauggcaaauuucaaauaugaugaguucugggaugaauuauuauacaaacccaacccagcaaaagccucaaaccuugcuagaggaaaggagucaucuuacaauuuuaaacuagcaauuucaucaaaaucuauaaaaaccugcaagaauguuaaggauguugccuguuuaucaccaaggucaggcgcuauauaugcuucaauaauugcauguggugaacccaaugggccaaguguguauagaaaaccaccaggugguguauuccaaucuagcacugaucggucuauauacugcuuacuagauagccauugucuagaagaguuugaagcuaucagccaggaggagcuagaugcagugaaaaaauccaaauguugggagauugaauauccugauguaaagccccuccaagaaagugaugggacuaaaagcuguagaaugaaagauucugggaacugcaauguugcaacuaacagauggccagugauacaaugcgagaaugacaaauuuuacuacucagagcuucaaaaagauuaugauaaaacucaagauauuggucauuauugcuuaagcccuggauguacuacuguccgguacccuauuaauccaaagcauaucucuaacuguaauuggcagguaagcagauccagcauagcgaagauagaugugcauaauauugaagacauugaacaauauaagaaggcuauaacucaaaaacuucaaacaagccuaucucuauucaaguaugcaaaaacaaaaaacuugccgcacaucaaaccaauuuauaaauauauaacuauagaaggaacagaaacugcagaagguauagagagugcauacauugaaucagaggugccugcauuggcugggacaucuaucggguucaaaaucaacucuaaagagggcaagcacuugcuagauguuauagcauauguaaaaagcgccucauacucuucaguguauacaaaauuguacucaacuggcccaacaucaggaauaaauacuaaacaugaugaauuauguacuggcccaugcccagcaaauaucaaucaucagguuggguggcuaacauuugcaagagagaggacaagcucauggggaugugaagaauuugguugccuggcuguaagugauggauguguauuugguucaugccaggauauaauaaaagaagaacuaucugucuauaggaaggagaccgaagaagugacugauguagaacuauguuuaacauuuucagauaaaacauauuguacaaacuugaacccuguuaccccuauuauaacagaucuauuugaaguacaguucaaaacuguagagacuuacagcuugcccagaauugucgcugugcaaaaccaugaaauuaagauugggcaaauaaaugaccuaggaguuuacucuaaggcuuguggaaauguucaaaaggucaauggaaccguuuauggcaauggaguuccuagauuugauuacuuaugccauuuagcuagcagaaaggaggucauuguuagaaaaugcuuugacaaugauuaccaggcgugcaaauuucuucaaagcccugcuaguuacagacuugaagaagacagugguacugugacuauaauugauuacaagaagauauuaggcacaaucaagaugaaggcaauuuuaggagaugucaaauauaagacauuugcugacagugucgauauaacugcagaagggucaugcacuggcuguaucaauugcuuugagaauauccauugcgaauuaacguugcauaccacaauugaagccagcuguccaauuaaaagcucaugcacaguauuccaugacaggauucuugugacuccaaaugaacacaaauacgcauuaaaaauggugugcacagaaaggccagggaauacacuuacaauuaaaguuugcaauacuaagauugaggcaucuauggcccuugucgacgcaaagccuauuauagaacuagcaccaguugaucagacagcauauauaagagaaaaagaugaaagguguaaaaccuggauguguaggguaagagaugaaggauugcaggucauccuggagccauucaaaaauuuauuuggaucuuauauugggauauuuuacacauuuauuauaucuauaguggcauuauugguuaucaucuaugugcuauugccuauaugcuuuaaguuaagagauacccuuagaaagcaugaagaugcauauaagagagagaugaaaauuagauag

SEQ ID NO: 4294 - RNA, 4326 nt, Artificial Sequence
  derived and/or modified CDS sequence (wt) from LACV(LACV/human/1960)__EF485031.1__GP
augauuuguauauuggugcuaauuacaguugcagcugcaagcccaguguaucaaagguguuuccaagauggggcuauagugaagcaaaacccauccaaagaagcaguuacagaggugugccugaaagaugauguuagcaugaucaaaacagaggccagguauguaagaaaugcaacaggaguuuuuucaaauaaugucgcaauaaggaaauggcuagucucugauuggcaugauugcaggccuaagaagaucguugggggacacaucaauguaauagaaguuggugaugaccugucacuccauacugaaucauauguuugcagcgcagauuguaccauagguguagacaaagagacugcacaggucaggcuucagacagauaccacaaaucauuuugaaauugcaggcacuacugugaagucaggaugguucaagagcacgacauauauaacucuugaucaaacuugcgaacaccuuaaaguuuccugcggcccaaaaucuguacaguuccaugccugcuucaaucagcauaugucuugcgucagauuuuuacacaggacaauauugccuggcucuauagccaauuccauaugucagaauaucgaaaucauaauuuuaguuacacuuacucuauuaaucuuuauauuguuaagcauuuuaaguaagacuuauauauguuauuuauuaaugccuauauucauccccauagcauauauauacgguacaauuuacaauaagucgugcaaaaaaugcaaauuauguggcuuaguguaucacccauucacagaguguggcacacauugugucuguggugcccgcuaugauacuucagauagaaugaaacugcauagagcuucuggauugugcccugguuauaaaagccuaagagcugccagagucaugugcaagucgaaagggccugcaucaauauugucuauaauuacugcgguacuggucuuaaccuuugugacaccaaucaacuccaugguuuuaggagagaguaaagaaaccuuugaacuugaagaucuuccagacgacauguuggaaauggcaucgagaauaaauucuuauuaucuuaccuguaucuugaauuaugcuguaagcuggggucuuguuaucauuggauuguugaucgggcugcuuuuuaagaaauaccagcacagauucuuaaauguuuacgcaauguacugugaagaaugugacauguaucaugacaagucuggguugaaaggacauggugauuucaccaacaaaugcagacagugcacauguggucaauaugaagaugcugcagguuugauggcucacaggaaaaccuauaacugcuuagugcaguacaaagcaaaguggaugaugaacuuccugauaauuuacauauucuuaauuuugaucaaagauucugcuauaguuguacaagcugcuggaacugacuucaccaccugccuagagacugagaguauaaauuggaacugcacugggccauuuuugaaccucgggaauugccaaaagcaacaaaagaaagaaccuuacaccaacauugcaacucaguuaaagggacuaaaggcaauuuccguacuagaugucccuauaauaacagggauaccagaugauauugcgggugcuuuaagauauauagaagagaaggaagauuuccauguccagcuaacuauagaauaugcgauguuaaguaaauacugugacuauuauacccaauucucagauaacucaggauacagucagacaacauggagaguguacuuaaggucucaugauuuugaagccuguauacuauauccaaaucagcacuuuugcagauguguaaaaaauggugagaagugcagcagcuccaauugggacuuugccaaugaaaugaaagauuauuacucugggaaacaaacaaaguuugacaaggauuuaaaucuagcccuaacagcuuugcaucaugccuucagggggaccucaucugcauauauagcaacaaugcucucaaaaaaguccaaugaugacuugauugcauacacaaauaagauaaaaacaaaauucccaggugaugcauuguugaaggcuauaauagauuauauagcauauaugaaaaguuugccagguauggcaaauuucaaauaugaugaauucugggaugaauuauuguacaaacccaacccagcaaaggccucaaaccuugcuagaggaaaggagucaucuuacaacuucaaacuagcaauuucaucaaagucuauaaaaaccugcaagaauguuaaggauguugccugcuuaucgccaaggucaggugcuauauaugcuucaauaauugcguguggugaacccaaugggccaaguguguauaggaaaccaucaggugguguauuccaaucuagcacugaucagucuauauacugcuugcuggauagccauugucuagaagaauuugaggccaucggccaggaggagcuggaugcgguaaagaaauccaaauguugggaaauugaauauccugacguaaagcucauccaagaaggcgaugggacuaaaagcuguagaaugaaagauucugggaacugcaauguugcaacuaacagauggccagugauacaaugugagaaugacaaauuuuacuacucagagcuucaaaaagauuaugacaaaacucaagauauuggucacuauugcuuaagcccuggauguacuacuguccgguacccuauuaauccaaagcacaucucuaacuguaauuggcaaguaagcagaucuagcauagcgaagauagaugugcacaauauugaggauauugagcaauauaagaaagcuauaacucagaaacuucaaacaagccuaucucuauucaaguaugcaaaaacaaaaaacuugccgcacaucaaaccaauuuauaaauauauaacuauagaaggaacagaaacugcagaagguauagagagugcauacauugaaucagaaguaccugcauuggcugggacaucuaucggauucaaaaucaauucuaaagagggcaagcacuugcuagauguuauagcauauguaaaaagugccucauacucuucaguguauacaaaauuguacucaacuggcccaacaucagggauaaauacuaaacaugaugaauuguguacuggcccaugcccagcaaauaucaaucaucagguuggguggcugacauuugcaagagagaggacaagcucauggggaugcgaagaguuugguugccuggcuguaagugauggguguguauuuggaucaugccaagauauaauaaaagaagaacuaucugucuauaggaaggagaccgaggaagugacugauguagaacuguguuugacauuuucagacaaaacauacuguacaaacuuaaacccuguuaccccuauuauaacagaucuauuugagguacaguucaaaacuguagagaccuacagcuugcccagaauuguugcugugcaaaaccaugagauuaagauugggcaaauaaaugauuuaggaguuuacucuaaggguugugggaauguucaaaaggucaauggaacuauuuauggcaauggaguucccagauuugacuacuuaugccauuuagcuagcaggaaggaagucauuguuagaaaaugcuucgacaaugauuaccaagcaugcaaauuccuucaaagcccugcuaguuacagacuugaagaagacaguggcacugugaccauaauugacuacaaaaagauuuuaggaacaaucaagaugaaggcaauuuuaggagaugucaaauauaaaacauuugcugauagugucgauauaaccgcagaagggucaugcaccggcuguauuaacugcuucgaaaauauccauugcgaauuaacguugcacaccacaauugaagccagcugcccaauuaaaagcucgugcacaguauuucaugacaggauucuugugacuccaaaugaacacaaauaugcauugaaaauggugugcacagaaaagccagggaacacacucacaauuaaagucugcaauacuaaaauugaagcaucuauggcccuugucgaugcaaagccuaucauagaacuagcaccaguugaucagacagcauauauaagagaaaaagaugaaagguguaaaacuuggauguguaggguaagagaugaaggacugcaggucaucuuggagccauuuaaaaauuuauuuggaucuuauauugggauauuuuacacauuuauuauaucuauaguagcauuauugguuauuaucuauguacuacuaccuauaugcuuuaaguuaagggauacccuuagaaagcaugaagaugcauauaagagagagaugaaaauuagauag

SEQ ID NO: 4295 - RNA, 4326 nt, Artificial Sequence
  derived and/or modified CDS sequence (wt) from LACV(LACV/mosquito/1978)__EF485037.1__GP
augauucgcauacuggugcugauugcaguuacagcugcaagcccaguguaucaaagguguuuccaagauggggcuauagugaagcaaaacccauccaaagaagcaguuacagaggugugccugaaagaugauguuagcaugaucaaaacagaggccagguauguaagaaaugcaacaggaguuuuuucaaacaauguugcaauaagaaaauggcuagucucugauuggcaugauugcaggccuaagaagaucauuggggggcacaucaauguaauagaaguuagugaugaccugucacuccauacugaaucauauguuugcagcgcagauuguaccauagguguagacaaggagacugcacaggucaggcuucagacagauaccacaaaucauuuugaaauugcaggcacuacugugaagucaggaugguucaaaaguacgacguacauaacucuugaucaaaccugcgaacaccuuaaaguuuccugcggcccaaaaucuguacaguuccaugccugcuucaaucagcauaugucuugcgucagauuuuuacacaggacaauauugccuggauccauagccaauuccauaugucagaauauugaaaucauaauuuuaguuacacuuacucuauuaaucuuuauauuguuaagcauuuuaagcaagacuuauauauguuauuuauuaaugccuauauuuaucccuauagcauacauguacgguauaauuuacaauaagucgugcaaaaaauguaaacuaugcggccuaguguaucauccauucacagaguguggcacacauugugucugcggugcucgcuaugauacuucagauagaaugaaacugcauagagcuucuggauugugcccugguuauaaaagccuaagagcugccagagucaugugcaagucgaaagggccugcaucaauauugucuauaauuacugcaguacuggucuuaaccuuuguaacaccaaucaacucuaugguuuuaggggagaguaaagaaacuuuugaacuugaagagcuuccagacgacauguuggaaauggcaucgagaauaaauucuuauuauuucaccuguaucuuaaauuaugcuguaagcuggggucuuguuaucauuggauuguugaccgggcugcuauuuaagaaauaucagcacagauuuuuaaauauuuacgcaauguacugugaggaaugugacauguaucaugacaagucuggguugaaaagacauggugauuucaccaauaaaugcaggcagugcacauguggucaauaugaagaugccgcagguuugauggcccacaggaaaaccuauaacugcuuagugcaguacaaagcaaaguggaugaugaauuuccugauaauuuacauauucuuaauuuuaaucaaagauucugcuauaguuguacaagcugcuggaaccgauuucaccaccugccuagagacugagagcauagauuggaacugcacugggccauuuuugaaccucgggaauugccaaaagcaacaaaagaaagaaccuuacaccaacauugcaacccaauuaaagggacuaaaggcaauuuccgugcuagauaucccuauaauaacaaggauaccagaugauauugcaggugcuuuaagauauauagaagaaagggaagauuuccauguccagcuaacuacagaauaugcgaugcugaguaaauacugugacuauuauacccaauucucagacaauucaggauacagucagacaacauggagaguguacuuaaggucucaugauuuugaggcauguauacuauauccaaaucagaauuuuugcagaugugugaaaaauggugagaaaugcagcagcucuaauugggauuuugccaaugaaaugaaagauuauuaccccgggaaacaagcaaaguuugauaaagacuuaaaucuagcccuaacagcuuugcaucaugccuucagggggacuucaucugcauauauagcaacaaugcucucaaaaaaguccaaugaugacuugauugcauacacaaauaagauaaaaacaaaauucccaggcaaugcauuguugaaggcuauaauagauuauauagcauauaugaaaagucugccagguauggcaaauuucaaauaugaugaauucugggaugaauuauuguacaagcccaacccagcaaaggccucaaaccuugcuagaggaaaggagucaucuuacaacuucaaauuagcaauuucaucaaagucuauaaaaaccugcaagaauguuaaggauguugccugcuuaucgccaaggucaggugcuauauaugcuucaauaauugcauguggcgaacccaauggaccaaguguguauagaaaaccaucaggcgguguauuucaaucuagcacugaucgaucuauauacugcuuacuagacagccauugucuagaagaauuugaggcuaucagccaggaggaacuggaugcaguaaaaaaauccaaauguugggaaauugaauauucugauguaaaaccccuccaagaagguaaugggacuaaaagcuguaggaugaaagauucugggaacugcaauguugcaacuaacagauggccagugauacaaugugagaaugacaaauuuuacuacucagagcuucaaaaagauuaugacaaaacucaagauauuggucauuauugcuuaagcccuggauguacuacuguucgguacccuauuaauccaaagcauaucucuaacuguaauuggcaggugagcagauccagcauagcgaagauagaugugcacaauauugaagauauugaacaguauaagaaggcuauaacucaaaaacuucaaacaagcuuaucucuauuuaaguaugcaaaaacaaaaaacuuaccgcacaucaaaccaauuuauaaauauauaacuauagaaggaacagaaacugcagaagguauagagagugcauacaucgaaucagagguaccugcuuuggcugggacaucuaucggauucaaaaucaauucuaaagagggcaagcacuugcuagauguuauagcauauguaaaaagcgccucauacucuucaguguaugcaaaguuauacucaacuggcccaacaucagggauaaauacuaaacaugaugaauuguguacuggcccaugcccagcaaauaucaaucaucagguuggguggcuaacauuugcaaaagagaggacaagcucauggggaugcgaagaguuugguugccuggcuguaagugauggguguguauuugggucgugccaagauauaauaaaagaagagcuaucugucuauaggaaagagaccgaggaagugacugauguagaacuauguuuaacauuuucagacaaaacauauuguacaaacuuaaacccuguuaccccuauuauaacggaccuauuugagguacaguucaaaacuguagagacuuacagcuugcccagaauuguugcugugcaaaaucaugagauuaagauugggcaaauaaaugaucuaggaguuuacucuaaggguuguggaaauguucaaaaggucaauggaacuguuuauggcaauggaguucccagauuugacuaccuaugccauuuagcuagcagaaaggaagucauuguuaggaaaugcuucgacaaugauuaccaagcaugcaaauuucuucaaagcccugcuaguuacagacuugaagaagacagcggcacugugacuauaauugauuacaaaaagauauuaggcacaauuaagaugaaggcaauuuuaggagaugucaaauauaaaacauuugcugauagugucgauauaacugcagaagggucaugcacuggcuguaucaacugcuucgagaauauccauugcgaauuaacguugcauaccacaauugaagccaguuguccaauuaaaagcucaugcacaguauuccaugacaggauucuugugacuccaaaugaacacaaauaugcauuaaaaaugguguguacagaaaagccgggaaacacacucacaauuaaaguuugcaauacuaagauugaagcaucuauggcccuuguugacgcaaagccuaucauagaacuagcaccaguugaucagacagcauauauaagagaaaaagaugaaagguguaaaacuuggauguguaggguaagagaugaaggacugcaggucaucuuggagccauuuaaaaauuuauuuggaucuuauauuggaauauuuuacacauuuauuauaucuauaguggcauuauuggcuaucaucuaugugcuauugccuauaugcuuuaaguuaagagauacccuuagaaagcaugaagaugcauauaagagagagaugaaaauuagauag

SEQ ID NO: 4296 - RNA, 4323 nt, Artificial Sequence
  derived and/or modified CDS sequence (wt) from LACV__KP271111.1__GP
augauucgcauacugguacugauugcaguuacagcugcaagcccaguguaucaaagguguuuccaagauggggcuauagugaagcaaaacccauccaaagaagcaguuacagaggugugccugaaagaugauguuagcaugaucaaaacagaggccagguacguaagaaaugcaacaggaguuuuuucaaacaauguugcaauaaggaaauggcuagucucugacuggcaugauugcagaccuaagaagaucauugggggacacaucaauguaauagaaguuggugaugaccugucacuccauacugaaucauauguuuguagcgcagauuguagcauagguguugacaaagagacugcacaggucaggcuucagacagauaccacaaaucacuuugaaauugcaggcacuacugugaagucagggugguuuaaaagcacgacguauauaacucuugaucaaaccugcgaacaccuuaaaguuuccugcggcccaaaaucuguacaguuccaugccugcuucaaucagcacaugucuugcgucagauuuuuacacaggacaauauugccuggcucuauagccaauucuauaugucagaauauugaaaucauaauuuuaguuacacuuacucuauuaaucuuuauauuguuaagcauuuuaaguaagacuuauauauguuauuuauuaaugccuauauuuaucccuauagcauacauguacgguauaauuuacaauaagucgugcaaaaaaugcaaacuaugcggccuaguguaucauccauucacagaguguggcacacauugcgucuguggugcucgcuaugauacuucagauagaaugaaacugcacagagcuucuggauugugcccugguuauaaaagccuaagagcugccagaguuaugugcaagucgaaagggccugcaucaauauugucuauaauuacugcaguacuggucuuaaccuuugugacaccaaucaauucuaugguuuuaggggagaguaaagaaacuuuugaacuugaagagcuuccagacgauauguuggaaauggcaucaagaauaaauucuuauuauuucaccuguaucuuaaauuaugcuguaagcuggggucuuguuaucauuggauuguugaccgggcugcuauuuaagaaauaucagcacagauuuuuaaauguuuacgcaauguacugugaggagugugacauguaccaugacaagucuggguugaaaagacauggugauuucacuaacaaaugcaggcagugcacauguggucaguaugaagaugcugcagguuugauggcccacaggaaaaccuauaacugcuuagugcaguacaaagcaaaauggaugaugaauuuccugauaauuuauauauucuuaauuuuaaucaaagauucugcuauaguuguacaagcugcuggaacugauuucaccacuugccuagagacugagaguauaaauuggaacugcacagggccauucuugaaccucgggaauugucaaaagcaacaaaagaaagaaccuuacaccaacauugcaacccaguuaaagggacuaaaggcaauuuccguacuagauaucccuauaauaacagggauaccagaugauaucgcaggugcuuuaagauauauagaagagagggaagacuuccauguccagcuaacuauagaauaugcaaugcugaguaaauacugugacuauuauacccaauucucagacaacucaggauacagucaaacaacauggagaguguacuuaaggucucaugauuuugaggcauguauacuauauccaaaucagcauuuuugcagaugugugaaaaauggugagaagugcagcagcuccaauugggacuuugccaacgaaaugaaagauuauuacucagggaaacaaacaaaguuugauaaagacuuaaaucuagcccuaacagcuuugcaucaugcuuucagggggacuucaucugcauauauagcaacaaugcucucaaaaaaauccaacgaugacuugauugcauacacaaauaagauaaaagcaaaauucccagguaaugcauuguugaaggcuauaauagauuauauagcauauaugaaaagucugccagguauggcaaauuucaaauaugaugaauucugggaugaguuauuguacaaacccaacccagcaaaggcuucaaaccuugcuagaggaaaggagucuucuuacaacuucaaacuagcaauuucaucaaaaucuauaaaaaccugcaagaauguuaaggauguugccugcuuaucgccaaggucaggugcuauauaugcuucaauaauugcauguggugaacccaauggaccaaguguguauagaaaaccaucaggugguguauuccaaucuagcacugaucggucuauauacugcuuacuagauagccauugucuagaagaauuugaggcuauuaaccaggaggaacuggaugcaguaaaaaaaucaaaauguugggaaauugaauauucugaugugaagccccuccaagaaggugauggaacuaaaagcuguagaaugaaagauucugggaacugcaauguugcaacuaacagauggccagugauacaaugcgagaaugacaaauuuuacuacucagagcuucaaaaagauuaugacaaaacucaagauauuggucauuauugcuuaaguccuggauguacuacuguucgguacccuauuaauccaaagcauaucucuaacuguaauuggcaggugagcagauccagcauagcgaagauagaugugcacaauauugaagauauugaacaguauaagaaggcuauaacucagaaacuucaaacaagcuuaucucuauucaaguaugcaaaaacaaagaauuugccgcacaucaagccaauuuacaaauauauaacuauagagggaacagaaacugcagaagguauagagagugcauacaucgaaucagagguaccugcauuggcugggacaucuaucggauucaaaaucaauucuaaagagggcaagcacuugcuagauguuauagcauauguaaaaagcgccucauacucuucaguguaugcaaaauuguacucaacuggcccaacaucagggauaaauacuaaacaugaugaauuguguacuggcccaugcccggcaaauaucaaucaucagguuggguggcuaacauuugcaaaagagaggacaagcucauggggaugcgaagaguuugguugccuggcuguaagugauggguguguauucgggucaugccaagauauaauaaaagaagaacuaucugucuauaggaaggagaccgaagaagugacugauguagaacuauguuuaacauuuucagacaaaacauacuguacaaacuuaaacccuguuaccccuauuauaacagaccuauuugagguacaguucaagacuguagagacuuacagcuugcccagaauuguugcugugcaaaaucaugagauuaagauugggcaaauaaaugaucuaggaguuuacucuaaggguuguggaaauguccaaaagaucaacggaacuguuuauggcaauggaguucccagauuugacuaucuaugccauuuagcuagcagaaaggaagucauuguuagaaaaugcuucgacaaugauuaccaagcaugcaaauuucuucagagcccugcuaguuacagacuugaagaagacaguggcacugugacuauaauugauuacaaaaagauauuaggcacaaucaagaugaaggcaauucuaggagaugucaaauauaaaacauuugcugauagugucgauauaacugcagaagggucaugcacuggcuguaucaacugcuucgagaauauccauugcgaauuaacguugcauacuacaauugaagccagcugcccaauuaaaagcucaugcacaguauuccaugauaggauucuugugacuccaaaugaacacaaauaugcauuaaaaauggugugcacagaaaagccggggaacacacucacaauuaaaguuugcaauacuaagauugaagcaucuauggcccuugucgaugcaaagccuaucauagaacuagcaccaguugaucagacagcauauauaagagaaaaagaugaaagguguaaaacuuggauguguaggguaagagaugaaggacugcaggucaucuuggagccauuuaaaaauuuguuugggucuuauauugggauauuuuacacauuuauuauaucuauaguggcauuauugguuauugucuaugugcuauugccuauaugcuuuaaguuaagagauacccuuagaaagcacgaagaugcauauaagagagagaugaaaauuaga

SEQ ID NO: 4297 - RNA, 4263 nt, Artificial Sequence
  derived and/or modified CDS sequence (wt) from OROV(BeAn19992)__NC_005775.1__GP
auggcgaauuuaauaauuauuucaaugguucugggcguugccuaugggcauccgcuuucaacaagucaaauuggugaccgcuguuuugcuggugguaaccucuucaaggagaugaacuugaguguaggacuuggcgaaauauguguuaaagaugacauaucuauuguuaagaguacuacuguuuuuagcaagaauaaaccagcucuugaggcaacuacaaaauuuuauagaucuuuuauugugaaagauuggucugagugcaauccagugcuagacaaauuuggaaauuuuaugguuuuaaguguugaugauaauggccauauaauaccuaaaauguauacauguagagcagcaugugauauuagauuaaacaaagauaaugccgaaauaauauuaucgucaacaaaacucaaccacuuugaaauugucgggacaacuucgacaucaggcugguucaagaacacaauaacaaacaacuuagaacauacaugcgagcauguaaccguaaauuguggucagaaaucaguaaaauuccaugcaugcuuuagacaacauagggguuguauaagauucuuuaaaggaacauauaugccauacucaaugauugaagcaaugugcguuaacauagagcuaauaauucugacauuauauaucuuugcugcaauuauauuugcauuaauuauaacaaagaguuauguggcauacuugcuccugccguuauuuuauccagugacgugguuuuacggaaagguuuauaaaaagauuaauucuugcccaaauugucuacuugcaucucacccuuucaccagcugcccuaaauucuguauaugcgguucuagguuuaguugcacagaagcucuuaagguacauagaaugggaaaggacugcuuagguuauaagucucuaagcaaagcuagacagauguguaaaucgaaaagcugguccuucacagcagcuauauuaacuggauuaauauugauggaauucaucucaccaauugcaggagagagaauguauaagcuugaggagcuggcugaugaguuuauaaagcuaacagagcagguaaauauuuuagaaagagaaauggaagucuugaagcagucaauaauuguuauguuugcaaucauuuugguauuguugcuuuuugaaaauaugauauucaaccggcuuuuccgcauuuuuuaucguucuugcuccaugugcggcuugauacauuauagaccaggacucaagaucgauuuaaccaaaacuaacagaugugguaguugcaucuguggauucgacgagcagcaaucaucugguuuugaauaugaaauauuucuaaaggauaugcauguccagaaagaaucaugcaaauuuaguccaagaguaaaccacuuuaggaauauuaaagcuuuauuauuugcacuuguaaucugugcuacuauauauacaguuuaugcagaugaagauugcuuaucuaaagauauuaaaauaacauaucaagaguugcacaauugcauagguccaaagauaaugggcgauacuuguguaucaaagagugaauuguauucugauuuauucucaaaaaaucuagucacagaauaugauaaaaaauauuuugaacccgauacuguaaaugaucaauucaacaagauagaguuugcccaagaugcacauagaaugauacuauuagaaagaauacuuuacaagacagaaugugaaaugcuaagcuuaaaaaagaacaguggaccuuauaauguugccuggcgcacauauuuaaaaaaucauaauauagacuuaugcaguaggcacaacuauaaaaugauaugucaguguauuaauacacacucuauguguaauaauacagauauagauuauaacaaagagaucgaaacauauuauaaaagcaaugcugcagccuauagagcugaccugaacaccauaauggacacauuaaaaacagcauucagagggcuuacaaagguccuaauugaaaauuauauagaaaaagaugacucugaugcucuuaaggccuuauuuaguaauauuacugauucuguucaggacaauuaucagaugauuggaauauugaaauuugccaguaagcuauuagauauuaaccuugguagauccacccgcucagcucaucauucuauaaugacaaacgaaauucccaaaucuaauccuuuuacugauuacaguuauucuaaucugaauauaaaggagugcaugucaccagagagcuugaaauguuuuaagaagagaggcaguacaccgcauacaaaccaccugcuuugcaagauagacaacaaauauaaagcauuugacuggccagagauagaaacaauucaaaaaggucaaaaauugugccuuggugacagucauugcaacuuggaauuuacagccauaacugcagacaagauuaugucauuaacuaacuguuauaaagaaucuuucacugcgcaaccagcagauaugcaggcuggaauuaaaaaaugcucagcugaugaaauuggagaauguacaacacuugaagacaagacauggccaauuauauucugugguggcaaauauuacuacucugauagcaaggagcaugccaaggacgguucuaucaacaauuauuguuuaaccaacaaaugcucugaacaacguuucccaauacaugaaaauugguucaaaaaauguaauugggacaagacccacaaagaauuuagcacuaugagacaaauaaacuauaaugauauaacuucuuauagaaaggcaauagaaucugagauaggaacagauuugaugacacaccauuauaagcccacaaagaaccuuccacauguuguaccaagguaucauaguauagauguacaagguacagaaucaacagaggguauuaucaaugguuucauacaaaauacaauaccugcuauuaguggucuaggugucgguuaucaucugaauuuucaaagcaaucaguuauuugacauaguuauuuuugugaaaaaagcuguauauaaagcacaguaccagaaagcauacaccacagguccuagcauauccauaaauauugaacacaacgaaagaugcacaggccacugccccgaaaagauuccugcaaaagaagguugguuaacauuuucuaaagagcauacuaguucuuggggaugugaagaauauggcugucuugcuauagauacaggcugucuauauggcucuugucaagaugucauacgcccagaauuagauguuuauaagaagauuggcagugagguaucacugauagaaauauguauaacuuugccucaugaaacuuauugcaaugauauggacauauuagaaccgauuauaggagauaaauuaagugcauccuuucagaauacacagacuaaucaacuuccgacccuuauagcuuauaaaaaagggaagauauacacaggucaaaucaacgauauuggaaacacagcauugcagugcggcucaauccaaguaaucaauggaucaacuaucggaacuggcagccccaaauuugauuauauaugccaugcuaugagaaggaaagauguuauuguaaggaaguguuucaaugacaauuaucagucgugcacuaggcuagaaaaacggaacgacuugaucccuuauagaaaaggcgaugucaucgaaguaucaaaaacaggaucgaacaugggccaaaugacauuuaaaauagaacuaggugauaucaacuauaaaauauuuacuaaaucaauagaucuucaaaugucuggcauuugugcugggugcauugacugugcugaaggcauuucaugcucuauaaaugcugaagugccagccgaaacagucugccauugcaaaacaaacugugaagauuuuauaaacaauauaguguuuucaccgcaaaucaagaauuacaauauaaaaguccacuguaaaucuaaaguugaaaaaauaacagcacauaucugugggagagacauugauuuacaguuaacaauuaagccauacaaucagaagauagacuugucgcaguuagaugaaucaaauuacauaagggaagaggaccuccaguguggaacaugguuauguaaagugcaaaaagaggggauugauauuauauuuaaaggauuauuuucaggcuuagggagauauuggaccauauuaauuuauucaauuauaggugugguaauaauugugauauugguuuauauccuguugcccauaggucggcuuuuaaaagcauuccuaaucagacaugaaauagaauaugccauggagcagaaaaucaaguag

SEQ ID NO: 4298 - RNA, 4263 nt, Artificial Sequence
  derived and/or modified CDS sequence (wt) from OROV(BeH759021)__KP691607.1__GP
auggcgaauuuaauaauuauuucaaugguucugagcguugccuacgggcauccucuuucaacaagucaaauuggugaccgcuguuucgcuggugguaaccucuucaaggagaugaacuugaguguaggacuuggcgaaauauguguuaaagaugacauaucuauuguuaaaaguacuacuguuuuuaguaagaauagaccagcucuugaggcaaccacaaaauuuuauagaucuuuuauugugaaagauuggucugagugcaauccagugcuagauaaauuuggaaauuuuaugguuuuaaguguugaugauaauggccauauaaugccuaaaauguacacauguagagcagcaugugauauuagauuaaacaaagauaaugcugaaauaauauuaucgucaacaaagcucaaccacuucgaaauugucggaacaacuucgacaucaggcugguucaaaaacacaauaacaaacaauuuggaacacacaugcgagcaugugaccguaaauuguggucagaaaucaguaaaauuccaugcaugcuuuagacaacauagggguuguauaagauucuuuaaaggaacauauaugccauacucaaugauugaagcaauguguguuaacauagagcuaauaauucugacauuauauaucuuugcugcaauuauauuugcauuaauuauaacaaagaguuauguggcauaccugcuccugccguuauuuuauccagugacaugguuuuacggaaagguuuauaaaaagauuaauuccugcccaaauugucuacuugcaucucauccuuucaccagcugcccuaaaaucuguauaugcgguucuagauuuaguugcacagaagcucuuaaggugcauagaauggguaaggacugcuuagguuauaaaucucuaagcaaagcuagacagauguguaagucgaaaagcugguccuuuacagcagcuauauuaacuggauuaauauugauggaauuuaucucaccaauugcaggagagagaauguauaagcuugaggaguuagcugaugaguuuauaaagcuaacagagcagguaaauauuuuagaaagagaaauggaagucuugaagcagucaauaauuguuauguuugcaaucauuuugguauuguugcuuuuugaaaauaugauauucaaccggcuuuucagcauuuuuuaucguucuugcuccaugugugguuugauacauuauagaccaggacucaagauugauuuaaccaaaacuaauaaaugcgguaguugcaucuguggauucaaugagcagcaaucaucugguuuugaauaugaaauauuucuaaaggauaugcauauccagaaagaaucaugcaaauuuaguccaagaguaaaccacuuuaggaauauuaaagcuuuauuauuugcacuuguaaucugugcuacuauauauacaguuuaugcagaugaagauugcuugucuaaagacauuaaaauaacauaucaagaguugcauaauugcauaggcccaaagauaaugggcaacacuuguguaucaaagaaugaauuguauucugauuuauucucaaaaaaucuagucacagaauaugauaaaaaauauuuugaaccugauacuguaaaugaucaauucaacaaaauagaguuugcccaagaugcacauagaaugauacuauuagaaagaauacuuuacaagacagaaugugaaaugcuaagcuuaaaaaagaacaguggaccuuauaauguugccuggcgcacauauuuaaaaaaucauaauauagaccuaugcaguaggcacaacuauaaaaugauaugucaguguauuaauacacacucuauguguaagaacacagauauagauuacaacaaagagaucgaaacauauuauaaaagcaaugcugcagccuauagagcugaccugaacaccauaauggacacauuaaaaacggcauucagagggcuuacaaagguccuaauugaaaauuauauagaaaaagaugacucugaugcucuuaaggcuuuauuuaguaauauuacugauucuguccaggacaauuaucagaugauuggaauauugaaauuugccaguaagcuauuagauauuaaccuugguagauccacccgcucagcucaucauucuauaaugacaaacgaaauucccaaaucuaauccuuuuacugauuacaguuauuccaaugugaacauaaaggagugcaugucaccagagagcuugaaauguuuuaagaagagagacaguacaccgcauacaaaccaccugcuuugcaagauagacagcaaauauaaagcauuugacuggccagagauagaaacaauucaaaaaggucaaaaauugugucuuggugacagucauugcaacuuggaauuuacagccauaacugcagauaagauuaugucauuaacuaacuguuauaaggaaucuuucacugcgcaaccagcagauaugcagacuggaauuaaaaaaugcucagcugaugaaauuggagaauguacaacacuugaagacaagacauggccgaucguauucugugguggcaaauauuacuacucugauagcaaagagcaugccaaggacgguucuaucaacaacuauuguuuaacaaacaaaugcucugaacaacguuuuccaauacaugaaaauugguuuaaaaaauguaauugggacaagacccacaaagaauuuagcacuaugagacagauaaacuauaaugauauaacuucuuauagaaaagcaauagaaucugagauaggaucagauuugaugacacaccauuauaagcccacaaagaaccuuccacauguugugccaagguaucauaguauagauguacaagguacagaaucaacagaggguauuaucaaugguuucauacaaaauacaauaccugcuauuaguggucuaggugucgguuaucaucugaauuucaaaggcaaucaguuauuugacauaguuauuuuugugaaaaaagcuguauauaaagcacaguaccagaaagcauacaccacaggucccaguauauccauaaauauugaacacaaugaaagauguacaggccacugccccgaaaagauuccugcaaaagaagguuggcuaacauuuucuaaagaacauacuaguucuuggggaugugaagaauauggcugucuugcuauagauacaggcugucuauaugguucuugucaagaugucauacgcccagaauuagauguuuauaagaagauuggcagugaaguaucacugauagaaauaugcauaacuuugccucaugaaacuuauugcaaugauauggauauauuagaaccgauuauaggugauaaauuaagugcauccuuucagaauacgcagacuaaccaacuuccgacccuuauagcuuauaaaaaagggaaaauauacacaggucaaaucaaugauauuggaaauacagcauugcagugcggcucaauccaaguaauuaaugggucaacuaucggaacuggcagccccaaauucgauuauauaugccaugcuaugagaaggaaagauguuauuguaaggaaguguuucaaugacaauuaucagucaugcacuagguuagaaaaacggaaugacuugaucccuuauagaaaaggcgaugucauugaaguaucaaaaacaggaucaaacaugggccaaaugacauucaaaauagaacuaggugaugucaacuauaaaauauucacuaaaucaauagaucuucaaaugucuggcauuugugcugggugcauugacugugcugaagguauuucaugcucuauaaaugcugaagugccggccgaaacagucugccauuguaaaacaaacugugaagauuuuauaaauaauauaguguuuucaccacaaaucaagaauuacaauauaaaaguccacuguaaaucuaaaguugaaaagauaauagcacauaucugugggagagacaucgauuuacaauuaacuguuaaaccauacaaucagaagauagauuugucgcaguuagaugaaucaaauuacauaagggaagaggaucuccagugcgggacaugguuauguaaagugcaaaaagaggggguugauauuauauucaaaggauuauuuucaggcuuagggagauauuggaccauauugauuuauucaauuauaggugugguaauaauugugauauugguuuauauccuguugcccauaggucggcuuuuaaaagcauuccuaaucagacaugaaauagaauaugccauggagcaaaaaaucaaguag

SEQ ID NO: 4299 - RNA, 4263 nt, Artificial Sequence
  derived and/or modified CDS sequence (wt) from OROV(BeH759022)__KP691610.1__GP
auggcgaauuuaauaauuauuucaauggcucugagcguugccuacgggcauccucuuucaacaagucaaauuggugaccgcuguuucgcuggugguaaccucuucaaggagaugaacuugaguguaggacuuggcgaaauauguguuaaagaugacauaucuauuguuaaaaguacuacuguuuuuaguaagaauagaccagcucuugaggcaaccacaaaauuuuauagaucuuuuauugugaaagauuggucugagugcaauccagugcuagauaaauuuggaaauuuuaugguuuuaaguguugaugauaauggccauauaaugccuaaaauguacacauguagagcagcaugugauauuagauuaaacaaagauaaugcugaaauaauauuaucgucaacaaagcucaaccacuucgaaauugucggaacaacuucgacaucaggcugguucaaaaacacaauaacaaacaauuuggaacacacaugcgagcaugugaccguaaauuguggucagaaaucaguaaaauuccaugcaugcuuuagacaacauagggguuguauaagauucuuuaaaggaacauauaugccauacucaaugauugaagcaauguguguuaacauagagcuaauaauucugacauuauauaucuuugcugcaauuauauuugcauuaauuauaacaaagaguuauguggcauaccugcuccugccguuauuuuauccagugacaugguuuuacggaaagguuuauaaaaagauuaauuccugcccaaauugucuacuugcaucucauccuuucaccagcugcccuaaaaucuguauaugcgguucuagauuuaguugcacagaagcucuuaaggugcauagaauggguaaggacugcuuagguuauaaaucucuaagcaaagcuagacagauguguaagucgaaaagcugguccuuuacagcagcuauauuaacuggauuaauauugauggaauuuaucucaccaauugcaggagagagaauguauaagcuugaggaguuagcugaugaguuuauaaagcuaacagagcagguaaauauuuuagaaagagaaauggaagucuugaagcagucaauaauuguuauguuugcaaucauuuugguauuguugcuuuuugaaaauaugauauucaaccggcuuuucagcauuuuuuaucguucuugcuccaugugugguuugauacauuauagaccaggacucaagauugauuuaaccaaaacuaauaaaugcgguaguugcaucuguggauucaaugagcagcaaucaucugguuuugaauaugaaauauuucuaaaggauaugcauauccagaaagaaucaugcaaauuuaguccaagaguaaaccacuuuaggaauauuaaagcuuuauuauuugcacuuguaaucugugcuacuauauauacaguuuaugcagaugaagauugcuugucuaaagacauuaaaauaacauaucaagaguugcauaauugcauaggcccaaagauaaugggcaacacuuguguaucaaagaaugaauuguauucugauuuauucucaaaaaaucuagucacagaauaugauaaaaaauauuuugaaccugauacuguaaaugaucaauucaacaaaauagaguuugcccaagaugcacauagaaugauacuauuagaaagaauacuuuacaagacagaaugugaaaugcuaagcuuaaaaaagaacaguggaccuuauaauguugccuggcgcacauauuuaaaaaaucauaauauagaccuaugcaguaggcacaacuauaaaaugauaugucaguguauuaauacacacucuauguguaagaacacagauauagauuacaacaaagagaucgaaacauauuauaaaagcaaugcugcagccuauagagcugaccugaacaccauaauggacacauuaaaaacggcauucagaggacuuacaaagguccuaauugaaaauuauauagaaaaagaugacucugaugcucuuaaggcuuuauuuaguaauauuacugauucuguccaggacaauuaucagaugauuggaauauugaaauuugccaguaagcuauuagauauuaaccuugguagauccacccgcucagcucaucauucuauaaugacaaacgaaauucccaaaucuaauccuuuuacugauuacaguuauuccaaugugaacauaaaggagugcaugucaccagagagcuugaaauguuuuaagaagagagacaguacaccgcauacaaaccaccugcuuugcaagauagacagcaaauauaaagcauuugacuggccagagauagaaacaauucaaaaaggucaaaaauugugucuuggugacagucauugcaacuuggaauuuacagccauaacugcagauaagauuaugucauuaacuaacuguuauaaggaaucuuucacugcgcaaccagcagauaugcagacuggaauuaaaaaaugcucagcugaugaaauuggagaauguacaacacuugaagacaagacauggccgaucguauucugugguggcaaauauuacuacucugauagcaaagagcaugccaaggacgguucuaucaacaacuauuguuuaacaaacaaaugcucugaacaacguuuuccaauacaugaaaauugguuuaaaaaauguaauugggacaagacccacaaagaauuuagcacuaugagacagauaaacuauaaugauauaacuucuuauagaaaagcaauagaaucugagauaggaucagauuugaugacacaccauuauaagcccacaaagaaccuuccacauguugugccaagguaucauaguauagauguacaagguacagaaucaacagaggguauuaucaaugguuucauacaaaauacaauaccugcuauuaguggucuaggugucgguuaucaucugaauuucaaaggcaaucaguuauuugacauaguuauuuuugugaaaaaagcuguauauaaagcacaguaccagaaagcauacaccacaggucccaguauauccauaaauauugaacacaaugaaagauguacaggccacugccccgaaaagauuccugcaaaagaagguuggcuaacauuuucuaaagaacauacuaguucuuggggaugugaagaauauggcugucuugcuauagauacaggcugucuauaugguucuugucaagaugucauacgcccagaauuagauguuuauaagaagauuggcagugaaguaucacugauagaaauaugcauaacuuugccucaugaaacuuauugcaaugauauggauauauuagaaccgauuauaggugauaaauuaagugcauccuuucagaauacgcagacuaaccaacuuccgacccuuauagcuuauaaaaaagggaaaauauacacaggucaaaucaaugauauuggaaauacagcauugcagugcggcucaauccaaguaauuaaugggucaacuaucggaacuggcagccccaaauucgauuauauaugccaugcuaugagaaggaaagauguuauuguaaggaaguguuucaaugacaauuaucagucaugcacuagguuagaaaaacggaaugacuugaucccuuauagaaaaggcgaugucauugaaguaucaaaaacaggaucaaacaugggccaaaugacauucaaaauagaacuaggugaugucaacuauaaaauauucacuaaaucaauagaucuucaaaugucuggcauuugugcugggugcauugacugugcugaagguauuucaugcucuauaaaugcugaagugccggccgaaacagucugccauuguaaaacaaacugugaagauuuuauaaauaauauaguguuuucaccacaaaucaagaauuacaauauaaaaguccacuguaaaucuaaaguugaaaagauaauagcacauaucugugggagagacaucgauuuacaauuaacuguuaaaccauacaaucagaagauagauuugucgcaguuagaugaaucaaauuacauaagggaagaggaucuccagugcgggacaugguuauguaaagugcaaaaagaggggguugauauuauauucaaaggauuauuuucaggcuuagggagauauuggaccauauugauuuauucaauuauaggugugguaauaauugugauauugguuuauauccuguugcccauaggucggcuuuuaaaagcauuccuaaucagacaugaaauagaauaugccauggagcaaaaaaucaaguag

SEQ ID NO: 4300 - RNA, 4263 nt, Artificial Sequence
  derived and/or modified CDS sequence (wt) from OROV(BeH759040)__KP691616.1__GP
auggcgaauuuaauaauuauuucaaugauucugagcguugccuacgggcauccucuuucaacaagucaaauuggugaccgcuguuucgcuggugguaaccucuucaaggagaugaacuugaguguaggacuuggcgaaauauguguuaaagaugacauaucuauuguuaaaaguacuacuguuuuuaguaagaauagaccagcucuugaggcaaccacaaaauuuuauagaucuuuuauugugaaagauuggucugagugcaauccagugcuagauaaauuuggaaauuuuaugguuuuaaguguugaugauaauggccauauaaugccuaaaauguacacauguagagcagcaugugauauuagauuaaacaaagauaaugcugaaauaauauuaucgucaacaaagcucaaccacuucgaaauugucggaacaacuucgacaucaggcugguucaaaaacacaauaacaaacaauuuggaacacacaugcgagcaugugaccguaaauuguggucagaaaucaguaaaauuccaugcaugcuuuagacaacauagggguuguauaagauucuuuaaaggaacauauaugccauacucaaugauugaagcaauguguguuaacauagagcuaauaauucugacauuauauaucuuugcugcaauuauauuugcauuaauuauaacaaagaguuauguggcauaccugcuccugccguuauuuuauccagugacaugguuuuacggaaagguuuauaaaaagauuaauuccugcccaaauugucuacuugcaucucauccuuucaccagcugcccuaaaaucuguauaugcgguucuagauuuaguugcacagaagcucuuaaggugcauagaauggguaaggacugcuuagguuauaaaucucuaagcaaagcuagacagauguguaagucgaaaagcugguccuuuacagcagcuauauuaacuggauuaauauugauggaauuuaucucaccaauugcaggagagagaauguauaagcuugaggaguuagcugaugaguuuauaaagcuaacagagcagguaaauauuuuagaaagagaaauggaagucuugaagcagucaauaauuguuauguuugcaaucauuuugguauuguugcuuuuugaaaauaugauauucaaccggcuuuucagcauuuuuuaucguucuugcuccaugugugguuugauacauuauagaccaggacucaagauugauuuaaccaaaacuaauaaaugcgguaguugcaucuguggauucaaugagcagcaaucaucugguuuugaauaugaaauauuucuaaaggauaugcauauccagaaagaaucaugcaaauuuaguccaagaguaaaccacuuuaggaauauuaaagcuuuauuauuugcacuuguaaucugugcuacuauauauacaguuuaugcagaugaagauugcuugucuaaagacauuaaaauaacauaucaagaguugcauaauugcauaggcccaaagauaaugggcaacacuuguguaucaaagaaugaauuguauucugauuuauucucaaaaaaucuagucacagaauaugauaaaaaauauuuugaaccugauacuguaaaugaucaauucaacaaaauagaguuugcccaagaugcacauagaaugauacuauuagaaagaauacuuuacaagacagaaugugaaaugcuaagcuuaaaaaagaacaguggaccuuauaauguugccuggcgcacauauuuaaaaaaucauaauauagaccuaugcaguaggcacaacuauaaaaugauaugucaguguauuaauacacacucuauguguaagaacacagauauagauuacaacaaagagaucgaaacauauuauaaaagcaaugcugcagccuauagagcugaccugaacaccauaauggacacauuaaaaacggcauucagagggcuuacaaagguccuaauugaaaauuauauagaaaaagaugacucugaugcucuuaaggcuuuauuuaguaauauuacugauucuguccaggacaauuaucagaugauuggaauauugaaauuugccaguaagcuauuagauauuaaccuugguagauccacccgcucagcucaucauucuauaaugacaaacgaaauucccaaaucuaauccuuuuacugauuacaguuauuccaaugugaacauaaaggagugcaugucaccagagagcuugaaauguuuuaagaagagagacaguacaccgcauacaaaccaccugcuuugcaagauagacagcaaauauaaagcauuugacuggccagagauagaaacaauucaaaaaggucaaaaauugugucuuggugacagucauugcaacuuggaauuuacagccauaacugcagauaagauuaugucauuaacuaacuguuauaaggaaucuuucacugcgcaaccagcagauaugcagacuggaauuaaaaaaugcucagcugaugaaauuggagaauguacaacacuugaagacaagacauggccgaucguauucugugguggcaaauauuacuacucugauagcaaagagcaugccaaggacgguucuaucaacaacuauuguuuaacaaacaaaugcucugaacaacguuuuccaauacaugaaaauugguuuaaaaaauguaauugggacaagacccacaaagaauuuagcacuaugagacagauaaacuauaaugauauaacuucuuauagaaaagcaauagaaucugagauaggaucagauuugaugacacaccauuauaagcccacaaagaaccuuccacauguugugccaagguaucauaguauagauguacaagguacagaaucaacagaggguauuaucaaugguuucauacaaaauacaauaccugcuauuaguggucuaggugucgguuaucaucugaauuucaaaggcaaucaguuauuugacauaguuauuuuugugaaaaaagcuguauauaaagcacaguaccagaaagcauacaccacaggucccaguauauccauaaauauugaacacaaugaaagauguacaggccacugccccgaaaagauuccugcaaaagaagguuggcuaacauuuucuaaagaacauacuaguucuuggggaugugaagaauauggcugucuugcuauagauacaggcugucuauaugguucuugucaagaugucauacgcccagaauuagauguuuauaagaagauuggcagugaaguaucacugauagaaauaugcauaacuuugccucaugaaacuuauugcaaugauauggauauauuagaaccgauuauaggugauaaauuaagugcauccuuucagaauacgcagacuaaccaacuuccgacccuuauagcuuauaaaaaagggaaaauauacacaggucaaaucaaugauauuggaaauacagcauugcagugcggcucaauccaaguaauuaaugggucaacuaucggaacuggcagccccaaauucgauuauauaugccaugcuaugagaaggaaagauguuauuguaaggaaguguuucaaugacaauuaucagucaugcacuagguuagaaaaacggaaugacuugaucccuuauagaaaaggcgaugucauugaaguaucaaaaacaggaucaaacaugggccaaaugacauucaaaauagaacuaggugaugucaacuauaaaauauucacuaaaucaauagaucuucaaaugucuggcauuugugcugggugcauugacugugcugaagguauuucaugcucuauaaaugcugaagugccggccgaaacagucugccauuguaaaacaaacugugaagauuuuauaaauaauauaguguuuucaccacaaaucaagaauuacaauauaaaaguccacuguaaaucuaaaguugaaaagauaauagcacauaucugugggagagacaucgauuuacaauuaacuguuaaaccauacaaucagaagauagauuugucgcaguuagaugaaucaaauuacauaagggaagaggaucuccagugcgggacaugguuauguaaagugcaaaaagaggggguugauauuauauucaaaggauuauuuucaggcuuagggagauauuggaccauauugauuuauucaauuauaggugugguaauaauugugauauugguuuauauccuguugcccauaggucggcuuuuaaaagcauuccuaaucagacaugaaauagaauaugccauggagcaaaaaaucaaguag

SEQ ID NO: 4301 - RNA, 4263 nt, Artificial Sequence
  derived and/or modified CDS sequence (wt) from OROV(BeH759146)__KP691631.1__GP
auggcgaauuuaauaauuaucucaaugguucugagcguugccuacgggcauccucuuucaacaagucaaauuggugaccgcuguuucgcuggugguaaccucuucaaggagaugaacuugaguguaggacuuggcgaaauauguguuaaagaugacauaucuauuguuaaaaguacuacuguuuuuaguaagaauagaccagcucuugaggcaaccacaaaauuuuauagaucuuuuauugugaaagauuggucugagugcaauccagugcuagauaaauuuggaaauuuuaugguuuuaaguguugaugauaauggccauauaaugccuaaaauguacacauguagagcagcaugugauauuagauuaaacaaagauaaugcugaaauaauauuaucgucaacaaagcucaaccacuucgaaauugucggaacaacuucgacaucaggcugguucaaaaacacaauaacaaacaauuuggaacacacaugcgagcaugugaccguaaauuguugucagaaaucaguaaaauuccaugcaugcuuuagacaacauagggguuguauaagauucuuuaaaggaacauauaugccauacucaaugauugaagcaauguguguuaacauagagcuaauaauucugacauuauauaucuuugcugcaauuauauuugcauuaauuauaacaaagaguuauguggcauaccugcuccugccguuauuuuauccagugacaugguuuuacggaaagguuuauaaaaagauuaauuccugcccaaauugucuacuugcaucucauccuuucaccagcugcccuaaaaucuguauaugcgguucuagauuuaguugcacagaagcucuuaaggugcauagaauggguaaggacugcuuagguuauaaaucucuaagcaaagcuagacagauguguaagucgaaaagcugguccuuuacagcagcuauauuaacuggauuaauauugauggaauuuaucucaccaauugcaggagagagaauguauaagcuugaggaguuagcugaugaguuuauaaagcuaacagagcagguaaauauuuuagaaagagaaauggaagucuugaagcagucaauaauuguuauguuugcaaucauuuugguauuguugcuuuuugaaaauaugauauucaaccggcuuuucagcauuuuuuaucguucuugcuccaugugugguuugauacauuauagaccaggacucaagauugauuuaaccaaaacuaauaaaugcgguaguugcaucuguggauucaaugagcagcaaucaucugguuuugaauaugaaauauuucuaaaggauaugcauauccagaaagaaucaugcaaauuuaguccaagaguaaaccacuuuaggaauauuaaagcuuuauuauuugcacuuguaaucugugcuacuauauauacaguuuaugcagaugaagauugcuugucuaaagacauuaaaauaacauaucaagaguugcauaauugcauaggcccaaagauaaugggcaacacuuguguaucaaagaaugaauuguauucugauuuauucucaaaaaaucuagucacagaauaugauaaaaaauauuuugaaccugauacuguaaaugaucaauucaacaaaauagaguuugcccaagaugcacauagaaugauacuauuagaaagaauacuuuacaagacagaaugugaaaugcuaagcuuaaaaaagaacaguggaccuuauaauguugccuggcgcacauauuuaaaaaaucauaauauagaccuaugcaguaggcacaacuauaaaaugauaugucaguguauuaauacacacucuauguguaagaacacagauauagauuacaacaaagagaucgaaacauauuauaaaagcaaugcugcagccuauagagcugaccugaacaucauaauggacacauuaaaaacggcauucagagggcuuacaaagguccuaauugaaaauuauauagaaaaagaugacucugaugcucuuaaggcuuuauuuaguaauauuacugauucuguccaggacaauuaucagaugauuggaauauugaaauuugccaguaagcuauuagauauuaaccuugguagauccacccgcucagcucaucauucuauaaugacaaacgaaauucccaaaucuaauccuuuuacugauuacaguuauuccaaugugaacauaaaggagugcaugucaccagagagcuugaaauguuuuaagaagagagacaguacaccgcauacaaaccaccugcuuugcaagauagacagcaaauauaaagcauuugacuggccagagauagaaacaauucaaaaaggucaaaaauugugucuuggugacagucauugcaacuuggaauuuacagccauaacugcagauaagauuaugucauuaacuaacuguuauaaggaaucuuucacugcgcaaccagcagauaugcagacuggaauuaaaaaaugcucagcugaugaaauuggagaauguacaacacuugaagacaagacauggccgaucguauucugugguggcaaauauuacuacucugauagcaaagagcaugccaaggacgguucuaucaacaacuauuguuuaacaaacaaaugcucugaacaacguuuuccaauacaugaaaauugguuuaaaaaauguaauugggacaagacccacaaagaauuuagcacuaugagacagauaaacuauaaugauauaacuucuuauagaaaagcaauagaaucugagauaggaucagauuugaugacacaccauuauaagcccacaaagaaccuuccacauguugugccaagguaucauaguauagauguacaagguacagaaucaacagaggguauuaucaaugguuucauacaaaauacaauaccugcuauuaguggucuaggugucgguuaucaucugaauuucaaaggcaaucaguuauuugacauaguuauuuuugugaaaaaagcuguauauaaagcacaguaccagaaagcauacaccacaggucccaguauauccauaaauauugaacacaaugaaagauguacaggccacugccccgaaaagauuccugcaaaagaagguuggcuaacauuuucuaaagaacauacuaguucuuggggaugugaagaauaugucugucucgcuauagauacaggcugucuauaugguucuugucaagaugucauacgcccagaauuagauguuuauaagaagauuggcagugaaguaucacugauagaaauaugcauaacuuugccucaugaaacuuauugcaaugauauggauauauuagaaccgauuauaggugauaaauuaagugcauccuuucagaauacgcagacuaaccaacuuccgacccuuauagcuuauaaaaaagggaaaauauacacaggucaaaucaaugauauuggaaauacagcauugcagugcggcucaauccaaguaauuaaugggucaacuaucggaacuggcagccccaaauucgauuauauaugccaugcuaugagaaggaaagauguuauuguaaggaaguguuucaaugacaauuaucagucaugcacuagguuagaaaaacggaaugacuugaucccuuauagaaaaggcgaugucauugaaguaucaaaaacaggaucaaacaugggccaaaugacauucaaaauagaacuaggugaugucaacuauaaaauauucacuaaaucaauagaucuucaaaugucuggcauuugugcugggugcauugacugugcugaagguauuucaugcucuauaaaugcugaagugccggccgaaacagucugccauuguaaaacaaacugugaagauuuuauaaauaauauaguguuuucaccacaaaucaagaauuacaauauaaaaguccacuguaaaucuaaaguugaaaagauaauagcacauaucugugggagagacaucgauuuacaauuaacuguuaaaccauacaaucagaagauagauuugucgcaguuagaugaaucaaauuacauaagggaagaggaucuccagugcgggacaugguuauguaaagugcaaaaagaggggguugauauuauauucaaaggauuauuuucaggcuuagggagauauuggaccauauugauuuauucaauuauaggugugguaauaauugugauauugguuuauauccuguugcccauaggucggcuuuuaaaagcauuccuaaucagacaugaaauagaauaugccauggagcaaaaaaucaaguag

SEQ ID NO: 4302 - RNA, 4263 nt, Artificial Sequence
  derived and/or modified CDS sequence (wt) from OROV(BeH759620)__KP691622.1__GP
auggcgaauuuaauaauuauuucaaugguucugagcguugccuacgggcauccucuuucaacaagucaaauuggugaccgcuguuucgcuggugguaaccucuucaaggagaugaacuugaguguaggacuuggcgaaauauguguuaaagaugacauaucuauuguuaaaaguacuacuguuuuuaguaagaauagaccagcucuugaggcaaccacaaaauuuuauagaucuuuuauugugaaagauuggucugagugcaauccagugcuagauaaauuuggaaauuuuaugguuuuaaguguugaugauaauggccauauaaugccuaaaauguacacauguagagcagcaugugauauuagauuaaacaaagauaaugcugaaauaauauuaucgucaacaaagcucaaccacuucgaaauugucggaacaacuucgacaucaggcugguucaaaaacacaauaacaaacaauuuggaacacacaugcgagcaugugaccguaaauuguggucagaaaucaauaaaauuccaugcaugcuuuagacaacauagggguuguauaagauucuuuaaaggaacauauaugccauacucaaugauugaagcaauguguguuaacauagagcuaauaauucugacauuauauaucuuugcugcaauuauauuugcauuaauuauaacaaagaguuauguggcauaccugcuccugccguuauuuuauccagugacaugguuuuacggaaagguuuauaaaaagauuaauuccugcccaaauugucuacuugcaucucauccuuucaccagcugcccuaaaaucuguauaugcgguucuagauuuaguugcacagaagcucuuaaggugcauagaauggguaaggacugcuuagguuauaaaucucuaagcaaagcuagacagauguguaagucgaaaagcugguccuuuacagcagcuauauuaacuggauuaauauugauggaauuuaucucaccaauugcaggagagagaauguauaagcuugaggaguuagcugaugaguuuauaaagcuaacagagcagguaaauauuuuagaaagagaaauggaagucuugaagcagucaauaauuguuauguuugcaaucauuuugguauuguugcuuuuugaaaauaugauauucaaccggcuuuucagcauuuuuuaucguucuugcuccaugugugguuugauacauuauagaccaggacucaagauugauuuaaccaaaacuaauaaaugcgguaguugcaucuguggauucaaugagcagcaaucaucugguuuugaauaugaaauauuucuaaaggauaugcauauccagaaagaaucaugcaaauuuaguccaagaguaaaccacuuuaggaauauuaaagcuuuauuauuugcacuuguaaucugugcuacuauauauacaguuuaugcagaugaagauugcuugucuaaagacauuaaaauaacauaucaagaguugcauaauugcauaggcccaaagauaaugggcaacacuuguguaucaaagaaugaauuguauucugauuuauucucaaaaaaucuagucacagaauaugauaaaaaauauuuugaaccugauacuguaaaugaucaauucaacaaaauagaguuugcccaagauucacauagaaugauacuauuagaaagaauacuuuacaagacagaaugugaaaugcuaagcuuaaaaaagaacaguggaccuuauaauguugccuggcgcacauauuuaaaaaaucauaauauagaccuaugcaguaggcacaacuauaaaaugauaugucaguguauuaauacacacucuauguguaagaacacagauauagauuacaacaaagagaucgaaacauauuauaaaagcaaugccgcagccuauagagcugaccugaacaccauaauggacacauuaaaaacggcauucagagggcuuacaaagguccuaauugaaaauuauauagaaaaagaugacucugaugcucuuaaggcuuuauuuaguaauauuacugauucuguccaggacaauuaucagaugauuggaauauugaaauuugccaguaagcuauuagauauuaaccuugguagauccacccgcucagcucaucauucuauaaugacaaacgaaauucccaaaucuaauccuuuuacugauuacaguuauuccaaugugaacauaaaggagugcaugucaccagagagcuugaaauguuuuaagaagagagacaguacaccgcauacaaaccaccugcuuugcaagauagacagcaaauauaaagcauuugacuggccagagauagaaacaauucaaaaaggucaaaaauugugucuuggugacagucauugcaacuuggaauuuacagccauaacugcagauaagauuaugucauuaacuaacuguuauaaggaaucuuucacugcgcaaccagcagauaugcagacuggaauuaaaaaaugcucagcugaugaaauuggagaauguacaacacuugaagacaagacauggccgaucguauucugugguggcaaauauuacuacucugauagcaaagagcaugccaaggacgguucuaucaacaacuauuguuuaacaaacaaaugcucugaacaacguuuuccaauacaugaaaauugguuuaaaaaauguaauugggacaagacccacaaagaauuuagcacuaugagacagauaaacuauaaugauauaacuucuuauagaaaagcaauagaaucugagauaggaucagauuugaugacacaccauuauaagcccacaaagaaccuuccacauguugugccaagguaucauaguauagauguacaagguacagaaucaacagaggguauuaucaaugguuucauacaaaauacaauaccugcuauuaguggucuaggugucgguuaucaucugaauuucaaaggcaaucaguuauuugacauaguuauuuuugugaaaaaagcuguauauaaagcacaguaccagaaagcauacaccacaggucccaguauauccauaaauauugaacacaaugaaagauguacaggccacugccccgaaaagauuccugcaaaagaagguuggcuaacauuuucuaaagaacauacuaguucuuggggaugugaagaauauggcugucuugcuauagauacaggcugucuauaugguucuugucaagaugucauacgcccagaauuagauguuuauaagaagauuggcagugaaguaucacugauagaaauaugcauaacuuugccucaugaaacuuauugcaaugauauggauauauuagaaccgauuauaggugauaaauuaagugcauccuuucagaauacgcagacuaaccaacuuccgacccuuauagcuuauaaaaaagggaaaauauacacaggucaaaucaaugauauuggaaauacagcauugcagugcggcucaauccaaguaauuaaugggucaacuaucggaacuggcagccccaaauucgauuauauaugccaugcuaugagaaggaaagauguuauuguaaggaaguguuucaaugacaauuaucagucaugcacuagguuagaaaaacggaaugacuugaucccuuauagaaaaggcgaugucauugaaguaucaaaaacaggaucaaacaugggccaaaugacauucaaaauagaacuaggugaugucaacuauaaaauauucacuaaaucaauagaucuucaaaugucuggcauuugugcugggugcauugacugugcugaagguauuucaugcucuauaaaugcugaagugccggccgaaacagucugccauuguaaaacaaacugugaagauuuuauaaauaauauaguguuuucaccacaaaucaagaauuacaauauaaaaguccacuguaaaucuaaaguugaaaagauaauagcacauaucugugggagagacaucgauuuacaauuaacuguuaaaccauacaaucagaagauagauuugucgcaguuagaugaaucaaauuacauaagggaagaggaucuccagugcgggacaugguuauguaaagugcaaaaagaggggguugauauuauauucaaaggauuauuuucaggcuuagggagauauuggaccauauugauuuauucaauuauaggugugguaauaauugugauauugguuuauauccuguugcccauaggucggcuuuuaaaagcauuccuaaucagacaugaaauagaauaugccauggagcaaaaaaucaaguag

SEQ ID NO: 4303 - RNA, 4263 nt, Artificial Sequence
  derived and/or modified CDS sequence (wt) from OROV(BeAn19991)__KP052851.1__GP
auggcgaauuuaauaauuauuucaaugguucugggcguugccuaugggcauccgcuuucaacaagucaaauuggugaccgcuguuuugcuggugguaaccucuucaaggagaugaacuugaguguaggacuuggcgaaauauguguuaaagaugacauaucuauuguuaagaguacuacuguuuuuagcaagaauaaaccagcucuugaggcaacuacaaaauuuuauagaucuuuuauugugaaagauuggucugagugcaauccagugcuagacaaauuuggaaauuuuaugguuuuaaguguugaugauaauggccauauaauaccuaaaauguauacauguagagcagcaugugauauuagauuaaacaaagauaaugccgaaauaauauuaucgucaacaaaacucaaccacuuugaaauugucgggacaacuucgacaucaggcugguucaagaacacaauaacaaacaacuuagaacauacaugcgagcauguaaccguaaauuguggucagaaaucaguaaaauuccaugcaugcuuuagacaacauagggguuguauaagauucuuuaaaggaacauauaugccauacucaaugauugaagcaaugugcguuaacauagagcuaauaauucugacauuauauaucuuugcugcaauuauauuugcauuaauuauaacaaagaguuauguggcauacuugcuccugccguuauuuuauccagugacgugguuuuacggaaagguuuauaaaaagauuaauucuugcccaaauugucuacuugcaucucacccuuucaccagcugcccuaaaaucuguauaugcgguucuagguuuaguugcacagaagcucuuaagguacauagaauggguaaggacugcuuagguuauaagucucuaagcaaagcuagacagauguguaaaucgaaaagcugguccuucacagcagcuauauuaacuggauuaauauugauggaauucaucucaccaauugcaggagagagaauguauaagcuugaggagcuggcugaugaguuuauaaagcuaacagagcagguaaauauuuuagaaagagaaauggaagucuugaagcagucaauaauuguuauguuugcaaucauuuugguauuguugcuuuuugaaaauaugauauucaaccggcuuuuccgcauuuuuuaucguucuugcuccaugugcggcuugauacauuauagaccaggacucaagaucgauuuaaccaaaacuaacagaugugguaguugcaucuguggauucgacgagcagcaaucaucugguuuugaauaugaaauauuucuaaaggauaugcauguccagaaagaaucaugcaaauuuaguccaagaguaaaccacuuuaggaauauuaaagcuuuauuauuugcacuuguaaucugugcuacuauauauacaguuuaugcagaugaagauugcuuaucuaaagauauuaaaauaacauaucaagaguugcacaauugcauagguccaaagauaaugggcgauacuuguguaucaaagagugaauuguauucugauuuauucucaaaaaaucuagucacagaauaugauaaaaaauauuuugaaccugauacuguaaaugaucaauucaacaagauagaguuugcccaagaugcacauagaaugauacuauuagaaagaauacuuuacaagacagaaugugaaaugcuaagcuuaaaaaagaacaguggaccuuauaauguugccuggcgcacauauuuuaaaaaucauaauauagacuuaugcaguaggcacaacuacaaaaugauaugucaguguauuaauacacacucuauguguaagaauacagauauagauuauaacaaagagaucgaaacauauuauaaaagcaaugcugcagccuauagagcugaccugaacaccauaauggacacauuaaaaacagcauucagagggcuuacaaagguccuaauugaaaauuauauagaaaaagaugacucugaugcucuuaaggccuuauuuaguaauauuacugauucuguucaggacaauuaucagaugauuggaauauugaaauuugccaguaagcuauuagauauuaaccuugguagauccacccgcucagcucaucauucuauaaugacaaacgaaauucccaaaucuaauccuuuuacugauuacaguuauucuaaucugaauauaaaggagugcaugucaccagagagcuugaaauguuuuaagaagagagacaguacaccgcauacaaaccaccugcuuugcaagauagacaacaaauauaaagcauuugacuggccagagauagaaacaauucaaaaaggucaaaaauugugccuuggugacagucauugcaacuuggaauuuacagccauaacugcagacaagauuaugucauuaacuaacuguuauaaagaaucuuucacugcgcaaccagcagauaugcaggcuggaauuaaaaaaugcucagcugaugaaauuggagaauguacaacacuugaagacaagacauggccaauuauauucugugguggcaaauauuacuacucugauagcaaggagcaugccaaggacgguucuaucaacaauuauuguuuaaccaacaaaugcucugaacaacguuucccaauacaugaaaauugguucaaaaaauguaauugggacaagacccacaaagaauuuagcacuaugagacaaauaaacuauaaugauauaacuucuuauagaaaggcaauagaaucugagauaggaacagauuugaugacacaccauuauaagcccacaaagaaccuuccacauguuguaccaagguaucauaguauagauguacaagguacagaaucaacagaggguauuaucaaugguuucauacaaaauacaauaccugcuauuaguggucuaggugucgguuaucaucugaauuucaaaggcaaucaguuauuugacauaguuauuuuugugaaaaaagcuguauauaaagcacaguaccagaaagcauacaccacagguccuagcauauccauaaauauugaacacaacgaaagaugcacaggccacugccccgaaaagauuccugcaaaagaagguugguuaacauuuucuaaagagcauacuaguucuuggggaugugaagaauauggcugucuugcuauagauacaggcugucuauauggcucuugucaagaugucauacgcccagaauuagauguuuauaagaagauuggcagugagguaucacugauagaaauauguauaacuuugccucaugaaacuuauugcaaugauauggacauauuagaaccgauuauaggagauaaauuaagugcauccuuucagaauacacagacuaaucaacuuccgacccuuauagcuuauaaaaaagggaagauauacacaggucaaaucaacgauauuggaaacacagcauugcagugcggcucaauccaaguaaucaauggaucaacuaucggaacuggcagccccaaauuugauuauauaugccaugcuaugagaaggaaagauguuauuguaaggaaguguuucaaugacaauuaucagucgugcacuaggcuagaaaaacgaaacgacuugaucccuuauagaaaaggcgaugucaucgaaguaucaaaaacaggaucgaacaugggccaaaugacauuuaaaauagaacuaggugauaucaacuauaaaauauuuacuaaaucaauagaucuucaaaugucuggcauuugugcugggugcauugacugugcugaaggcauuucaugcucuauaaaugcugaagugccagccgaaacagucugccauugcaaaacaaacugugaagauuuuauaaacaauauaguguuuucaccgcaaaucaagaauuacaauauaaaaguccacuguaaaucuaaaguugaaaaaauaacagcacauaucugugggagagacauugauuuacaguuaacaauuaagccauacaaucagaagauagacuugucgcaguuagaugaaucaaauuacauaagggaagaggaccuccaguguggaacaugguuauguaaagugcaaaaagaggggauugauauuauauuuaaaggauuauuuucaggcuuagggagauauuggaccauauuaauuuauucaauuauaggugugguaauaauugugauauugguuuauauccuguugcccauaggucggcuuuuaaaagcauuccuaaucagacaugaaauagaauaugccauggagcagaaaaucaaguag

SEQ ID NO: 4304 - RNA, 4263 nt, Artificial Sequence
  derived and/or modified CDS sequence (wt) from OROV(Tr9760)__AF312381.2__GP
auggcgaauuuaauaauuauuucgaugguucugagcauugccuaugggcauccgcucucaacaagucaaauuggugaccgcuguuuugcuggugguaaccucuucaaggagaugaacuugaguguaggacuuggcgaaauauguguuaaagaugacauaucuauuguuaagaguacuacuguuuuuagcaagaauaaacuggcucuugaagcaacuacaaaauuuuauagauccuuuaucguaaaagacuggucugagugcaauccagugcuagacaaauuuggaaauuuuaugguuuuaaguguugaugauaacggccauacaauaccuaaaauguauacauguagagcagcaugugauauuagauuaaacaaagauaaugccgaaauaauauuaucgucaacaaaacucaaccacuuugaaauugucgggacaacuucgacaucaggcugguuuaagaacacaauaacaaacaaccuagaacauacaugcgagcauguaacuguaaauuguggucagaaaucaguaaaauuccaugcaugcuuuagacaacauagggguuguguaagauuuuuuaaagggacauauaugccacacucaaugaucgaagcaaugugcguuaacauagagcuaauaauucugacauuauauaucuuugcugcaauuauauuugcacuaauuauaacaaagaguuauguagcauaccugcuccugccguuauuuuauccagcaacgugguuuuauggaaagguuuauaaaaagauuaauucuugcccaaacugucuacuugcaucucacccuuucaccagcugccccaaaaucuguauaugcgguucuagguuuaguugcacagaagcucuuaaggugcauagaauggguaaggacugcuuaggcuauaaaucucuaagcaaagcuagacagauguguaaaucgaaaagcugguccuucacagcagcuauauuaacuggauuaauauugauggaauucaucucaccaauugcaggagagagaauguauaagcuugaggaguuggccgaugaguuuauaaagcuaacagagcaggugaauauucuagaaagagaaauggaagucuugaagcagucaauaauuguuauguuugcaaucauuuuaguauuguuacuuuuugaaaauaugauauucaaccggcuuuuccgcauuuuuuaucguucuugcuccaugugcggcuugauacauuauagaccaggacucaaaaucgauuuaaccaaaacuaacagauguggcaguugcaucuguggauucgacgagcagcagucgucugguuuugaauaugaaauauuuuuaacggauaugcauguccaaaaagaaucaugcaaauucaguccaagaguaaaccacuuuaggaauacuaaagcuuuauuauuugcacuuguaaucugugcuaccauauauacaguuuaugcagaugaagauugcuuaucuaaagauauuaaaauaacauaucaagaguugcacaacugcauagguccaaagauaaugggcgauacuuguguaucaaagagugaauuguauucugauuuauucucaaaaaaucuagucacagaauaugauaaaaaauauuuugaaccugauacuguaaaugaucaauucaacaagauagaauuugcccaagaugcacauagaaugauacuauuagaaagaauacuuuacaagacagaaugugaaaugcuaagcuuaaaaaagaacaguggaccuuauaauguugccuggcgcacacauuuaaaaaaucauaauauagacuuaugcaguaggcacaacuacaaaaugauaugucaguguauuaaugcacacucuauguguaagaauacagacauagauuauaacaaagagaucgaaacauauuacaaaagcaaugcugcagccuauagagcuggccugaacaccauaauggacacauuaaaaacagcauucagagggcuuacaaagguccuaauugaaaauuauauagaaaaagaugacucugaugcucuuaaggccuuauuuaguaauauuacugauucuguccaggacaacuaucagaugauuggaauauugaaauuugcuaguaagcuauuagauauuaaccuugguagauccacccgcucagcucaucauucuauaaugacaaacgaaauucccaaaucuaauccuuuuacugauuacaguuauucuaauguuaauauaaaggaaugcaugucgccagagagcuugaaauguuuuaagaagagagacaguacaccgcauacaaaccaccugcuuugcaagauagacaacaaauauaaagcauuugacuggccagagauagaaacaauucaaaaaggucaaaaauuaugccuuggugacagucauugcaacuuggaauuuacagccauaacugcagacagaauuaugucauuaacuaacuguuauaaagaaucuuucacugcgcaaccagcagauaugcaggcuggaauuaaaaaaugcucggcugaugaaauaggagaauguacaacacuugaagacaagacauggccaauuguauucuguagcggcaaauauuacuacucugauagcaaggagcaugccaaagacgguucuaucaacaauuauuguuuaaccaacaaauguucugaacaacguuucccaauacaugaaaauugguucaaaaaauguaauugggacaagacccacaaagaauuuaggccauaugagacaaauaacuauaaugauauaacuucuuauagaaaagcaauagaaucugagauaggaacagauuugaugacacaccauuauaagcccacaaagaaccuuccacauguuguaccaagguaucauaguauagauguacaagguacagaaucaacagaggguauuaucaaugguuucauacaaaauacaauaccugcuauuaguggucuagauguugguuaucaucugaauuucaaaggcaaucaguuauuugacauaguuauuuuuguaaaaaaagcuguauauaaagcacaguaccagaaagcauacaccacagguccuagcauauccauaaauauugaacauaacgaaagaugcacaggccacugccccgaaaagauuccugcaaaagaagguugguuaacauuuucuaaagagcauacuaguucuuggggaugugaagaauauggcugucuugcuauagauacaggcuguuuauauggcucuugucaagaugucauacgcccagaauuagauguuuauaagaagauuggcagugaggcaucacugauagaaauauguauaacuuugccucaugaaacuuauugcaaugauauggacauauuagaaccgauuauaggagauaaauuaagugcauccuuucagaauacacagacuaaucaacuuccgacccuuauagcuuauaaaaagggaaaaauauacacaggucaaaucaaugauauuggaaacacagcauugcagugcggcucaauccaaguaaucaauggaucaacuaucggaacuggcagcccaaaauuugauuauauaugccaugcuaugagaaggaaagauguuaucguaaggaaguguuucaaugacaacuaucagucgugcacuaggcuagaaaagcgaaaugacuugauuccuuauagaaaaggcgaugucaucgaaguaucaaaaacaggaucgaacaugggccaaaugacauuuaaaauagaacuaggugauauuaacuauaaaauauuuacuaaaucaguagaucuucaaaugucuggcauuugugcugggugcauugacugugcugaagguauuucaugcucuauaaaugcugaagugccagccgaaacagucugccauugcaaaacaaacugugaagauuuuauaaacaauauaguguuuucaccgcaaaucaagaauuacaauauaaaaguccacuguaaaucuaagguugaaaaaauaacagcacauaucugugggagagacauugauuuacaguugacaguuaagccauacaaucagaagauagacuugucgcaguuagaugaaucaaauuacauaagggaagaggaccuccaguguggaacaugguuauguaaggugcaaaaagaggggauugauauuauguuuaaaggauuauuuucaggcuuagggagauauuggaccauauuaauuuauucaauuauaggugugguaauaauugugauauugguuuauauccuauugcccauaggucgccuuuuaaaagcauuccuaaucagacaugaaauagaauaugccauggagcagaaaaucaaguag

SEQ ID NO: 4305 - RNA, 4263 nt, Artificial Sequence
  derived and/or modified CDS sequence (wt) from OROV(TRVL-9760)__KC759123.1__GP
auggcgaauuuaauaauuauuucgaugguucugagcauugccuaugggcauccgcucucaacaagucaaauuggugaccgcuguuuugcuggugguaaccucuucaaggagaugaacuugaguguaggacuuggcgaaauauguguuaaagaugacauaucuauuguuaagaguacuacuguuuuuagcaagaauaaacuggcucuugaagcaacuacaaaauuuuauagauccuuuaucguaaaagacuggucugagugcaauccagugcuagacaaauuuggaaauuuuaugguuuuaaguguugaugauaacggccauauaauaccuaaaauguauacauguagagcagcaugugauauuagauuaaacaaagauaaugccgaaauaauauuaucgucaacaaaacucaaccacuuugaaauugucgggacaacuucgacaucaggcugguuuaagaacacaauaacaaacaaccuagaacauacaugcgagcauguaacuguaaauuguggucagaaaucaguaaaauuccaugcaugcuuuagacaacauagggguuguauaagauuuuuuaaagggacauauaugccauacucaaugaucgaagcaaugugcguuaacauagagcuaauaauucugacauuauauaucuuugcugcaauuauauuugcacuaauuauaacaaagaguuauguagcauaccugcuccugccguuauuuuauccagcaacgugguuuuauggaaagguuuauaaaaagauuaauucuugcccaaacugucuacuugcaucucacccuuucaccagcugccccaaaaucuguauaugcgguucuagguuuaguugcacagaagcucuuaaggugcauagaauggguaaggacugcuuaggcuauaaaucucuaagcaaagcuagacagauguguaaaucgaaaagcugguccuucacagcagcuauauuaacuggauuaauauugauggaauucaucucaccaauugcaggagagagaauguauaagcuugaggaguuggccgcugaguuuauaaagcuaacagagcaggugaauauucuagaaagagaaauggaagucuugaagcagucaauaauuguuauguuugcaaucauuuuaguauuguuacuuuuugaaaauaugauauucaaccggcuuuuccgcauuuuuuaucguucuugcuccaugugcggcuugauacauuauagaccaggacucaaaaucgauuuaaccaaaacuaacagauguggcaguugcaucuguggauucgacgagcagcagucgucugguuuugaauaugaaauauuuuuaaaggauaugcauguccaaaaagaaucaugcaaauucaguccaagaguaaaccacuuuaggaauacuaaagcuuuauuauuugcacuuguaaucugugcuaccauauauacaguuuaugcagaugaagauugcuuaucuaaagauauuaaaauaacauaucaagaguugcacaacugcauagguccaaagauaaugggcgauacuuguguaucaaagagugaauuguauucugauuuauucucaaaaaaucuagucacagaauaugauaaaaaauauuuugaaccugauacuguaaaugaucaauucaacaagauagaauuugcccaagaugcacauagaaugauacuauuagaaagaauacuuuacaagacagaaugugaaaugcuaagcuuaaaaaagaacaguggaccuuauaauguugccuggcgcacauauuuaaaaaaucauaauauagacuuaugcaguaggcacaacuacaaaaugauaugucaguguauuaaugcacacucuauguguaagaauacagacauagauuauaacaaagagaucgaaacauauuacaaaagcaaugcugcagccuauagagcugaccugaacaccauaauggacacauuaaaaacagcauucagagggcuuacaaagguccuaauugaaaauuauauagaaaaagaugacucugaugcucuuaaggccuuauuuaguaauauuacugauucuguccaggacaacuaucagaugauuggaauauugaaauuugcuaguaagcuauuagauauuaaccuugguagauccacccgcucagcucaucauucuauaaugacaaacgaaauucccaaaucuaauccuuuuacugauuacaguuauucuaauguuaauauaaaggaaugcaugucgccagagagcuugaaauguuuuaagaagagagacaguacaccgcauacaaaccaccugcuuugcaagauagacaacaaauauaaagcauuugacuggccagagauagaaacaauucaaaaaggucaaaaauuaugccuuggugacagucauugcaacuuggaauuuacagccauaacugcagacagaauuaugucauuaacuaacuguuauaaagaaucuuucacugcgcaaccagcagauaugcaggcuggaauuaaaaaaugcucggcugaugaaauaggagaauguacaacacuugaagacaagacauggccaauuguauucuguagcggcaaauauuacuacucugauagcaaggagcaugccaaagacgguucuaucaacaauuauuguuuaaccaacaaauguucugaacaacguuucccaauacaugaaaauugguucaaaaaauguaauugggacaagacccacaaagaauuuagcacuaugagacaaauaaacuauaaugauauaacuucuuauagaaaagcaauagaaucugagauaggaacagauuugaugacacaccauuauaagcccacaaagaaccuuccacauguuguaccaagguaucauaguauagauguacaagguacagaaucaacagaggguauuaucaaugguuucauacaaaauacaauaccugcuauuaguggucuagguguugguuaucaucugaauuucaaaggcaaucaguuauuugacauaguuauuuuuguaaaaaaagcuguauauaaagcacaguaccagaaagcauacaccacagguccuagcauauccauaaauauugaacauaacgaaagaugcacaggccacugccccgaaaagauuccugcaaaagaagguugguuaacauuuucuaaagagcauacuaguucuuggggaugugaagaauauggcugucuugcuauagauacaggcuguuuauauggcucuugucaagaugucauacgcccagaauuagauguuuauaagaagauuggcagugaggcaucacugauagaaauauguauaacuuugccucaugaaacuuauugcaaugauauggacauauuagaaccgauuauaggagauaaauuaagugcauccuuucagaauacacagacuaaucaacuuccgacccuuauagcuuauaaaaagggaaaaauauacacaggucaaaucaaugauauuggaaacacagcauugcagugcggcucaauccaaguaaucaauggaucaacuaucggaacuggcagcccaaaauuugauuauauaugccaugcuaugagaaggaaagauguuaucguaaggaaguguuucaaugacaacuaucagucgugcacuaggcuagaaaagcgaaaugacuugauuccuuauagaaaaggcgaugucaucgaaguaucaaaaacaggaucgaacaugggccaaaugacauuuaaaauagaacuaggugauauuaacuauaaaauauuuacuaaaucaguagaucuucaaaugucuggcauuugugcugggugcauugacugugcugaagguauuucaugcucuauaaaugcugaagugccagccgaaacagucugccauugcaaaacaaacugugaagauuuuauaaacaauauaguguuuucaccgcaaaucaagaauuacaauauaaaaguccacuguaaaucuaagguugaaaaaauaacagcacauaucugugggagagacauugauuuacaguugacaguuaagccauacaaucagaagauagacuugucgcaguuagaugaaucaaauuacauaagggaagaggaccuccaguguggaacaugguuauguaaggugcaaaaagaggggauugauauuauguuuaaaggauuauuuucaggcuuagggagauauuggaccauauuaauuuauucaauuauaggugugguaauaauugugauauugguuuauauccuauugcccauaggucgccuuuuaaaagcauuccuaaucagacaugaaauagaauaugccauggagcagaaaaucaaguag

SEQ ID NO: 4306 - RNA, 4263 nt, Artificial Sequence
  derived and/or modified CDS sequence (wt) from OROV(TVP-19244/DEI-216)__KP795073.1__GP
auggcgaaucuaauaauuauuucaaugauccugggcauugccuauggacauccgcucucaacaagucagauuggugaccgcuguuuugcuggugguauccuuuuuaaagaaaugaaucugagugugggacuuggcgaaauauguguuaaagacgauauaucuauuguuaagaguacaacugccuuuaguaagaaugcacuggcacuugaagcaacuacaaaauucuauaggucuuuuauugucaaagauuggucugaaugcaauccaguauuagacaaauuugggaauuucaugguuuugaauguugaugauaacgggcauuuagucccuaagauguauacgugcagggcagcaugugauauuagauugaauaaggauaaugcggagauaauauugucaucaacaaagcuuaaccauuucgaaauugucgggacuacuucaacgucagguugguuuaaaaacacaauaacaaauaaucuagaacacacaugcgaacaugugacuguuaauuguggucagaaaucaguaaaauuccaugcaugcuuucgacagcauagggguuguauaagauucuucaaagggacauauaugccguacucaaugauugaagcaaugugcgucaauauagaauuaauaauccuaacauuguauaucuuugcugcaauuauauuugcauuaaucauaacaaagagcuauauagcauacuuacucuuaccauuguuuuauccgguaaccuggcuuuacggaaaaguuuacaagaggauuaauucauguccuaauugucuacuugcaucacaucccuuuacuagcugcccaaaaaucuguauaugugguucuagauuuagcugcacagaagcccucaaaguacacaggauggguaaagacugccuagguuauaaaucccuaagcaaagcuagacaaauguguaagucuaaaagcuggucauucacagcagcuauacugacuggcuuaauauugauggaauuuguuucaccaauugcaggcgaaaggauguacaaacuugaagaauuggcugacgauuacauagaacugacagagcaggugaauauauuaggaaaagaaaucaaaauuuuaaaacaaucuauaauugucaugcuugcaauuauuuugauacuacugcuuuccgaaaacauaaucuucaauuaccucuucagcacccuuuaucgcucuuguucuauguguggauugauacacuauagaccgggacucaagguugauucgaccaagacuaacaaaugcgggaguugcauuugcggguucgaugagcaacaaucaucuggguuugaauacgaaguauuuuuaaaagacaugcauguucaaagggaaucuugcaaauuuggaccuagaguaaaucauuuuagaaacacuaagauuuuguuauuuacaguugcuauuugcacuucuuuuuauacaguuuaugcagaugaagacugcuugucuaagaauauuaggauaacauaucaagaauuacacaauuguauaggaccgcacauaaugggugacaccuguaugucaaaaagugaauuguauucugaucugcucucaaagaauuuaaucacagaauaugacaaaaaauauuuugaaccugacacugugaaugaccaauuuaacaaaaucgaauucgcucaagaugcacacagaaugauauuguuggaaagaauacuuuauaagaccgaaugcgagaugcugagcuuaaagaaaaauaguggaccuuacaauguugcuuggcgcacauauuugaaaaaucauaacauagaucuaugcagcaggcauaauuacaaaaugauaugucaguguaucaacacgcauuccauguguaaaaauacagauauagacuucaauaaagaaauugaaacauauuauaaggccaaugcugcagcuuauaggucugacuucaacacaauaauagauacacugaaaacagcauuuagaggacuuacaaaaguacugauugaaaauuacauagaaaaagaugauucugaugcccugaaggcuuuguuuagcaauauuacugauuccguucaggacaacuaucagaugguuggugugcuaaaauuugcuagcaaguuacuaaauauuaguuuagguaggacuacccgcucagcucaacauucaauaaugacuaacgaaauuccuaagucaaacccuuuuaccgauuauaguuauucuagugucaacauuaaagaauguaugucaccggagagcuuaaaauguuuuaagaaaagagacagugcaccgcauaugaaccauuugcuuuguaagauggacaacaaauauaaagcauuugacuggccagaaauagagacaguucagaaagggcaaaaguugugucuuggugauagccacugcaacuuagaauuuacugcuauaacugcagacaagauuaugucauuaacuaauuguuacaaagagucuuucacugcacaaccugccgacaugcaaacugguauuaaaaaauguucagcugaugagaucggagaauguauaacccuugaggauaaaucauggccaauuguuuucugcggagauaaauacuauuacucugaugguaaagaacaugcaaaagacggaucuauuaacaauuauugucuugcaaauaagugcuccgaacagcgguuuccaauacauaaaaauugguucaaaaagugcaacugggacaaaacucauaaggaauucaccacuaugaggcaaauaaauuacaaugacauaacuucauacaggaaggcaauugaaucggaaauaggaacagaccuaaugacgcaucauuauaagcccacaaagaaucucccacauguugugccacgauaucacaguauagauguucaagguacagaaucaacagaagguauuauuaauggguucauacaaaauacaauaccugcuaucagcggcuuaggcgucggcuaccacuuagguuucaaaggaaaucaacuauuugacauaguuauuuuuguuaaaaaggcuguauauaaagcacaauaucagaaaguguacacaacugggccuaguauaucuauaaauaucgaacauaaugaaaaguguacaggccacugccccgaaaaaaucccugcaaaagaaggcugguugacauuuucuaaggaacauacaagcucuugggggugugaggaguaugguugccuugccauagacacuggcugccuauaugguucuugccaagacguuauacgcccagaauuagauauuuauaaaaagauugguagugaagcaucacuuauagaaauauguauaacuuugccucaugagacauauugcaaugauauggauauauuagaaccuauuauuggagacaaauugagugcaucuuuucaaaauacacaaacaaaccagcugccaaaccucauggcuuauaaaaagggaaaagucuauacuggacagauaaaugauguaggaaacacagcauuacaaugcgguucaauacaaguagucaaugguucaacuauugggucuggcaauccuaaauuugauuauauaugccaugcuaugagacggaaagacgucauugugagaaaaugcuucaaugacaauuaucagucuugcacuagacugaauccaagaaaugauuuaauuccuuacaggaagggugauauuauugagauaucgaagacagggucaaauaugggucaaaugacauuuaaaauagaguugggugauauuaauuauaaaauauuuacuaaaucaguggaucuccagaugucugguauuugugcuggaugcauugauugugcugaaggcauaucauguucuauaaaugcugaugugucagcugaaacugucugccacuguaaaacaaacugugaagacuuuauaagcaauauuguaaucucaccccaaaucaaaacuuauaauauaaaaguacacuguaagucaaaaguuaaaaagauaacagcaaauaucugugggagaaauauugauuuacaacugacaguuaagccguacaaucaaaaaauagaucugucacagcuggaugaaucgaauuauauaaaagaagaggaccuccaaugcggaacauggcugugcaaaguccaaaaagaaggaauugauauuguauucaaaggacuauuuucaggauuagggaaauauugggcuauucuaauuuacucaauuauagggauaauuguagucauauuguugauauaugucuuacugccaauaggacgccuccuaaaggcauuccuaaucaaaaaugaaauagaauacaccauggagcaaaaaauuaaauag

SEQ ID NO: 4307 - RNA, 4263 nt, Artificial Sequence
  derived and/or modified CDS sequence (wt) from OROV(TVP-19249/GML-444672)__KP795076.1__GP
auggcgaaucuaauaauuuuuucaauaauccuaggcauugccuaugggcauccgcucucaacaagucagauuggugaccgcuguuuugcuggugguagccuuuuuaaagaaaugaaccugagugugggacuuggcgaaauaugcgucaaagacgacauaucuauuguuaagaguacaacugccuuuaguaagaauacacuagcacucgaagcaacuacaaaauucuauaggucuuuuaucgucaaagacuggucugaaugcaauccaguauuagauaagcuugggaauuucaugguucugaauguugaugauaacgggcauuuagucccuaggauguauacaugcagagcagcaugugauauuagauugaauaaagacaaugcagaaauaauauugucaucgacaaagcuuaaccacuuugaaauuguugggacaacuucaacaucagguugguuuaagaauacaauaacaaauaaucuagaacauacaugcgaacaugugacuguuaauugcggucagaaaucaguaaaauuccaugcaugcuuucggcagcauagggguuguauaagauucuuuaaagggacauacaugccguauucaaugauugaagcaaugugcauuaauauagaauuaauaauccuaacauuguauaucuuugcugcaauuauauuugcacuaaucauaacgaagagcuauauagcauacuuacuccuaccauuguucuauccgguaaccuggcuuuacggaaaaguuuacaaaaggauuaauucaugcucuaauugccuacuugcaucacaucccuuuacuagcugcccgaagaucugcauauguggcucuagauuuagcugcacagaagcccucaaaguacacaggauggguaaagacugucuagguuauaaaucccuaagcaaagcuagacagaugugcaaaucuaaaagcuggucauucacagcagcuauacuaacuggcuuaauauugauggaauuuguuucaccaauugcaggugaaaggauguacaaacuugaagagcuggccgacgauuacauagaaauggcagagcggguggguauguuagaaaaagaaauaaaaguuuuaaaacaguucacgauugucaugcuuguaauuauucugauacugcugcuuuuugaaaacacaaucuucaauuaccucuuuaacacccuuuaucguucuuguucuauguguggguugauacacuauagaccagggcucaagguugauuugaccaagacuaacaaaugcgggaguugcauuugcggauuugacgagcaacaaucaucuggguuugaauacgaaguauucuuaaaggacaugcauauucaaagggaaucuugcaaauuuggaccuagaguaaaccacuuuaggaacaccaagauuuuguuguuuacaauugcuauuugcacuucuuuuuauacaguuuaugcagaugaagacugcuuguccaagaauauuaagauaacauaucaagaauuacacaauuguauaggaccauacauaaugggcgacaccugugugucaaaaagugaauuauauucugaucugcuuucaaagaauuuaaucacagaauaugacaaaaaauauuuugaaccagacacuguaaaugaccaauucaacaaaauugaauucgcucaggaugcacacagaaugauacuguuggaaagaauacuuuauaagaccgaaugcgagaugcugagcuuaaagaagaauaguggaccuuacaauguugcuuggcgcacauacuugaaaaaucauaacauagauuugugcagcaggcauaauuacaaaaugauaugccaguguaucaauaugcauucuauguguaaaaauacagauauagacuucaacaaugaaauugaaacauauuauaaggccaaugccgcagcuuauaggucugacuucuacacaauaauagauacacugaaaacagcauuuagaggacuuacgaaaguacugaucgaaaauuacauagaaaaagaugauucugaugcucuaaaggcuuuguuuagcaauauuacuaauucuguucaggacaacuaucagaugguuggcguacuaaaauuugcuagcaaguuacuaaauauuaguuuagguaggucuacccgcucggcucaacauucaauaaugacuaaugaaaucccuaagucaaacccuuuuacugauuauaguuauucuagcgucaacauuaaagaauguaugucgccagagagcuuaaaauguuuuaagaaaagagacaguguaccgcauacgaaccauuugcucuguaagauggauaacaaguauaaagcauuugacuggccagaaauagagacaguucaaaaagggcaaaaguugugucuuggugauagccacuguaacuuagaauuuacagcuauaacugcagacaagauuaugucauuaacuaauuguuacaaagagucuuucacugcacagccugcugacaugcaaacugguaucaaaaaauguucagcugacgagaucggagaauguauaacccuugaggauaaagcguggccaauuguugucugcggagacaaauacuauuacucugaugguaaagaacaugcaaaagaugggucuauuaacaauuauugucuugcaaauaaaugcucugaacagcgauuuccaauacauaaaaauugguucaaaaaaugcaacugggacaaaacucacaaagaguucaccacuaugaggcaaauaaauuacaaugacauaacuucauacagaaaggcaauugaaucagaaauaggaacagaccuaaugacacaucauuacaaacccacaaagaaucucccacauguuguuccacgauaucacaguauagauguucaagguacagaaucaacagaaggcauuauuaauggguucauacaaaauacaauaccugcuaucagcggcuuagguguuggcuaucacuuagguuucagaggaaaucaacuauuugauauaguuauuuuuguuaaaaaggcuguauauaaagcacaauaucagaaaguguacacaacuggacccaguauaucuauaaauauugaacacaaugaaaaguguacaggccacugucccgaaaaaauaccugcaaaagaagguugguugacauuuucuaaggaacauacaagcucuugggggugugaggaguaugguugccuugccauagacacugguugucuauaugguucuugccaagauguuauacguccagaauuagauauuuauaagaagauuggcagcgaagcaucacuuauagaaauauguauaacuuugccucaugagacuuauugcaaugauauggauauauuagaaccuauuauuggagauaaauuaagugcauccuuucaaaauacacaaacaaaccaacugccaguccucauggcuuauaagaaggggaaagucuauacuggacagauaaaugauguugggaacacagcguuacaaugugguucaauacaaguagucaaugguucaacuauugggucuggcaauccuaaauuugacuauauaugccaugcuaugaggcgaaaagacgucauugugagaaaaugcuucaaugauaauuaucagucuugcacuagacuggaugcgagaaaugauuuaauuccuuauaggaaaggcgauauuauugagauaucaaaaacagggucaaauaugggucaaaugacauuuaaaauagaguuaggcgauauuaauuauaaaauauuuacuaagucgguggaucuccaaaugucugguauuugugccggaugcauugauugugccgaaggcauaucauguucuauaaaugccgauguaucagcugaaacugucugccauuguaaaacaaacugcgaagacuuuauaagcaauauuguaaucucaccucaaaucaaaacuuauaauauaaaaguacauugcaagucaaaaguugaaaagauaacagcaaauaucugugggagaaauauugacuuacaauugacaguuaagccguacaaccaaaagauagaucuaucacagcuggaugaaucgaauuauauaaaagaagaagaccuccaauguggaacauggcuguguaaaguccagaaagaagggauugauauuguauuuaaaggacuauuuucaggauuagggaaauauuggaccauucuaauuuacucaauuauagggauaauuguaauuguauuauugauauaugucuuacugccaauaggacgucucuuaaaagcauuccuaaucaaaaaugaaauagaauacaccauggaacaaaaaauuaaauag

SEQ ID NO: 4308 - RNA, 4263 nt, Artificial Sequence
  derived and/or modified CDS sequence (wt) from OROV(TVP-19254/GML-480914)__KP795082.1__GP
auggcgaauuuaauaauuauuucaaugguucugagcguugcuuaugggcauccgcuuucaacaagucaaauuggugaccgcuguuucgcuggugguaaccucuucaaggagaugaacuugaguguaggacuuggcgaaauauguguuaaagaugacauaucuauugucaaaaguaccacugcuuuuaguaagaauaaaccagcucuugaagcaacuacaaaauuuuauaggucuuuuauugugaaagauuggucugagugcaauccagugcuagacaaauuuggaaauuuuauggucuuaaguguugaugacaauggccauauaauaccuaaaauguauacauguagagcagcaugugauauuagauuaaacaaagauaaugcugaaauaauauuaucgucaacaaaacucaaccacuuugaaauugucgggacaacuucgacaucaggcugguucaagaacacaauaacaaacaauuuagaacacacaugcgagcaugugaccguaaauuguggucagaaaucaguaaaauuccaugcaugcuuuagacaacauagggguuguauaagauucuuuaaaggaacauauaugccauacucaaugauugaagcaaugugcguuaacauagagcuaauaauucugacauuauauaucuuugcugcaauuauauuugcauuaauuauaacaaagaguuacguggcauacuugcuccugccguuauuuuauccagugacgugguuuuacgggaagguuuauaaaaagauuaauuccugcccaaauugucuacuugcaucccacccuuucaccagcugcccuaaaaucuguauaugcgguucuagauuuaguugcacagaagcucuuaagguacauagaauggguaaggacugcuuagguuauaaaucucuaagcaaagcuagacagauguguaagucgaaaagcugguccuuuacggcagcuauauuaacuggauuaauauugauggaauuuaucucaccaauugcaggagagagaauguauaagcuugaagaguuggcugaugaauuuauaaagcuaacagagcagguaaauauuuuagaaagagaaauggaagucuugaagcagucaguaauuguuaugcuugcaaucauuuuaguauuguugcuuuuugaaaauaugauauucaaccggcuuuuccgcauuuuuuaucguucuugcuccaugugcgguuugauacauuauagaccaggacucaagaucgauuuaaccaaaacuaauagaugcgguaguugcaucuguggauucgaugaacagcaaucaucugguuuugaauaugaaauauuucuaaaggauaugcauauccagaaagaaucaugcaaguuuagcccaagaguaaaccacuuuaggaauauuaaagcuuuauuauuugcacuuguaaucugugcuacuauauauacaguuuaugcagaugaagauugcuuaucuaaaaauauuaaaauaacauaucaagaguugcauaauugcauagguccaaaaauaaugggcgauacuuguguaucaaagagugaauuguauucugauuuauucucaaaaaaucuagucacagaguaugauaaaaaauauuuugaaccugauacuauaaaugaucaauucaacaagauagaguuugcccaagaugcacauagaaugauacuauuagaaagaauacuuuacaagacagaaugugaaaugcuaagcuuaaaaaagaacaguggaccuuauaauguugccuggcgcacauauuuaaaaaaucauaauauagaccuaugcaguaggcacaacuauaaaaugauaugucaguguauuaauacacacucuauguguaagaauacagauauagauuauaacaaagagaucgaaacauauuauaaaagcaacgcugcagccuauagagcugaccugaacacuauaauagacacauuaaagacagcauucagagggcuuacaaagguccuaauugaaaauuauauagaaaaagaugauucugaugcucuuaaggccuuauuuaguaauauuacugauucuguccaggacaauuaucagaugauuggaauauugaaauuugccaguaagcuauuagauauuaaccucgguagauccacccgcucagcucaucauucuauaaugacaaacgaaauucccaaaucuaauccuuuuacugauuacaguuauuccaaugugaauauaaaggagugcaugucaccagaaagcuugaaauguuuuaagaagagagacaguacaccgcauacaaaccaccugcuuuguaagauagacaacaaauauaaagcauucgacuggccagagauagaaacaauucaaaaaggucaaaaauugugucuuggugacagucauugcaacuuggaauuuacagccauaacugcagacaagauuaugucauuaacuaacuguuauaaagaaucuuucacugcgcaaccagcagauaugcaggcuggaauuaaaaaaugcucagcugaugaaauuggagaaugcacaacacuugaagacaagacauggccaauuguauucugugguggcaaauauuacuacucugauagcaaggagcaugccaaggacgguucuaucaacaauuauugucuaaccaacaaaugcucugaacaacguuucccaauacaugaaaauugguucaaaaaauguaauugggacaagacccauaaagaauuuaguacuaugaaacagauaaacuauaaugauauaacuucuuauagaaaggcaauagaaucugagauaggaacagauuuaaugacacaccauuauaagcccacaaagaaccuuccgcauguuguaccaagguaucauaguauagaugugcaagguacagaaucaacagagggucuuaucaaugguuucauacaaaauacaauaccugcuauuaguggucuaggugucgguuaucaucugaauuucaaaggcaaucaauuauuugacauaguuauuuuuguaaaaaaagcuguguauaaagcacaguaccagaaagcauacaccacaggccccagcauauccauaaauauugaacacaaugaaagaugcacaggccacugccccgaaaagauuccugcaaaagaagguuggcuaacauuuucuaaagaacauacuaguucuuggggaugugaagaauauggcugucuugcuauagauacaggcugucuauauggcucuugucaagaugucauacgcccagaauuagauguuuauaagaagauuggcagugagguaucacugauagaaauaugcauaacuuugccucacgaaacuuauugcaaugauauggacauauuagaaccgauuauaggagauaaauuaagugcauccuuucagaauacgcagacuaaucaacuuccgacccuuauagcuuauaaaaaggggaaaauauacacaggucaaaucaaugauauuggaaacacagcauuacagugcggcucaauccaaguaauuaauggaucaacuaucggaacuggcagccccaaauuugauuauauaugccaugcuaugagaaggaaagauguuauuguaaggaaguguuucaaugacaauuaucagucaugcacuagguuagaaaaacggaacgacuugaucccuuauagaaaaggcgaugucauugaaguaucaaaaacaggaucgaacaugggccaaaugacauuuaaaauagaacuaggugauaucaacuauaaaauauucacuaaaucaauagaccuucaaaugucuggcauuugugcugggugcauugacugugcugaagguauuucaugcucuauaaaugcugaaguaucagccgaaacagucugccauugcaaaacaaacugugaagauuuuauaaacaauauaguguuuucaccacaaaucaaaaauuacaauauaaaaguccacuguaaaucuaaaguugaaaagauaauagcacauaucugugggaaagacauugauuuacaguuaacaguuaagccauacaaucagaagauagacuuaucgcaguuagaugaaucaaauuacauaagagaagaggaccuccaguguggaacaugguuauguaaagugcaaaaagaggggauugauauuauauucaaaggauuauuuucaggcuuagggagauauuggaccauauuaauuuauucaauuauaggugugguaauaauugugauauugguuuauauccuguugcccauaggucggcuuuuaaaagcauuccuaaucagacaugaaauagaauaugccauggagcagaaaaucaaguag

SEQ ID NO: 4309 - RNA, 4263 nt, Artificial Sequence
  derived and/or modified CDS sequence (wt) from OROV(TVP-19256/IQE-7894)__KP795085.1__GP
auggcgaaucuaauaauuauuucaaugauccugggcauugccuaugggcauccacucucaacaagucagauuggugaccgcuguuuugcuggugguagccuuuuuaaagaaaugaaucugagugugggacuuggcgaaauauguguuaaagacgauauaucuauuguuaagaguacaacugccuuuaguaagaaugcacuagcacuugaagcaacuacaaaauucuauaggucuuuuauugucaaagauuggucugaaugcaacccaguauuagauaaauuugggaauuucaugguucugaauguugaugauaacgggcauuuaguuccuaagauguauacgugcagggcagcaugugauauuagauugaauaaggauaaugcggaaguaauauugucaucaacaaagcuuaaccauuucgaaauugucgggacuacuucaacaucggguugguuuaaaaauacaauaacaaauaaucuagaacacacaugcgaacaugugacuguuaauugcggucagaaaucaguaaaauuccaugcaugcuuucgacagcauagggguuguauaagguucuucaaaggggcauauaugccguacucaaugauugaagcaaugugugucaauauagaauuaauaauccuaacauuguauauuuuugcugcaauuauauuugcauuaaucauaacaaagagcuauauagcauacuuacuccuaccauuguuuuauccgguaaccuggcuuuacggaaaaguuuacaaaaggauuaauucauguccuaauugucuacuugcaucacaccccuuuacuagcugcccaaaaaucuguauaugcgguucuagauuuagcugcacagaagcccucaaagugcacaggauggggaaagacugucuagguuauaaaucccuaagcaaagcuagacaaauguguaagucuaaaagcuggucauucacagcugcuauacuaacuggcuuaauauugauggaauuuguuucaccaauugcaggcgaaaggauguacaaacuugaagagcuggcugacgauuacauagaacuggcagagcaggugaauauauuaggaaaagaaaucaaaauuuuaaaacaaucuauaauugucaugcuugcaauuauuuugauacuacugcuuuccgagaauauaaucuucaauuaccucuucaaaacccuuuaucgcucuuguucuaugugcggguugauacacuauagaccaggacucaagguugauuugaccaagacuaacaaaugcgggaguugcauuugcggguucgaugagcaacaaucaucuggguuugaauacgagguauuuuuaaaagacaugcauguucaaagggaaucuugcaaauucggaccuagaguaaaccauuuuagaaacacuaagauuuuguuauuuacaauugcuauuugcacuucuuuuuauacaguuuaugcagaugaagacugcuuguccaagaauauuaggauaacauaucaagaauuacacaauugcauaggaccacacauaaugggugacaccugcaugucaaagagugaauuguauucugaucugcuuucaaagaauuuaaucacagaauaugacaaaaaauauuucgaaccugacacuguaaaugaccaauucaacaaaaucgaauucgcucaagaugcacacagaaugauauuauuggaaagaauacuuuauaagaccgaaugcgagaugcugagcuuaaagaaaaauaguggaccuuacaauguugcuuggcgcacauauuugaaaaaucauaacauagauuugugcagcaggcauaauuacaaaaugauaugucaguguaucaacacgcauuccauguguaaaaauacagauauagacuucaauaaagaaauugaaacauauuauaaggccaaugcugcagcuuauaggucugacuucaacacaauaauagauacauuaaaaacagcauuuagaggacuuacaaaaguacugauugaaaauuacauagaaaaagaugauucugaugcccugaaggcuuuguuuagcaauauuacugauucuguucaggacaacuaucagaugguuggugugcuaaaauuugcuagcaaguugcuaaauaucaguuuagguaggacuacccguucagcucaacauucaauaaugacuaacgaaauuccuaagucaaaccccuuuacugauuauaguuauucuaguguuaauauuaaagaauguaugucaccagagagcuuaaaauguuuuaagaaaagagacaguguaccacauacgaaccauuugcuuugcaagauggauaacaaauauaaaguauuugacuggccagaaauagagacaguucagaaagggcaaaaguugugucuuggugauagccacugcaacuuagaauuuacugcuauaacugcagacaagauuaugucauuaacuaauuguuauaaagagucuuucacugcacaaccugccgacaugcaaacugguauuaaaaaauguucagcugaugagauuggagaauguauaacccuugaggauaaaucguggccaauuguuuucugcggagauaaauacuauuacucugaggguaaagaacaugcaaaagauggauccauuaauaauuauugucuugcaaauaaaugcuccgaacagcgguucccaauacauaaaaauuggcucaaaaagugcaacugggacaaaacucauaaggaguucaccacuaugaggcgaauaaauuacaaugacauaacuucauacagaaaggcaauugaguccgaaauaggaacagaucuaaugacacaccauuauaagcccacaaagaaucuuccacauguuguuccacgcuaucacaguauagauguucaagguacagaaucaacagaagguauuaucaauggguucauacaaaacacgauaccugcuaucagcggcuuaggcgucggcuaccacuuagguuuuaaaggaaaucaacuauuugacauaguuauuuuuguuaaaaaggcuguauauaaagcgcaauaucagaaaguguacacaacuggaccuaguauaucuauaaauaucgaacauaaugaaaaguguacaggccacugucccgaaaaaauaccugcuaaagaagguugguugacauuuucuaaggaacauacaagcucuugggggugugaggaguauggcugccuugccauagacacuggcugucuauaugguucuugccaagauguuauacgcccagaauuagauauuuauaaaaagauugguagugaagcaucacuuauagaaauauguauaacuuugccucaugagacauauugcaaugauauggauauauuagaaccuauuauuggggauaaauugagugcaucuuuucaaaauacacaaacaaaucagcugccaaaccucauggcuuauaaaaagggaaaagucuauacuggacagauaaaugauguaggaaacacagcauuacaaugcgguucaauacaaguagucaaugguucgacuauugggucuggcaauccuaaauuugauuauauaugccaugcuaugagacgaaaagaugucauugugagaaaaugcuucaaugacaauuaccagucuugcacuagacuagauccaagaaaugauuuaauuccuuacaggaagggcgauauuguugagauaucgaagacagggucaaauaugggucaaaugacauuuaaaauagaguugggugauauuaauuauaaaauauuuacuaaaucaguagaucuccagaugucugguauuugugcuggaugcauugauugugcugaaggcauaucauguucuauaaaugccgaugcgucagcugaaacugucugccacuguaaaacaaauugugaagacuuuauaagcaauauuguaaucucaccccaaaucaaaacuuauaauauaaaaguacauugcaagucaaaagucgaaaagauaacagcaaauaucugugggagaaauauugacuuacaauuaacaguuaagccguacaaucaaaaaauagaucugucacagcuggaugaaucgaauuacauaaaagaagaagaccuccaaugcggaacauggcuguguaaaguccaaaaagaaggaauugauauuguauuuaaaggacuauuuucaggauuagggaaauauugggccauucuaauuuacucaauuauagggguaauuguagucauauuauugauauauguccuacugccaauaggacgccuucuaaaggcauuccuaaucaaaaaugaaauagaguauaccauggagcaaaaaauuaaauag

SEQ ID NO: 4310 - RNA, 4263 nt, Artificial Sequence
  derived and/or modified CDS sequence (wt) from OROV(TVP-19257/IQT-1690)__KP795088.1__GP
auggcgaaucuaauaauuauuccaaugauccugggcauugccuauggacauccgcucucaacaagucagauuggugaccgcuguuuugcuggugguagccuuuuuaaagaaaugaaucugagugugggacuuggcgaaauauguguuaaagacgauauaucuauuguuaagaguacaacugccuuuaguaagaaugcacuagcacuugaagcaacuacaaaauucuauaggucuuuuauugucaaagauuggucugaaugcaauccaguauuagacaaauuugggaauuucaugguuuugaauguugaugauaacgggcauuuagucccuaagauguauacgugcagggcagcgugugauauuagguugaauaaggauaaugcggaaauaauauugucgucaacaaagcuuaaccauuucgaaauugucgggaccacuucaacgucagguugguuuaaaaacacaauaacaaauaaucuagaacacacaugugaacaugugacuguuaauuguggucaaagaucaguaaaauuccaugcaugcuuucgacagcauagggguuguauaagguucuucaaagggacauauaugccguacucaaugauugaagcaaugugcgucaauauagaauuaauaauccuaacauuguauaucuuugcugcaauuauauuugcauuaaucauaacaaagagcuauauagcauacuuacuccuaccauuguuuuauccgguaaccuggcuuuacggaaaaguuuacaagaggauuaauucauguccuaauugccuacuugcaucacaccccuuuacuagcugcccaaaaaucuguauaugugguucuagauuuagcugcacagaagcccucaaaguacacaggauggguaaagacugccuagguuauaaaucccuaagcaaagcuagacaaauguguaagucuaaaagcuggucauucacagcagcuauacugacuggcuuaauauugauggaauuuguuucaccaauugcaggugaaaggauguacaaacuugaagaauuggcugacgauuacauagaacuggcagagcaggugaauauauuaggaaaagaaaucaaaauuuuaaaacaaucuauaauugucaugcuugcaauuauuuugauacuacugcuuuccgaaaacauaaucuucaauuaccucuucaacacccuuuaucgcucuuguucuauguguggauugauacacuauagaccggggcucaagguugauuugaccaagacuaacaaaugcgggaguugcauuugcggguucgaugaacaacaaucaucuggguuugaauacgagguauuuuuaaaagacaugcauguucaaagggaaucuugcaaauuuggaccuagaguaaaccauuuuaggaacacuaagauuuuguuauuuauaauugcuauuugcacuucuuuuuauacaguuuaugcagaugaagacugcuugucuaagaauauuaggauaacauaucaagaauuacacaauuguauaggaccacacauaaugggugacaccuguaugucaaaaagugaauuguauucugaucugcuuucaaagaauuuaaucacagaauaugacaaaaaauauuuugaaccugacacugugaaugaccaauuuaacaaaaucgaauucgcccaagaugcacacagaaugauauuguuggaaagaauacuuuauaagaccgaaugcgagaugcugagcuuaaagaaaaauaguggaccuuacaauguugcuuggcgcacauauuugaaaaaucauaacauagaucuaugcagcaggcauaauuacaaaaugauaugucaguguaucaacacgcauuccauguguaaaaauacagauauagacuucaauaaagaaauugaaacauauuauaaggccaaugcugcagcuuauaggucugacuucaacacaauaauagauacauuaaaaacagcauuuagaggacuuacaaaaguacugauugaaaauuacauagaaaaagaugauucugaugcccugaaggcuuuguuuagcaauauuacugauuccguucaggacaacuaucagaugguuggugugcuaaaauuugcuagcaaguuacuaaauauuaguuuagguaggacuacccgcucagcucaacauucaauaaugacuaacgaaauuccuaagucaaacccuuuuaccgauuauaguuauucuagugucaacauuaaagaauguaugucaccggagagcuuaaaauguuuuaagaaaagagacagugcaccgcauacgaaccauuugcuuuguaagauggacaacaaauauaaagcauuugacuggccagaaauagagacaguucagaaagggcaaaaguugugucuuggugauagccacugcaacuuagaauuuacugcuauaacugcagacaagauuaugucauuaacuaauuguuacaaagagucuuucacugcacaaccugcugacaugcaaacugguguuaaaaaauguucagcugaugagaucggagaauguauaacccuugaggauaaaucguggccaauuguuuucugcggagauaaauacuauuacucugaugguaaagaacaugcaaaagacggaucuauuaacaauuauugucuugcaaauaaaugcuccgaacagcgguuuccaauacauaaaaacugguucaaaaagugcaacugggacaaaacucauaaggaauucaccacuaugaggcaaauaaauuacaaugacauaacuucauacaggaaggcaauugaaucggaaauaggaacagaccuaaugacgcaucauuauaagcccacaaagaaucuuccacauguugugccacgauaucacaguauagauguucaagguacagaaucaacagaagguauuauuaauggguucauacaaaauacaauaccugcuaucagcggcuuaggugucggcuaccacuuagguuucaaaggaaaucaacuauuugacauaguuauuuuuguuaaaaaggcuguauauaaagcacaauaucagaaaguguacacaacugggccuaguauaucuauaaauaucgaacauaaugaaaaguguacaggccacugccccgaaaaaaucccugcaaaagaaggcugguugacauuuucuaaggaacauacaagcucuugggggugugaggaguaugguugccuugccauagacacuggcugccuauaugguucuugccaagacguuauacgcccagaauuagauauuuauaaaaagauugguagugaagcaucacuucuagaaauauguauaacuuugccucaugagacauauugcaaugauauggauauauuagaaccuauuauuggagacaaauugagugcaucuuuucaaaauacacaaacaaaccagcugccaaaccucauggcuuauaaaaaggggaaagucuauacuggacagauaaaugacguaggaaacacagcauuacaaugcgguucaauacaaguagucaaugguucaacuauugggucuggcaauccuaaauuugauuauauaugccaugcuaugagacggaaagacgucauugugagaaaaugcuucaaugacaauuaucagucuugcacuagacuggauccaagaaaugauuuaauuccuuacaggaagggugauauuauugagauaucgaagacagggucaaauaugggucaaaugacauuuaaaauagaguugggcgauauuaauuauaaaauauuuacuaaaucaguggaucuccagaugucugguauuugugcuggcugcauugauugugcugaaggcauaucauguucuauaaaugcugaugugucagcugaaacugucugccacuguaaaacaaacugugaagacuuuauaagcaauauuguaaucucaccucaaaucaaaacuuauaauauaaaaguacacuguaagucaaaaguugaaaagauaacagcaaauaucugugggagaaauauugauuuacaacugacaguuaagccguacaaucaaaaaauagaucugucacagcuggaugaaucaaauuauauaaaagaagaggaccuccaaugcggaacauggcugugcaaaguccaaaaagaaggaauugauauuguauucaaaggacuauuuucaggauuagggaaauauugggcuauucuaauuuacucaauuauagggauaauuguagucauauuguugauauaugucuuacugccaauaggacgccuccuaaaggcauuccuaaucaaaaaugaaauagaauacaccauggagcaaaaaauuaaauaa

SEQ ID NO: 4311 - RNA, 4263 nt, Artificial Sequence
  derived and/or modified CDS sequence (wt) from OROV(TVP-19258/IQT-4083)__KP795091.1__GP
auggcgaaucuaauaauuauuucaaugauccugggcauugccuauggacauccgcucucaacaagucagauuggugaccgcuguuuugcuggugguagccuuuuuaaagaaaugaaucugaguguaggacuuggcgaaauauguguuaaagacgauauauccauuguuaagaguacaacugccuuuaguaagaaugcacuggcacuugaagcaacuacaaaauucuauaggucuuuuauugucaaagauuggucugaaugcaauccaguauuagacaaauuuggaaacuucaugguuuugaauguugauaauaacgggcauuuagucccuaagauguauacgugcagggcagcaugugauauuagauugaauaaggauaaugcggagauaauauugucaucaacaaagcuuaaccauuucgaaauugucgggacuacuucaacgucagguugguuuaaaaacacaauaacaaauaaucuagaacacacaugcgaacaugugacuguuaauuguggucagaaaucaguaaaauuccaugcaugcuuucgacagcauagggcuuguauaagauucuucaaagggacauauaugccguacucaaugaucgaagcaaugugcgucaauauagaauuaauaauccuaacauuguauaucuuugcugcaauuauauuugcauuaaucauaacaaagagcuauauagcauacuuacucuuaccauuguuuuacccggcaaccuggcuuuacggaaaaguuuacaagaggauuaauucguguccuaauugucugcuugcaucacaucccuuuacuagcugccccaaaaucuguauaugugguucuagauuuagcugcacagaagcccucaaaguacacaggauggguaaagacugccuagguuauaaaucccuaagcaaagcuagacaaauguguaagucuaaaagcuggucauucacagcagcuauacugacuggcuuaauacugauggaauuuguuucaccaauugcaggcgaaaggauguacaaacuugaagaauuggcugacgauuacauagaacugacagagcaggugaauauauuaggaaaagaaaucaaaauuuuaaaacaaucuauaauugucaugcuugcaauuauuuugauacuacugcuuuccgaaaacauaaucuucaauuaccucuucaacacccuuuaucgcucuuguucuauguguggauugauacacuauagaccgggacucaagguugauuugaccaagacuaacaaaugcgggaguugcauuugcggauucgaugagcaacaaucaucuggguuugaauacgaaguauuuuuaaaagacaugcauguucaaagggaaucuugcaaauuuggaccuagaguaaaccauuuuagaaacacuaagauuuuguuauuuacaauugcuauuugcacuucuuuuuauacaguuuaugcagaugaagacugcuugucuaagaauauuaggauaacauaucaagaauuacacaauuguauagggccacacauaaugggugacacauguaugccaaaaagugaauuguauucugaucugcuuucaaagaauuuaaucacagaauaugacaaaaaauauuuugaaccugacacugugaaugaccaauuuaacaaaaucgaauucgcucaagaugcacacagaaugauauuguuggaaagaauacuuuauaagaccgaaugcgagaugcugagcuuaaagaaaaauaguggaccuuacaauguugcuuggcgcacauauuugaaaaaucauaacauagaucugugcagcaggcauaauuacaaaaugauaugucaguguaucaacacgcauucuauguguaaaaauacagauauagacuucaauaaagaaauugaaacauauuauaaggccaaugcugcagcuuauaggucugacuucaacacaauaauagauacacuaaaaacagcauuuagaggacuuacaaaaguacugauugaaaauuacauagaaaaagaugauucugaugcccugaaggcuuuguuuagcaauauuacugauuccguucaggacaacuaucagaugguuggugugcuaaaauuugcuagcaaguuacuaaauauuagcuuagguaggacuacccgcucagcucaacauucaauaaugacuaacgaaauuccuaagucaaacccuuuuaccgauuauaguuauucuaguaucaacauuaaagaauguaugucaccagagagcuuaaaauguuuuaagaaaagagacagugcaccgcauacgaaccauuugcuuuguaagauagacaacaaauauaaagcauuugacuggccagaaauagagacaguucagaaagggcaaaaguugugucuuggugauagccacugcaacuuagaauuuacugcuauaacugcagauaagauuaugucauuaacuaauuguuacaaagagucuuucacugcacaaccugccgacaugcaaacugguauuaaaaaauguucagcugaugaaaucggagaauguauaacccuugaggauaaaucguggccaauuauuuucugcggagauaaauacuauuacucugaugguaaagaacaugcaaaagacggaucuauuaacaauuauugucuugcaaauaaaugcuccgaacagcgguuuccaauacauaaaaauugguucaaaaagugcaacugggacaaaacucauaaggaauucaccacuaugaggcagauaaauuacaaugacauaacuucauacaggaaggcaauugaaucggaaauaggaacagaccuaaugacgcaucauuauaagcccacaaagaaucuuccacauguugugccacgauaucacaguauagauguucaagguacagaaucaacagaagguauuauuaauggguucauacaaaauacaauaccugcuaucagcggcuuaggugucggcuaccacuuagguuucaaaggaaaucaacuauuugacauaguuauuuuuguuaaaaaggcuguguauaaagcacaauaucagaaaguguacacaaccgggccuaguauaucuauaaauaucgaacauaaugaaaaguguacaggccacugccccgaaaaaaucccugcaaaagaaggcugguugacauuuucuaaggaacauacaagcucuugggggugugaggaguaugguugccuugccauagacacuggcugccuauaugguucuugccaagacgucauacgcccagaauuagauauuuacaaaaagauugguagugaagcaucacuuauagaaauauguauaacuuugccucaugagacauauugcaaugauauggauauauuagaaccuauuauuggagacaaauugagugcaucuuuucaaaauacacaaacaaaccagcugccaaaccucauggcuuauaaaaaggggaaagucuauacuggacagauaaaugauguaggaaacacagcauuacaaugcgguucaauacaaguagucaaugguucaacuauugggucuggcaauccuaaauuugauuauauaugccaugcuaugagacggaaagacgucauugugagaaaaugcuucaaugacaauuaucagucuugcacuagacuggauccaagaaaugauuugauuccuuacaggaagggugauauuauugagauaucgaagacagggucaaauaugggucaaaugacauucaaaauagaguugggcgauauuaauuauaaaauauuuacuaaaucaguggaucuccagaugucugguauaugugcuggaugcauugauugugcugaaggcauaucauguucuauaaaugcugaugugucagcugaaacugucugucacuguaaaacaaacugugaagacuuuauaagcaauauuguaaucucaccccaaaucaaaacuuauaauauaaaaguacacuguaagucaaaaguugaaaagauaacagcaaauaucugugagagaaauauugauuuacaacugacagucaagccguacaaucaaaaaauagaucugucacagcuggaugagucgaauuauauaaaagaagaggaccuccaaugcggaacauggcugugcaaaguccaaaaagaaggaauugauauuguauucaaaggacuauuuucaggauuagggaaauauugggcuauucuaauuuacucaauuauagggauaauuguagucauauuguugauauaugucuuacugccaauaggacgccuccuaagagcauuccuaaucaaaaaugaaauagaauacaccauggagcaaaaaauuaaauag

SEQ ID NO: 4312 - RNA, 4263 nt, Artificial Sequence
  derived and/or modified CDS sequence (wt) from OROV(TVP-19259/IQT-7085)__KP795094.1__GP
auggcgaaucuaauaauuauuucaaugauccugggcauugccuaugggcauccacucucaauaagucagauuggugaccgcuguuuugcuggugguagccuuuuuaaagaaaugaaucugagugugggacuuggcgaaauauguguuaaagacgauauaucuauuguuaagaguacaacugccuuuaguaagaaugcacuagcacuugaagcaacuacaaaauucuauaggucuuuuauugucaaagauuggucugaaugcaauccaguauuagauaaauuugggaauuucaugguuuugaauguugaugauaacgggcauuuagucccuaagauguauacgugcagggcagcaugugauauuagauugaauaaggauaaugcggaaauaauauugucaucaacaaagcuuaaccauuucgaaauugucgggacuacuucaacaucagguugguuuaaaaauacaauaacaaauaaucuagaacacacaugcgaacaugugacuguuaauugcggucagaaaucaguaaaauuccaugcaugcuuucgacagcauagggguuguauaagguucuucaaagggacauauaugccguacucaaugauugaagcaaugugugucaauauagaauuaauaauccuaacauuguauaucuuugcugcaauuauauuugcauuaaucauaacaaagagcuauauagcauacuuacuccuaccauuguuuuauccgguaaccuggcuuuacggaaaaguuuacaaaaggauuaauucauguccuaauugucuacuugcaucgcaucccuuuacuagcugcccaaaaaucuguauaugugguucuagauuuagcugcacagaagcccucaaaguacacaggauggggaaagacugucuagguuacaaaucccuaagcaaagcuagacaaauguguaagucuaaaagcuggucauucacagcagcuauacugacuggcuugauauugauggaauuuguuucaccaauugcaggcgaaaggauguacaaacuugaagaacuggcugacgauuacauagaacuggcagagcaggugaauauauuaggaaaagaaaucaaaauuuuaaaacaaucuauaguugucaugcuugcaauuauuuugauacuacugcuuuccgaaaauauaaucuucaauuaccucuucaacacccuuuaucgcucuuguucuauguguggguugauacacuauagaccaggacucaagguugauuugaccaagacuaacaaaugcgggaguugcauuugcggguucgaugagcaacaaucaucuggguuugaauacgagguauuuuuaaaagacaugcauguucaaagggaaucuugcaaauuuggaccuagaguaaaccauuuuagaaacacuaagauuuuguuauuuacaauugcuauuugcacuucuuuuuauacaguuuaugcagaugaagacugcuuguccaagaauauuaggauaacauaucaagaguuacacaauuguauaggaccacacauaaugggugacaccugcaugucaaaaagugaauuguauucugaucugcuuucaaagaauuuaaucacagaauaugacaaaaaauauuucgaaccugacacuguaaaugaccaauucaacaaaaucgaauucgcucaagaugcacacagaaugauauuguuggaaagaauacuuuauaagaccgaaugcgagaugcugagcuuaaagaaaaauaguggaccuuacaauguugcuuggcgcacauauuugaaaaaucauaacauagauuugugcagcaggcauaauuacaaaaugauaugucaguguaucaacacgcauuccauguguaaaaauacagauauagacuucaauaaagaaauugaaacauauuauaaggccaaugcugcagcuuauaggucugacuuuaacacaauaauagauacacuaaaaacagcauuuagaggacuuacaaaaguacugauugaaaauuacauagaaaaagaugauucugaugccuugaaggcuuuguuuagcaauauuacugauuccguucaggauaacuaucagaugguuggugugcuaaaauuugcuagcaaguuacuaaauauuaguuuagguaggacuacccguucagcucaacauucaauaaugacuaacgaaauuccuaagucaaacccuuuuacugauuauaguuauucuagugucaauauuaaagaauguaugucaccggagagcuuaaaauguuuuaagaaaagagacagugcaccacauacgaaccauuugcuuuguaagauggauaacaaauauaaagcauuugacuggccagaaauagagacaguucagaaagggcaaaaguugugucuuggugauagccacugcaacuuagaauuuacugcuauaacugcagacaagauuaugucauuaacuaauuguuauaaagagucuuucacugcacaaccugccgacaugcaaacugguauuaaaaaauguucagcugaugagauuggagaauguauaacccuugaggauaaaucguggccaauuguuuucugcggagauaaauacuauuacucugaugguaaagaacaugcaaaagauggaucuauuaauaauuauugucuugcaaauaaaugcuccgaacagcgguucccaauacauaaaaauugguucaaaaagugcaacugggacaaaacucauaaggaguucaccacuaugaggcaaauaaauuacaaugacauaacuucauacagaaaggcaauugaaucggaaauaggaacagaccuaaugacacaccauuauaagcccacaaagaaucucccacauguuguuccacgauaucacaguauagauguucaagguacagaaucaacagaagguauuauuaauggguucauacaaaauacgauaccugcuaucagcggcuuaggcgucggcuaccacuuagguuucaaaggaaaucaacuauuugacauaguuauuuuuguuaaaaaggcuguauauaaagcacaauaucagaaaguguacacaacugggccuaguauaucuauaaauaucgaacauaaugaaaaguguacaggccacugucccgaaaaaauaccugcuaaagaagguugguugacauuuucuaaggaacauacaagcucuugggggugugaggaguaugguugccuugccauagacacuggcugccuauaugguucuugccaagauguuauacgcccagaauuagauauuuauaaaaaaauugguagugaagcaucacuuauagaaauauguauaacuuugccucaugagacauauugcaaugauauggauauauuagaaccuauuauuggagauaaauugagugcaucuuuucaaaauacacaaacaaaucagcugccaaaccucauggcuuauaaaaagggaaaggucuauacuggacagauaaaugauguaggaaacacagcauuacaaugcggcucaauacaaguagucaaugguucaacuauugggucuggcaauccuaaauuugauuauauaugccaugcuaugagacgaaaagacgucauugugagaaaaugcuucaaugacaauuaucagucuugcacuagacuggauccaagaaaugauuuaauuccuuacaggaagggcgauauuauugagauaucgaagacagggucaaauaugggucaaaugacauuuaaaauagaguugggcgauauuaauuauaaaauauuuacuaaaucaguggaucuccagaugucugguauuugugcuggaugcauugauugugcugaaggcauaucauguucuauaaaugccgaugugucagcugaaacugucugccacuguaaaacaaacugugaagacuuuauaagcaauauuguaaucucaccccaaaucaaaacuuauaauauaaaaguacauugcaagucaaaaguugaaaagauaacagcaaauaucugugggagaaauauugacuuacaauugacaguuaagccguacaaucaaaaaauagaucugucacagcuggaugaaucgaauuacauaaaagaagaagaccuccaaugcggaacauggcuguguaaaguccaaaaagaaggaauugauauuguauucaaaggacuguuuucaggauuagggaaauauugggcuauucuaauuuacucaauuauagggguaauuguagucauauuauugauauauguccuacugccaauaggacgccuucuaaaggcauuccuaaucaaaaaugaaauagaguacaccauggagcaaaaaauuaaauag

SEQ ID NO: 4313 - RNA, 4263 nt, Artificial Sequence
  derived and/or modified CDS sequence (wt) from OROV(TVP-19262/OBS-9478)__KP795100.1__GP
auggcgaaucuaauaauuauuucaaugauccugggcauugccuauggacauccgcucucaacaagucagauuggugaccgcuguuuugcuggugguagccuuuuuaaagaaaugaaucugaguguaggacuuggcgaaauauguguuaaagacgauauauccauuguuaagaguacaacugccuuuaguaagaaugcacuggcacuugaagcaacuacaaaauucuauaggucuuuuauugucaaagauuggucugaaugcaauccaguauuagacaaauuuggaaacuucaugguuuugaauguugauaauaacgggcauuuaaucccuaagauguauacgugcagggcagcaugugauauuagauugaauaaggauaaugcagagauaauauugucaucaacaaagcuuaaccauuucgaaauuaucgggacuacuucaacgucagguugguuuaaaaacacaauaacaaauaaucuagaacacacaugcgaacaugugacuguuaauuguggucagaaaucaguaaaauuccaugcaugcuuucgacagcauagggguuguauaagauucuucaaagggacauauaugccguacucaaugaucgaagcaaugugugucaauauagaauuaauaauccuaacauuguauaucuuugcugcaauuauauuugcauuaaucauaacaaagagcuauauagcauacuuacucuuaccauuguuuuacccggcaaccuggcuuuacggaaaaguuuacaagaggauuaauucguguccuaauugucugcuugcaucacaucccuuuacuagcugccccaaaaucuguauaugugguucuagauuuagcugcacagaagcccucaaaguacacaggauggguaaagacugccuagguuauaaaucccuaagcaaagcuagacaaauguguaagucuaaaagcuggucauucacagcagcuauacugacuggcuuaauacugauggaauuuguuucaccaauugcaggcgaaaggauguacaaacuugaagaauuggcugaugauuacauagaacugacagagcaggugaauauauuaggaaaagaaaucaaaauuuuaaaacaaucuauaauugucaugcuugcaauuauuuuaauacuacugcuuuccgaaaacauaaucuucaauuaccucuucaacacccuuuaucgcucuuguucuauguguggacugauacacuauagaccgggacucaagguugauuugaccaagacuaacaaaugcgggaguugcauuugcggauucgaugagcaacaaucaucuggguuugaauacgaaguauuuuuaaaagacaugcauguucaaagggaaucuugcaaauuuggaccuagaguaaaccauuuuagaaacacuaagauuuuguuauuuacaauugcuauuugcacuucuuuuuauacaguuuaugcagaugaagacugcuugucuaagaauauuaggauaacauaucaagaauuacacaauuguauagggccacacauaaugggugacacauguaugccaaaaagugaauuguauucugaucugcuuucaaagaauuuaaucacagaauaugacaaaaaauauuuugaaccuggcacugugaacgaccaauuuaacaaaaucgaauucgcucaagaugcacacagaaugauauuguuggaaagaauacuuuauaagacugaaugcgagaugcugagcuuaaagaaaaauaguggaccuuacaauguugcuuggcgcacauauuugaaaaaucauaacauagaucugugcagcaggcauaauuacaaaaugauaugucaguguaucaacacgcauucuauguguaaaaauacagauauagacuucaauaaagaaauugaaacauauuauaaggccaaugcugcagcuuauaggucugacuucaacacaauaauagauacacuaaaaacagcauuuagaggacuuacaaaaguacugauugaaaauuacauagaaaaagaugauucugaugcccugaaggcuuuguuuagcaauauuacugauuccguucaggacaacuaucagaugguuggugugcuaaaauuugcuagcaaguuacuaaauauuagcuuagguaggacuacccgcucagcucaacauucaauaaugacuaacgaaauuccuaagucaaacccuuuuaccgauuauaguuauucuaguauuaacauuaaagaauguaugucaccagagagcuuaaaauguuuuaagaaaagagacagugcaccgcauacgaaccauuugcuuuguaagauagacaacaaauauaaagcauuugacuggccagaaauagagacaguucagaaagggcaaaaguugugucuuggugauagccacugcaacuuagaauuuacugcuauaacugcagauaagauuaugucauuaacuaauuguuacaaagagucuuucacugcacaacccgccgacaugcaaacugguauuaaaaaauguucagcugaugaaaucggagaauguauaacccuugaggauaaaucguggccaauuauuuucugcggagauaaauacuauuacucugaugguaaagaacaugcaaaagacggaucuauuaacaauuauugucuugcaaauaaaugcuccgaacagcgguuuccaauacauaaaaauugguucaaaaagugcaacugggacaaaacucauaaggaauucaccauuaugaggcagauaaauuacaaugacauaacuucauacaggaaggcaauugaaucggaaauaggaacagaccuaaugacgcaucauuauaagcccacaaagaaccuuccacauguugugccacgauaucacaguauagauguucaagguacagaaucaacagaagguauuauuaauggguucauacaaaauacaauaccugcuaucagcggcuuaggugucggcuaccacuuagguuucaaaggaaaucaacuauuugacauaguuauuuuuguuaaaaaggcuguguauaaagcacaauaucagagaguguacacaaccgggccuaguauaucuauaaauaucgaacauaaugaaaaguguacaggccauugccccgaaaaaaucccugcaaaagaaggcugguugacauuuucuaaggaacauacaagcucuugggggugugaggaguaugguugccuugccauagacacuggcugccuauaugguucuugccaagacgucauacgcccagaauuagauauuuauaaaaagauugguagugaagcaucacuuauagaaauauguauaacuuugccucaugagacauauugcaaugauauggauauauuagaaccuauuauuggagacaaauugagugcaucuuuucaaaauacacaaacaaaccagcugccaaaccucauggcuuauaagaaggggaaagucuauacuggacagauaaaugauguaggaaacacagcauuacaaugcgguucaauacaaguagucaaugguucaauuauugggucuggcaauccuaaauuugauuauauaugccaugcuaugagacggaaagacgucauugugagaaaaugcuucaaugacaauuaucagucuugcacuagacuggauccaagaaaugauuugauuccuuacaggaagggugauauuauugagauaucgaagacagggucaaauaugggucaaaugacauucaaaauagaguugggcgauauuaauuauaaaauauuuacuaaaucaguggaucuccagaugucugguauaugugcuggaugcauugauugugcugaaggcauaucauguucuauaaaugcugaugugucagcugaaacugucugucacuguaaaacaaacugugaagacuuuauaagcaauauuguaaucucaccccaaaucaaaacuuauaauauaaaaguacacuguaagucaaaaguugaaaagauaacagcaaauaucugugagagaaauauugauuuacaacugacagucaagccguacaaucaaaaaauagaucugucacagcuggaugagucgaauuauauaaaagaagaggaucuccaaugcggaacauggcugugcaaaguucaaaaagaaggaauugauauuguauucaaaggacuauuuucaggauuagggaaauauugggcuauucuaauuuacucaauuauagggauaauuguagucauauuguugauauaugucuuacugccaauaggacgccuccuaagagcauuccuaaucaaaaaugaaauagaauacaccauggagcaaaaaauuaaauag

SEQ ID NO: 4314 - RNA, 4299 nt, Artificial Sequence
  derived and/or modified CDS sequence (wt) from OROV/FPV(Aus Ch 16129)__KF697137.1__GP
augaaauucgugagcauuuuauuauuugucuccuggcuaggagcaacuuaucaaaauccugugucucaccgccaaauaggugagcgauguuuugcugguggcaguuugauaaagacugucaaccaaacuaguggaguuucugaggucugugugagagaugacauaucaaugauuaagaguauuguucauacaacaaaggccagugauacugcagucaacaauuauauacgauucuauaggguuuuuauagugaaagaauggcaugauugcaacccuuuuccugauccaaagggcacauuuaugguguuggaugucaguucgacuaaccaccuugaaccaauaacauacacaugccgaaccccaugugaaauuacacuagauaaagauucugcugaagucacucuaucaucucaaaagaugaaccauuaugaaauuucugguucaacaauaaauaacgguugguuuaagaacaguauuucaguuuccuuagagcacacaugugagcauauuacugucucuugugggcagaaaacuguaagguuccaugcuugcuuccgccagcauagaucuuguacaagauucuuuaaaaauaguaugaugccagcuaggaugacagagucuauaugucaaaauuuagaaauaauuuugcugacuugcuucucguuugucugcuucauauuucucugcauaaucacaaaaacuuauguagcauauguacugauuccggucuuuuaucccuuuacauauauuuauggccgauuguacgauaaauauuucaaauuaugcgaaaauugucuuuuggcaguccaucccuuuacuccaugugagacaguauguguguguggcucccaguaugcuaauacugaacagcuuagaacccauaggaugacaaacaacugcaaagguuacaaaucauugagcaaaucuagagcuaugugcaaaagcaaagguuguuccuuuguuguugcaaucuucuguucuauaauauuuuucucauuuaucacaccaaucaacucucaggaauauaaauuaucagaucuaccagaugaguucaccagauuagaagaggaaaauacaaugcuuaagaucaggcuuuugguuaucaagauuacaauuucagucauaucugucacaauaacuguuacaucuuuaacugagaggaaaguauuucaagaguuauuuaaugcuauauacaggcauuguccauuuugcgguaugauacacaggagaagagggcugagagugguuaacucaaccacaaacaaguguggaacuuguauuuguggauauaaagaagaaacagaacaugguguggaauaugaaauauuucuaaaaaccaugcaccaggaaaaugucaauugcauguuuaaaccaucucaaagacacuuccgcaauuucaagauauugauugcauuuuuagcaaugugcaugauuauaaccucuguaucugcugaugaaaaacauugccuuaaguauaaagaaccaguuaaacugucaaauuuaacagaaugccauagccuguggcucaauauaacagaaugucaaauaaaucaaucaacauuauuugaaacuuuaaaaggggagcaauuaguuacagacuuugauaaaccagauuuuacuauaaugggccaaaaauaugauauagcuauggaaagaauugagaaugcacaaaauuuacaucauaugauuuuacuggaauaccuacaugcaaaaaguaauuguuuaaaauauaaacaauugaagucaaauucuggaccuuacaacauaccauggagaacauacauucauggacaugguuuggauguuuguggacaauauucauauaaauugauauguaaauguaucucgacagguaugcacugugaaaacacagcauuggauauuuauaaugaaaugagacaguuuuacacaaacaaucaagaaaauuacaauuuagauuuaaauacuguuauaaaggcaauagguuuggcaaugcguggaaucgggcagaugauuauagaagaauucuuuggugagucucaaauagaagaauuaucaaauuuccugaauaugacaucaaagaaucuugguacaaauaagcaacuaaucggcuugauuaauuuuggcuuaaugcuccuugacauuaaucagacuaaaacaccgcaaauugacccaaaaccuagaacucuccaggcaagguccucgauuccuaccggaacugaaauaacagauuggacaaaaggccaaucuaagauaaaaaccugugcagaauauagcacauugaccugucaaucauggaggaagacagucaauacaaaaucauucuuaauguguaaagugucaaguaaauggcauguauauaacuggccagaaauaccaacaguuguuagaaauucaaaacuaugcuuaggugacuaucacugcaauauggaauucacaccuauagaugcagacgaagcauugaaacaguuacgguguuauaagacagaauuugugccuucaccagaugguauggaugaaucuauuaaaaagugcacucuagaaaaguuuggaggaugcacuacggccaauggacauucauggacaauaaugguguguaaugguagauauuaucaaacaaauacuagagagcacgcaaaagauggauuguuaaacagcuauugcuuugagccaaaaugucaaucaggaagacacccaauacacaagucauuuuugaacaauugcauauggaaggagagcucaaggcaaauuauagaaacaagaacuauagaauacaauaauauagaagacuauaagaaaaguguugaaucagacauaaaaagcgauuuaaccauucaccauuuuaagccaacaaaaaaucuuccucuaguuacuccaacauauauaucuguuguugcagaugggacuaugguaagugauggaauucagaaugcauauguuaaaggaacaauaccagggauaucaggaguugccacuggacuacauguuaagacuccagauggaauacuauuaauggauauuauaguauauguucgcaaagcuuuauauaaagcaaauuacgaaaaaauauacuccacuggcccaacuauagggauuaaugucaagcauaaugaaaaguguacuggcacauguccagaacauauaccaaaagaugaaggcuggcugacauucucuaaggaacacaccagcaacugggguugugaagaguauggcuguuuugcaauuaauucagggugccuauauggaucaugucaagacauaauuagaccagagcuagauauuuauaaacagcagggagaggagcagacacuuuuagaauuguguauaaccuuaccucaugaaacauuuuguaaugauuuggauguguuagagccaguaaucacugacaaauuacaauuagacuuccagacaacucaaucagaucaucuaccugagcuaguugcuuugaagaaaggauuaauauugacuggacaacuaaaugaccuaggcaauacagcagcaaugugcgguucaguucaacuugugaauaaaacuauauaugggcaaggaaauccaaaguuugauuuuauuugucaugcaaugagaagaaaagauguuauuguuaggagauguuaugauaaucauuauagcacaugugcauuauugaaacaaagaaaugauuuauugcauaaagaagucaaugaucaaaugagcauaacuguaaaugggaaaaauuugggguugauuaauuuuagauuaaauuuaggggaucuaaauuacaagcuuuuugucaaugaaccuaauuuugaacuaacuggucaaugugcuggcuguauaucuugugccgacgaaaucuccugucaacuaaauaucauugcagaucaugaguuuaccugcaagguguccagcucuuguaauuuguauauaucaaauaugaugauuacaccagcaaaucauauuuauaauuuaaagguuucuugcagagaacauguuagcaauauugaccuugcuguuuguggcagaucuuuuagucugcaugcuacacuaaagcaacauagucagaaauuagaucugucagcauuagacgagacuaauuuuguaaaagaagaagauuugagauguggaaccugguuguguaaagucaaggaugaaggauuaucauuuuuaacuagaucaauauuuggaucuuuagggacauauuggucauacuuuauuuauggucuaauauuuaugauucuuuuauucauagcaauuuauuuucucuauccgcuaugcaagagacuuaagggauuguuagaagagaaugagagagaauacuugauugaaucaaagaugaaauaa

SEQ ID NO: 4315 - RNA, 4257 nt, Artificial Sequence
  derived and/or modified CDS sequence (wt) from OROV/IQTV(IQT9924)__KF697143.1__GP
auggauugcauaauauuuuaccugucauuuuuugcuguaguuacagcacauccugugucucaccaccaaguuggugauagguguuuugccggaggcaacuugauaaaagauuugaauaagacaguaaauauuggugaaguauguguuagagaugauauaucaauaaucaaaaguacgacagcuauucaaaagucacuagaccacuuauccacucggacaaaguuuuaccguguuuacauaguuaaggaaugggcugagugcaacccaauuauugauuaugcugggaauuuuauuguuaugaacauugaugauaacggccaccuaguaccuagaaugcauaccugcagagcuucaugcgauauaagguuaaacaaaaaugacgcugaaaucauuuuaucaucgcagaaaaccaaucauuaugaaauaauuggaaccaccacugucagugguugguucaaaaauacuauaaaucugcccuuagagcacacaugugaacauauaacugugaauugcggacaaaaaucauugagauuccaugccugcuuuaggaugcauagaggaugcacuagauucuuuaaaaacacauauaugccaucaacaaugauugaacauauguguguaaaccuagaguuaauaauuuucacauuauauaucuucaccgcauugguguuugcauauauuauuacaaaaaguuauauagcauauauccuucugccauuauuuuauccauuaacuuauguauuugguauaauauacucaaaauugaagcagugcaagacauguaugcuugcugcccauccguuuacuaauugccccaagagaugugucuguggaucuagauucaauugcacagaagcucuccguguacauagauugggcagagauugccaaggauauaaaucauugaguaaagccagacagauguguaaaucaaaauccuggucuuucaucauugcaaucuucacuggacuuauacuuauggaauuuauaacaccuauccacggugaaaggacuuacaaacucagugaacuggcugaugaguuuauugcuaugaagacugaaguaacagugaugcaaagaucaauauauaaucagaaaauauuaaauauagcauugcuaacuuuagugguauuaauaauucuuuuagaaacauauauuuuuaaaauccuuuuuagucuuuuauauagaucaugcuccaugugugguuugauacauuauaaagugggccuaaaaauaaauuuauuaaccacuaauaaauguggcaccuguauuugcggauuuagugaacaacaaucuucuggguuugaauaugaaguuuucuuaaaggauaugcauaaacagcgagaauccuguaaauauuucccgauguugaaccauuuccgcaaucuaaaaauauuaacaacuauauugcuacugauucugcuagcaacuaguguuucaagugaaugccuucagaaaccauuaaaaauaaagcuggaagauuugcaugaaugcauugggguuaauuuccuugauaagcaaugcuauaauaggaagaacuuauaugagucauuaagaucgaagaaucucauuucugaaguugauaaaaaauauuuugagaacgcugauuuagaagggcaauuuaagaggauagaauaugcucaggaugcacaucggaugauacuuuuagaaagaauacucuauuccacagagugugagaugcauacuauccuaacaaaugguggagcauauaacaucccauggagaacauauuuaaagaaucacaacuugaauuuaugcggcaagcauguacauaaaaugguaugccaaugugugaauacacacacacaaugccugucuacugguauagauuaccaagacgaaauuacuaaauucuaccaagcugauggagauucauacagaucugaucuaucuauaauucuugaaacaauaucaacugcauuuagaggguuaacuaaaguuuugauugaaacuuauaucgaacaagauaauagugagucuaugauaaaauugcucaacacaauucaaggaaagguuccaaauaauuaucaaauguuagguauacuuaaauuugccauuaagaucaugaacauuaaucaaacucgagguguacgaucugccagacauacaauuguaucaaaugauauaccuaugucugaaccguuuuccaacuucgagguaucaaauauaaacauuaagcaguguuuagaaccauuaacucuaaaaugcuucacaaaaagaggugacucaccucauucuaaucaccugcuauguaaagaacaaaguaaauauaaaguauuugaauggccugaaguagaaacgguuacaaagaauaacaaacuuugcuuaggagauacucauugcaaccucaaauuuacugcaacaacaucugacgaaaucaucaaacuauugaauuguuucagugauacauacaaaccaaacccuggagaaauggaaauagggcucaaaaagugcaaugcugaaaaaauaggugagugugucacauuagaaaauagcccguggccuauaguauauugugaaaacaaauacuauuauucagaagcaaaagagcaugcaaaggaugguaguguuaauaguuacuguuuaacaaauaagugcaccgaagauagguugccuaucaacccagccugguucaaaucauguaauugggaaaaaaauauuaaggaaacagcaacaauaaaggaauuuguauacaaugacaucaagucauaccgcaagucacuagaaucagaaaucaauacagaccuaaugauacaccauuauaggccaacgaaaaauuugccgcauauuaagccuauuuauaaaucccucaguauacaaggaagcgagacaguggauggccuacagaauagcuuuauagagggagaaaugccagcuaucaguggguuagccaacgguuaucacuugauguauaaaggcacacagcuauuugauauaguaauauuuauaagaaaagcaguauacaaagccaauuauuacaaaauauacacuacugggccuaguauugcuauaaauauggagcauaaugaacaauguacaggacauuguccaagcaaaauaccuucuaaggaaaacugguugacauucucaagagaacauacuaguucaugggguugcgaagaauauggcugccuugcuauugauacaggcugucuauacgggucgugccaagaugucauuaggccugagauagaugucuacaaaaaaucuggaacugagcaaagcuugauagagcucugcauaacaucagcacaugaaacuuuuuguaaugauuuggacauacuagagcccauaauuggagaaaagauaucagcaucauuccagucuacacagucuaaccaauuacccaauauaauagccuucaggaaaggacagauacuuacaggugcuaucaaugaucuaggaaauacaggcagccagugugggucaauacaauuaguaaacaacacauuauuaggggaagggaaugucaaauuugacuauauaugccaugcuaugagaaggaaggauguuaucaucagaagguguuauaaugaccacuuuacaaguugcaaccuguugcagaagcgcucugacuugauugguaauauuaaugggaaagaauugcaaaucaguaugucaggacgaucaaugggcucaaugaaguucaaaauugaacucggggauauaaauuacaaguuguauacugaaaaugcagauauaacuauaagaggugagugcggagguugcauuggcugugcagaagcugucucauguucuuuagaaguggaauccgcuagcgaaauauuauguaaaguugaauguaauugucaaccauacauagagaacauuuugauaaaaccgcaaacaaaaaccuauucauuuaaggcuacaugcuuggaaaagucuaacaccuuagacaucaaaauaugugggaaacaaauuauagcacccuugacuauaaaaucauauaaucaaaaaauugaccuauccaaacuagacgaaucaaauuauguaaaagaagaagauuuagcaugcaacacauggcuauguaagguucaaacagaagguuucaauuuugucuucucuggcuuguuugcuggguucgguagauauuggacuaucgcaauuuauauauugauugcugugguaauuauauuaauacugauauauauauugaugccuaucuuuagauugauacggaccuucuuaauaaaaaaugagauagaauauacuacugagcaaaaaaugagauag

SEQ ID NO: 4316 - RNA, 4257 nt, Artificial Sequence
  derived and/or modified CDS sequence (wt) from OROV/IQTV(MIS-0397)__KJ866387.1__GP
auggauugcauaauauuuuaccugucauuuuuugcuguaguuacagcacauccugugucucaucaccaaguuggugauagguguuuugccgggggcaacuugauaaaagacuugaauaagacaguaaauauuggugaaguauguguuagagacgauauaucaauaaucaaaaguacgacagcuauucaaaaaucacuagaucauuuauccacgcggacaaaguuuuaccguguuuacauaguuaaggagugggcugagugcaacccaauuauugauuaugcugggaauuuuauuguuaugaacauugaugauaauggccaccuaguaccuagaaugcauaccugcagagcuucaugcgauauaagguuaaauaaaaaugacgcugaaaucauuuuaucaucgcagaaaaccaaucauuaugaaauaauuggaaccaccacugucagugguugguucaaaaauacuauaaaucugcccuuagagcacacaugugaacauauaacugugaauugcggacaaaaaucauugagauuccaugccugcuuuaggaugcauagaggaugcacuagauucuuuaaaaacacauauaugccaucaacaaugauugaacauaugugugcaaaccuagaguuaauaauuuucacauuauauaucuuuaccgcauugguguuugcauauauuauuacaaaaaguuauauagcauauauccuccugccauuauuuuacccauuaacuuauguauuugguauaauauacucaaaauugaagcagugcaagacauguaugcuugcugcccauccguuuacuaauugccccaagagaugugucuguggaucuagauucaauuguacagaagcucuccguguacauagauugggcagagacugccaaggauauaaaucauuaaguaaagccagacagauguguaaaucaaaauccuggucuuucaucauugcaaucuucacuggacuuauacuuauggaauuuauaacaccuauccacggugaaaggacuuacaaacucagcgaacuggcugaugaguuuauugcuaugaagacugaaguaacagugaugcaaagaucaauauauaaucagaaaauauuaaauauagcauugcuaacguuagugguauuaauaauucuuuuagaaacauauauuuuuaaaauccuuuuuagucuuuuauauagaucaugcuccaugugugguuugauacauuauaaauugggccuaaaaauaaauuuauuaaccacuaauaaauguggcaccuguauuugcggauuuagugaacaacaaucuucuggguuugaauaugaaguuuucuuaaaggauaugcauaaacagcgagaauccuguaaauauuucccgauguugaaccauuuccgcaaucuaaaaauauuaacaacuauauugcuacugauucugcuggcaacuaguguuucaagugaaugucuucagaaaccauuaaaaauaaagcuggaagauuugcaugaaugcauugggguuaauuuccuugauaggcaaugcuauaauagaaaggacuuauaugagucauuaaggucgaagaaccucauuucugaaguugauaaaaaauauuuugagagcgcugauuuaggagggcaauuuaagaggauagaauaugcucaggaugcacaucggaugauacuuuuagaaagaauacucuauuccacagagugugagaugcauacuauccuaacaaaugguggagcauauaacauuccauggagaacauaucuaaagaaucacaacuugaauuuaugcggcaagcauguacauaaaauggugugccaaugugugaauacacacacacaaugccugucuacugguauagauuaccaagacgaaauuacuaaauucuaccaagcugauggagauucauacagaucugaucuaucuauaauucuugaaacaauaucaacugcauuuagaggguuaaccaaaguuuuaaucgaaacuuauaucgaacaagauaauagugagucuaugauaaaauugcucaacacaauucaaggaaagguuccaaauaauuaucaaauguuagguauacuuaaauuugccaucaagaucaugaacauuaaucaaacucgagguguacgaucugccaggcauacaauuguaucaaaugauauacccaugucugaaccguuuuccaacuucgaggcgucaaauauaaacauuaagcaguguucagagccauuaacucuaaaaugcuucacaaaaagaggugacucaccucauucuaaucaccugcuauguaaagaacaaaguaaauauaaaguauucgaauggccugaaauagaaacaguuacaaagaauaacaaacuuugcuuaggagauacucauugcaaccucaaauuuacugcaacaacauccgacgaaaucaucaaacuauugaauuguuuuagugauacauacaaaccaaacccuggagaaauggaaauagggcucaaaaagugcaaugcugaaaaaauaggugagugugucacauuagaaaauagcccguggccuauaguauauugugaaaacaaauacuauuauucagaagcaaaagaacaugcaaaggaugguaguguuaauaguuacuguuuaacaaauaaguguaccgaagauagauugccuaucaauccagccugguucaaaucaugcaauugggaaaaaaauauuaaggaaacagcaacaauaaaggaauuuguauacaacgacaucaagucauaccgcaagucacuagaaucagaaaucaauacagaccuaaugauacaccauuauaggccuacgaaaaauuugccacauauuaagccuauuuacaaaucccucaguauacaaggaagcgagacaguggauggccuacagaauagcuuuauagagggagaaaugccagcuaucaguggguuagccaacgguuaccacuugacguauaaaggcacacagcuauuugauauaguaauauuuauaagaaaagcaguauacaaagccaauuauuacaaaauauacacuacugggccuaguauugcuauaaauauggagcauaaugaacaauguacaggacauuguccaagcaaaauaccuucuaaagaaaacugguugacauucucaagagaacauacuaguucaugggguugcgaagaauacggaugccuugcuauugauacagguuguuuguacgggucgugccaagaugucauuaggccugagauagauguuuacaaaaaaucuggaaaugagcaaagcuugauagagcucugcauaacaucagcacaugaaacuuuuuguaaugauuuggacauauuagagcccauaauuggagaaaagauaucagcaucauuccagucuacacagucuaaccaauuacccaauauaauagccuucaggaaaggacagauacuuacaggugcuaucaaugaccuaggaaauacaggcagccagugugggucgauacaauuaguaaacaacacauuauuaggggaaggaaaugucaaauuugacuauauaugccaugcuaugagaaggaaagauguuaucaucagaagguguuauaaugaccacuuuacaaguugcaaccuguugcagaagcgcucugacuugauugguaauauuaaugggaaagaauugcaaaucaguaugucaggacgaucaaugggcucaaugaaguucaaaauugaacucggggauauaaauuacaaguuguauacugaaaaugcagauauaacuauaagaggugagugcggagguuguauuggcugugcagaagcugucucauguucuuuagaaguggaauccucuagugaaauauuauguaaaguugaauguaauugucaaccauacauagagaacauuuugauaaaaccgcaaacaaaaaccuauucauuuaaggcuacaugcuuggaaaggucuaacaccuuagacaucaaaauaugugggaaacaaauuauagcacccuugacuauaaaaucauacaaucaaaaaauugaucuauccaaacuagacgaaucaaauuauguaaaagaagaagauuuagcaugcaauacauggcuauguaagguucaaacagaagguuucaauuuugucuucucuggcuuguuugcuggguuugguagauauuggacuaucgcaauuuauauauuaauugcugugguaauuauauuaauacugauauauauauugaugccuaucuuuagauugauacggaccuucuuaauaaaaaaugagauagaauauacuacugagcaaaaaaugagauag

SEQ ID NO: 4317 - RNA, 4257 nt, Artificial Sequence
  derived and/or modified CDS sequence (wt) from OROV/MDDV(FMD 1303)__KF697145.1__GP
auggcguucuuacuaaucuacguaguuuuggcugcugcaguggcaucacauccauuauccaaucaccagauuggugauaggugcuuugccggagggaacuugauaagagaguuaaauaaaacuguaaauauuggcgaauuguguguuagagacgauauaucaaugauaaaaagcaccacugcuauccagaaaucuguaggccauuuaucuacaaggacaaaauuuuauagaguauacauaguuaaagaaugggcagaaugcaauccaauuauagauuuugcugggaauuucauaauuaugaauauugaugagaacggucacuuagucccuaaaaugcauaccugcagagcuucaugugauauacgucuaaauaaggaugaugcagaaauuauuuugucaucgcaaaaaacaaaucauuaugaaauaauagggacaacaaguauuaguggcugguuuaaaaauacuauuaaucuaccauuggagcauacaugugagcauauuacuguuaauuguggccagaaaucauugagauuccaugcauguuuuagaaugcauaggggauguacuagauuuuucaaaaacaccuauaugccauccacuaugauugagaccaugugcguuaaccuugaauugauuauauucacauuauauaucuuuagugcagcaguauuugcauauguaauuacaaaaaguuacauagcauauauucuucugccgguuuuuuauccgauaacauauauuuuagguucuauauacuccagauuuaaacaguguaaaacuugcauguuagcugcucacccauucacaagcugcccuaaaaaauguguuugcggaucuagauucaacugcacugaggcuuuacguguccacagauugggaaaagauugccaagguuauaaaucacugaguaaggcuagacaaauguguaaaucuaagucuugguccuucauuauugcaguuuuuacuggccuuauucuuauggaguuuauaacaccaauaagcggcgaaaggauguauaagcuuagcgaacuggcugaggaauucauugaaaugaaggaagaggcaucagcauugaagaaagcuauuaacaacuuaaaacuguugaauguauuacuaucagcaauugccacauuaguagucguuauggaaacauacauauucaagucuuuauucaauuuguuauauagaucauguucuaugugcggucuaauacauuauaaaauaggcuuaagggugaauuuguuaacuacaaacagaugcgguacaugcauauguggauuuaaugagcagcagucaucagguuuugaauaugaaaucuuccuaaaggacaugcauaaacaaagagaaucaugcaaauacuucccgaugcucaaucauuuuagaaaugucaaaauauugacaguauucuugcuauugacuaugcuaacagcuagugcguccagugaaugccuacagaaaccauuaaagauaaaacuagaagauuuacaugaauguauuggcguuaacuuccuuaauaggcaaugcuacaauagucaggaauuauaccaaucauuaaagucuaaaaaccuggucucagaaguugacaaaaaauauuuugauaauaagaauuuagaagaucuauuuaagagaauagaguaugcacaagaugcccauagaaugauacuuuuggaaagaauacuuuacuccacagagugcgagaugcauacuauacuaacaaauggcggugcauauaauauucccuggcgaacauacuugaaaaaccacaauuuaaaccuaugcgguaaacauguucauaaaaugguuugucaaugcauaaauacgcauacacaaugcuuguccacuggcauugauuaccaagaugaaauuaccaaauuuuaccaagcagauggcgauucuuauagagcugauuuaucuguaaucuugcaaacuauagcaacugccuuuagagguaugacuaaaguucugauagaaacauauauagaacaggacaacagcgaaucuaugauaaaauugcuuaauacgaucaaagagaaagugccaaauaauuaucaaaugcuagguauucuaaauuuugcuauuaaaaucaugagugugaaccagacucgaggcgugcgcucugcuagacauacuaucauauccaaugauauaccuaugucugaaacuuuuuccaacuucgaaguaucaaauauagauguuaagcaaugcacagauccauuaacucugaaaugcuucaccaaaaggggggacgcgccacauuccaaccacuuauuguguaaagagcaaaacaaauacaaagucuuugaauggccggagaucgaaacaguuaugaaaaacaauaaauuaugucugggagauacucauugcaaucuuaaauuugcugcaauagcaucugaugaaguuauaaaauugcuaaauuguuucagugauacauauaagccaaauccaggagaaauggaggucggugcaaaaaaaugcaaugcugauaaaauaggugaaugcauuacauuagagaauaauccuuggccuauagucuauugugaaacaaaauauuauuauucggaugcaaaggaacaugcaaaagauggaaaugugaacaguuauuguuuaacaaauaagugcaaugaggacagauuuccuauaaauccaacuugguucaagucauguagcugggauaggaauguuaaagaaacuacaacaauaaaggaauuugugcacaaugauauuagugcauaccguaaaucacuugaaucugaaauaaguacugauuuauuaauacaucauuauaggccgacaaaaaauuugccccauauaaugccagcauacaaaucacucacuauucaagguagugaaacgguagaugguuuacaaaacagcuuuauugaaggggagaugccugccauuaguggucuagcaaauggguaccaccuaaaauauaagggcauugaguuguuugauauugugauuuuuauaagaaaggcuguauacaaagcuaauuauuauaagauauauacaacugggccaaguguugcaauaaauauggagcauaaugagcaaugcacuggaagcuguccaaaaaagauaccugcuaaggaaaauugguugaccuuuucaaaagagcauacuagcucaugggguugcgaagaguauggcugccuugcaauugacacgggaugccucuauggaucaugucaagauguuauuagaccagagguagauguguauaagaaggcuagugcggagcagaguuuaauagaauuaugcauuacaucugcucaugaaaccuuuuguaaugacuuggauauacuggaacccauaaucggagauaagauaucugcagcauuucaaucaacacaagucaaucaauuacccaacauaauagcauuuaagaagggccagauauucacuggugcaauuaaugaccugggaaacacaggcagucaauguggcucgauacaauugauuaauaauacucugcugggagaagguaauguaaaguuugauuauauaugccaugcuaugaaacggaaagauguuauugugcgaagaugcuacaaugaccauuuugcuagcugcaacuuauuacagaaacgcucugaucuaguuggcacccuuaauggaaaagaacuccagguuaguaugucugggcgaucuaugggaucaaugaaguucaaaguugaacuaggagauauuagcuauaagcuuuauaccgaaaacgcagauauaucaauaaguggagaauguggaggaugcaucaacugugcagaggcaauaucaugugcuuuagaaauagauucuucaaccgaaguguuaugcaaguuagaguguagcugucagccauacauucaaaacauccucauuaagccucaggucaagaaauacucauucaaggccacaugcuuugagaagcggaacucauuagaggucacaguauguaaaaaacagcauacuauaccccuuacuauaaaaucuuacaaucaaaaaauugauuuguccagacuugacgagucaaacuauguaagagaagaggauuugacguguaauacauggcuaugcaaaguugaaaaagaaggaauagguguuauguucucugguuuauucgcuggcuuuggcaaauacuggaguauugcaauuuaugcuuugauugcauuaguaauuuuccucauacugaucuauauucugguaccaaucuucagguugaucaggaccuucuugaucaaaaaugaaguggaguauaccacagagcaaaagaugagauaa

SEQ ID NO: 4318 - RNA, 4257 nt, Artificial Sequence
  derived and/or modified CDS sequence (wt) from OROV/MDDV(INHRR 17a-10)__KJ866390.1__GP
auggcguucuuacuaaucuacguaguuuuggcugcuacaguggcaucacauccauuauccaaucaccagauuggugauaggugcuuugccggagggaacuugauaagagagcuaaauaaaacuguaaauauuggugaauuauguguuagagacgauauaucaaugauaaaaagcaccacugcuauccagaaaucuguaggccauuugucuacaaggacaaaauuuuauagaguauacauaguuaaagaaugggcagaaugcaauccaauuauagauuuugcuggaaauuucauaauuaugaauauugaugagaauggacacuuagucccuaaaaugcauaccugcagagcuucaugugauauacgucuaaauaaggaugaugcagaaauuauuuugucaucgcaaaaaacaaaucauuaugaaauaauagggacaacaaguauuaguggcugguuuaaaaauacuauuaaucuaccauuggagcauacaugugagcauauuacuguuaauuguggccagaaaucauugagauuccaugcauguuuuagaaugcauaggggauguacuagauuuuucaaaaacaccuauaugccauccacuaugauugagaccauguguguuaaccuugaauugauuauauucacauuauauaucuuuagugcagcaguauuugcauauguaauuacaaaaaguuacauagcauauauucuucugccgguuuuuuauccgauaacauauauuuuagguucuauauacuccagauuuaaacaguguaaaacuugcauguuagcugcucauccauucacaagcugcccuaaaaaauguguuugcgggucuagauucaacugcacugaggcuuuacguguccacagauugggaaaagauugccaagguuauaagucacugaguaaggcuagacaaauguguaaaucuaagucuugguccuucauuauugcaguuuuuacuggccuuauucuuauggaguuuauaacaccaauaagcggcgaaaggauguauaagcuuagcgaacuggcugaggaauuuauugaaaugaaggaagaggcaucagcauugaagaaagcuauuaacaacuuaaaacuguugaauguauuacuaucagcaauugccacauuaguagucguuauggaaacaugcauauucaagucauuauucaauuuguuauauagaucauguucuaugugcggucuaauacauuauaaaauaggcuuaagggugaauuuguuaacuacaaacagaugcgguacaugcauauguggauuuagugagcagcagucaucagguuuugaauaugaaaucuuccuaaaggacaugcacaaacaaagagaaucaugcaaauacuucccgaugcucaaucauuucagaaaugucaaaauauugacaguauucuuacuauugacuaugcuaacagcuagugcguccagugaaugccuacagaaaccauugaagauaaaacuagaagauuuacaugaauguauuggcguuaacuuccuuaauaggcaaugcuacaauagucaggaauuauaccaaucauuaaagucuaaaaaccuggucucagaaguugacaaaaaauauuuugauaauaagaauuuagaagaucuauuuaagaggauagaguaugcacaagaugcccauagaaugauacuuuuggaaagaauacuuuauuccacagaaugcgagaugcauacuauacuaacaaauggcggugcauauaauauucccuggcgaacauacuugaaaaaucauaauuuaaaccuaugcggcaaacauguucauaaaauggucugucaaugcauaaauacgcauacacaaugcuuguccacuggcauugauuaccaagaugaaauuaccaaauuuuaccaagcagauggcgauucuuauagagcugauuuaucuauaaucuuggaaacuauagcaacugccuuuagagguaugacuaaaguucugauagaaacauauauagaacaggacaacagcgaaucuaugauaaaauugcuuaauacgaucaaagagaaagugccaaauaauuaucaaaugcuagguauucuaaauuuugcuauuaaaaucaugagugugaaccaaacucgaggcgugcgcuccgcuagacauacuaucauauccaaugauauaccuaugucugaaacuuuuaccaacuucgaaguaucaaauauagauguuaagcaaugcacagauccauuaacucuaaaaugcuucaccaaaagaggggacgcaccacauuccaaccacuuauuguguaaagagcaaaacaaauacaaagucuuugaauggccggagaucgaaacaguuaugaaaaacaauaaauuaugucugggagauacucauugcaaucuuaaauuugcugcaauagcaucugaugaaguuauaaaauugcuaaauuguuucagugauacauauaagccaaauccaggagaaauggaggucgguacaaaaaaaugcaaugcugauaaaauaggugaaugcauuacauuagagaauaauccuuggccuauagucuauugugaaacaaaauauuauuauucggaugcaaaggaacaugcaaaagauggaaaugugaacaguuauuguuuaacaaauaaguguaaugaggacagauuuccuauaaauccaacuugguucaagucauguagcugggauaggaauguuaaagaaacuacaacaauaaaggaauuugugcauaaugauauuagugcauaccguaaaucacuugaaucugaaauaaguacugauuuauuaauacaucauuauaggccgacaaaaaauuugccccauauaaugccagcauacaaaucacucacuauucaagguagugaaacaguagaugguuuacaaaacagcuuuauugaaggggauaugccugccauuaguggucuagcaaauggguaccaccuaaaauauaagggcauugaguuauuugauauugugauuuuuauaaaaaaggcuguauacaaagcuaauuauuauaaaauauauacaacugggccaaguguugcaauaaauauggagcauaaugagcaaugcacuggaagcuguccaaaaaagauaccugcuaaggaaaauuggcugaccuuuucaaaagagcauacuagcucaugggguugcgaagaguauggcugccuugcaauugacacgggaugccucuauggaucaugucaggauguuauuagaccagagauagauguguauaagaaggcuagugcggagcagaguuuaauagaguuaugcauuacaucugcucaugaaaccuuuuguaaugacuuggauauacuggaacccauaauuggagauaagauaucugcagcauuucaaucaacacaagucaaucaauuacccaacauaauagcauuuaagaaggggcagauauucacuggugcaauuaaugaccugggaaacacaggcagucaauguggcucgauacaauugauuaauaauacucugcugggagaagguaauguaaaguuugauuauauaugccaugcuaugaaacggaaagauguuauugugcgaagaugcuacaaugaccauuuugcuagcugcaacuuauuacagaaacgcucugaucuaguuggcacccuuaauggaaaagagcuccaaguuaguaugucugggcgaucuaugggaucaaugaaguucaaaguugaacuaggagauauuagcuauaagcuuuauaccgaaaacgcagauauaucaauaaguggagaauguggaggaugcaucaacugugcagaggcaauaucaugugcuuuagaaauagauucuucaaccgaagugcuaugcaaguuagaguguagcugucagccauacauucaaaacauccucauuaagccgcaggucaagaaauacucauucaaggccacaugcuuugagaagcggaacucauuagaggucacaguauguaaaaaacagcauacuauaccucuuacuauaaaaucuuacaaucaaaaaauugauuuguccaggcuugacgagucaaacuauguaagggaagaggauuugacguguaauacauggcuaugcaaaguugaaaaagaaggaauagguguuauguucucugguuuauuugcuggcuuuggcaaauacuggaguauugcaauuuaugcuuugauugcauuaguaauuuuccucauacugaucuauauucugguaccaaucuucagguugaucaggaccuucuugauuaaaaaugaaguggaguauaccacagagcaaaaaaugagauaa

SEQ ID NO: 4319 - RNA, 4257 nt, Artificial Sequence
  derived and/or modified CDS sequence (wt) from OROV/Perdoes virus(BeAn789726)__KP691625.1__GP
auguuuauucaauucaauuuagcguucuuuugucucucaauagucuguggccauccauugaccaaagaccauauuggugacaggugcuuugcaggagguaaucuguucaaagagauuacccaaacuacaggcuuaagugagauauguauuaaggaugauauuucaauaauuaaaagucaaguagaaauuaaaaagcaaucuucugaagugacuuaugcuguaaaauucuauagagucuauuugguaaaagaauggagcgagugcaacccaauacaggaucaacaugguucuauaaugauauuagauguaacaaacacaggucuaaucgucccuaaaauguacacuuguagagcagcuugcgauauaacauuggauaaagacaaugcagagguugucuucauuucccaaaaaaauaacaacuaugaguuagcugguacuacagucaugcacgguugguucaaaaauguuguuucuauaaaacuagaacacacaugugagcauuugacugccacauguggucaaaaaacaguaaaguuccaugccugcuucagacaacauagagccugcgccagguuccuaaaaacaaccuauaugccuauuguuaugguggaaucacuaugcucaaaccuggaauuagucaucuucaucacauauauuuuugugugccuagcauuugcauucauaauaacgaggacuuacguagcuuaccuacuaauaccuguauucuacccuuucacauaugcauaugguaaaauguauuugaaauguguaaaaacuugcccuaauugccuauuagcaaugcacccguuuacaaauugcacuaaucuaugcauuuguggcagucgguucagcaacacugaaucuuuaaaggugcaucgacuagguaauuguuauggauauaaagcauuaaguggugcaagaaguaugugcaagucaaagguuucaucauuuacaacugcuauguuuuuugguauaauaaucuuaucguuuauugcaccacuaaauggugagagacuauauaaauuaucugaacuaccagacgaauauauagagauggagucaacaauagaaggaagcaaacaaaaagagacaauaguagauauaaucaauuauacugcguuggugcuaauauuaauaaccauacucuugcaggguauuuuagagaauuauauauuuagguuaaaauuuagauuuugcuccuucugugauaugauacauaugaagaagaauuugaaaauauucucuaacaugacaaauaaaugcggcacauguauuugugguuuuaaccaagagaucagaucaggguuugauuaugagguguuuauaaaggauaugcauguuucgagagaauccuguaaauauaacuaccauaaaaauuauagcuucuacauaaaaauguuguugguaguacuacuagugccuuugauaggcacaacugcagcugaggauacuaaauguuuaaaauaugauuugaauaaaaauauagaggauuugaaggacugcuaugguuuaaaguuaaauauagauaaacacgauacaguggaaaaugcuuacaaaaauuuaguugaucaaaaacuugugucagaauuagaccgauuagaucucaauauaaugcuagguuccaaagaaucaauauuugaagcuaucgagaccuccaugaauauacaucaaaugguauuuuuagaauaucuugcauauaagacagacccaaaauugagcgagauuaaacaaaauacagggccauacaauauugcauggcgaaccuuuauacauggcaauagccuugaagugugugguaauuauccuuacaaauuaauuugcuauuguauaaaucaaaaaacucauugugagaauucaacuguagauuaugggauucaaauacaaccauuuuacaaccagcauccuaauaguuauaaaucugauauggaagcacugauuaaaacaguccagauagcauuucgggggauuauaaaaguucuuauacaguauuauguugagaauaacaaaaccagugaacucucaaaucuccuuacugagcucaggaauguaaugggaaauaauauucaaaugaaaggaauuuuaaaauaucuggaaacuuacuuaaagaagccccuauugauggcaagaacgauucggauagcagcaaaagucgacacuucaggugauccauauaauaacuuuucaacaucuaaagaaaauauaacaaaaugcauuaaaauacaaaaauugagaugcauuacgaaauugacaagaauugaacauaacuauauucuuugcggugauucugagaaaaaguuauaccaguggccagcaaaaccaacuauuguagaugacaaugaugccuguuugggagacaaacacugucaccugccauuuauuccaauaggcaaugaugaggcaauaaaaacaguuaacuguuauguagaagucuaugagcaaaacccuggggacaugaauucuuaucaaaagaaaugugaugcuaugaaugucgggacaugcuuaaccauaaaaaaugagaauuggccuauaguacaaugcaagacagggaaauauuauuaugcugacggccguauacaugcuaaagaugguacaauaaauacuuacugcuuuucugaaaaauguaaugcagacagguauccaauacaucaggauuauauaaauucauguaauuggcaagagacaauaaaagacuuccaacaugugagagaauuuguccaccuagauauagaauccuauaaaaaggcaauagagucagauauuaagacagauuuaguuguacauaaauucaggccggugaaaaaucuuccgcauguuaucccaauauacaagaguaucacaguucaaggaacagagacaucugaugguauacagaaugcuuuuauccaaggcucaaugccugcaauuaguggucuugcuaacggcuaccauuuauucacaccagacuccaaacaauuauuugaugucguacuauuccucagaaaggcaucauauaaagccgaauaucggaaaauauacucaacagggccuacaauuggaauaaauguugaacauaaugagaaaugcacuggcucuuguccaaagacuauugacaaaaaggauaauugguugacauucuccaaagagcauaccagucaaugggguugugaagaguacggaugccuagcuauuaacacuggaugugucuuugguucuugccaggauauaauccgaccugagauagauguguauaaaaugcauggugcagagagaagugugguagaauuauguauaacauuaccacaugaaacuuauugcaaugauuuagauguccuugagccaauuauuggugacaaaauacaagcagcauuucaaacugugcaaucaaaccauaugccuagacuaauggcuaucaaaaauaauaaggccuucacuggucaaauuaaugauuuggguagcacagcuaguuacugugggucaguucagaaguuuaaugagacuauuauagggcaaggagacccuaaauuugauuauguaugucauuuauugaagcggaaagacauuauaguucgaagauguuauagcaacaauuaugagucuuguaagcugcucacacccagagcagauauaauaguggacaagaaaggggagucgcuucaagcaagcauagucggauuaaaucuaggccagaugaacuucaaaauuaugcugggagauauaaacuauaagcaauacacugaguccaauaacuuagaagcaacaggacagugugugggaugcguugauuguagugaagacauagucuguaaccucaaaauagaaucgcaaucagagucugugugcaacauuaaaucagacuguaaucuauauuuaucaaguaugcuaauccagcccacugucggugaauauaaccucaaaaugucauguaaugcaaaauuagacaagguaaauauagaaauauguaagcagaaauuuguacuaccuuuaaccauaaagucgcauaaccagaagauugacuuaucuaagcuagaugagucuaauuauauaagagaagaagaccuaaagugugauacuaugauaugcaagguuaaagacgaaggacuuucauuuauaacaaacagcuuguuugggggaauaucauacuuuuggaaaauacuaauuucaagccuaauuguaauauuuuuaauaauacucuucuauuauguagggcuacccauccuuagacucauuaaagauuaucuuaaggaaaaugaauuagaauaucuggcagaaggaaaauga

SEQ ID NO: 4320 - RNA, 4257 nt, Artificial Sequence
  derived and/or modified CDS sequence (wt) from OROV/Perdoes virus(BeAn790177)__KP691628.1__GP
auguuuauucaauucaauuuagcguucuuuugucucucaauagucuguggccauccauugaccaaagaccauauuggugacaggugcuuugcaggagguaaucuguucaaagagauuacccaaacuacaggcuuaagugagauauguauuaaggaugauauuucaauaauuaaaagucaaguagaaauuaaaaagcaaucuucugaagugacuuaugcuguaaaauucuauagagucuauuugguaaaagaauggagcgagugcaacccaauacaggaucaacaugguucuauaaugauauuagauguaacaaacacaggucuaaucgucccuaaaauguacacuuguagagcagcuugcgauauaacauuggauaaagacaaugcagagguugucuucauuucccaaaaaaauaacaacuaugaguuagcugguacuacagucaugcacgguugguucaaaaauguuguuucuauaaaacuagaacacacaugugagcauuugacugccacauguggucaaaaaacaguaaaguuccaugccugcuucagacaacauagagccugcgccagguuccuaaaaacaaccuauaugccuauuguuaugguggaaucacuaugcucaaaccuggaauuagucaucuucaucacauauauuuuugugugccuagcauuugcauucauaauaacgaggacuuacguagcuuaccuacuaauaccuguauucuacccuuucacauaugcauaugguaaaauguauuugaaauguguaaaaacuugcccuaauugccuauuagcaaugcacccguuuacaaauugcacuaaucuaugcauuuguggcagucgguucagcaacacugaaucuuuaaaggugcaucgacuagguaauuguuauggauauaaagcauuaaguggugcaagaaguaugugcaagucaaagguuucaucauuuacaacugcuauguuuuuugguauaauaaucuuaucguuuauugcaccacuaaauggugagagacuauauaaauuaucugaacuaccagacgaauauauagagauggagucaacaauagaaggaagcaaacaaaaagagacaauaguagauauaaucaauuauacugcguuggugcuaauauuaauaaccauacucuugcaggguauuuuagagaauuauauauuuagguuaaaauuuagauuuugcuccuucugugauaugauacauaugaagaagaauuugaaaauauucucuaacaugacaaauaaaugcggcacauguauuugugguuuuaaccaagagaucagaucaggguuugauuaugagguguuuauaaaggauaugcauguuucgagagaauccuguaaauauaacuaccauaaaaauuauagcuucuacauaaaaauguuguugguaguacuacuagugccuuugauaggcacaacugcagcugaggauacuaaauguuuaaaauaugauuugaauaaaaauauagaggauuugaaggacugcuaugguuuaaaguuaaauauagauaaacacgauacaguggaaaaugcuuacaaaaauuuaguugaucaaaaacuugugucagaauuagaccgauuagaucucaauauaaugcuagguuccaaagaaucaauauuugaagcuaucgagacuuccaugaauauacaucaaaugguauuuuuagaauaucuugcauauaagacagacccaaaauugagcgagauuaaacaaaauacagggccauacaauauugcauggcgaaccuuuauacauggcaauagccuugaagugugugguaauuauccuuacaaauuaauuugcuauuguauaaagcaaaaaacucauugugagaauucaacuguagauuaugggauucaaauacaaccauuuuacaaccagcauccuaauaguuauaaaucugauauggaagcacugauuaaaacaguccagauagcauuucgggggauuauaaaaguucuuauacaguauuauguugagaauaacaaaaccagugaacucucaaaucuccuuacugagcucaggaauguaaugggaaauaauauucaaaugaaaggaauuuuaaaauaucuggaaacuuacuuaaagaagccccuauugauggcaagaacgauucggauagcagcaaaagucgacacuucaggugauccauauaauaacuuuucaacaucuaaagaaaauauaacaaaaugcauuaaaauacaaaaauugagaugcauuacgaaauugacaagaauugaacauaacuauauucuuugcggugauucugagaaaaaguuauaccaguggccagcaaaaccaacuauuguagaugacaaugaugccuguuugggagacaaacacugucaccugccauuuauuccaauaggcaaugaugaggcaauaaaaacaguuaacuguuauguagaagucuaugagcaaaacccuggggacaugaauucuuaucaaaagaaaugugaugcuaugaaugucgggacaugcuuaaccauaaaaaaugagaauuggccuauaguacaaugcaagacagggaaauauuauuaugcugacggccguauacaugcuaaagaugguacaauaaauacuuacugcuuuucugaaaaauguaaugcagacagguauccaauacaucaggauuauauaaauucauguaauuggcaagagacaauaaaagacuuccaacaugugagagaauuuguccaccuagauauagaauccuauaaaaaggcaauagagucagauauuaagacagauuuaguuguacauaaauucaggccggugaaaaaucuuccgcauguuaucccaauauacaagaguaucacaguucaaggaacagagacaucugaugguauacagaaugcuuuuauccaaggcucaaugccugcaauuaguggucuugcuaacggcuaccauuuauucacaccagacuccaaacaauuauuugaugucguacuauuccucagaaaggcaucauauaaagccgaauaucggaaaauauacucaacagggccuacaauuggaauaaauguugaacauaaugagaaaugcacuggcucuuguccaaagacuauugacaaaaaggauaauugguugacauucuccaaagagcauaccagucaaugggguugugaagaguacggaugccuagcuauuaacacuggaugugucuuugguucuugccaggauauaauccgaccugagauagauguguauaaaaugcauggugcagagagaagugugguagaauuauguauaacauuaccacaugaaacuuauugcaaugauuuagauguccuugagccaauuauuggugacaaaauacaagcagcauuucaaacugugcaaucaaaccauaugccuagacuaauggcuaucaaaaauaauaaggccuucacuggucaaauuaaugauuuggguagcacagcuaguuacugugggucaguucagaaguuuaaugagacuauuauagggcaaggagacccuaaauuugauuauguaugucauuuauugaagcggaaagacauuauaguucgaagauguuauagcaacaauuaugagucuuguaagcugcucacacccagagcagauauaauaguggacaagaaaggggagucgcuucaagcaagcauagucggauuaaaucuaggccagaugaacuucaaaauuaugcugggagauauaaacuauaagcaauacacugaguccaauaacuuagaagcaacaggacagugugugggaugcguugauuguagugaagacauagucuguaaccucaaaauagaaucgcaaucagagucugugugcaacauuaaaucagacuguaaucuauauuuaucaaguaugcuaauccagcccacugucggugaauauaaccucaaaaugucauguaaugcaaaauuagacaagguaaauauagaaauauguaagcagaaauuuguacuaccuuuaaccauaaagucgcauaaccagaagauugacuuaucuaagcuagaugagucuaauuauauaagagaagaagaccuaaagugugauacuaugauaugcaagguuaaagacgaaggacuuucauuuauaacaaacagcuuguuugggggaauaucauacuuuuggaaaauacuaauuucaagccuaauuguaauauuuuuaauaauacucuucuauuauguagggcuacccauccuuagacucauuaaagauuaucuuaaggaaaaugaauuagaauaucuggcagaaggaaaauga

SEQ ID NO: 4321 - RNA, 4284 nt, Artificial Sequence
  derived and/or modified CDS sequence (wt) from OROV/UTIV(BeAn84785)__KF697155.1__GP
auguuucuaauuuuuauucucauccaaauugcugcgucgacgccauugucuccgcaacaaguuggugacagaugcuuuauugguggcucucuuauuaaagagauaaaccaaucuacuggacuaggagaaguauguauaaaagaugauauauccaucaucaaaaguauuaacauccaaaagaaaauuucaaaugaucagguucaaaauacugucaaauuuuacaagacuuauauugcuagagaauggcaugauugcaacccgauauuugaugaacauggcucauuuaugguauuugacaucuccaauacuggcucuauaauaccuaaaaugcauacaugcagagcccaaugugaaauaacauuaaauaaagauaaugcugagguuauauucacuucugccaaaacuaaucauuaugaaguuucuggaacaacaacuguaaaugguugguuuaaacaaacuauaagcguuucguuagaacauacuugcgagcauauaauugcaagcugcggacaaaaaucauuaaaauuccaugcauguuuuagacagcaucguucaugcguuagauucuuuagaaauaguuauuuaccauauaaaaugauagaaaguuuauguauaaauauagaauuaauuauuauauuauguuacgcuuuauuaugcuuuauuuuugcuuacauuauuacaaagacauauauagcuuacuuauuaauuccuuuguucuauccuauaacauacauauauggaaaaauauauaauaaauauuuuaagagguguaaauccuguuugcuagcuguucacccauuaacuaacugcaauaaaacaugcguguguggaugccgauucaauucaacagaagcacucaaaguacauagauuagguaaagauuguaaugguuucaaagcauuaaguaaagcuagauucuuaugcaaaucuacagggccuucuuuuacuaucugcuuuuuaacaggaaugcuuauuuuaagcuuuauuacgccaauuaauucugaaaaguuauauaaauuagaagaacuuccagaugauuauauuaauuuagaaaaucaauuaucugaaugcaacaauaauaagcaaauaacuagagcuuuagcuguugcuugcauauuagggaauauucuauucguauuauuuuucaaauuuauuuacaauaaacuaaucaacaauauauauaggacaugcaaucuauguaauaugguccaucauagaaagaauuuaaaaaucuauagugaauuuacuaauaaaugcgguacauguguauguggauuuaaugaagaaauaagaaguggguuugauuaugaaguauuuauaaaagauaugcauauuuuuagagauaauugcuuauucaaauuuuacucaaaauauucaauaauauauauaugcauuauaauccuaguaauuaaucuucaauuaggaaugacguuagcggaggagacagagacuaauuguuuaaaucugccaauuucugcucaaacacuggauauagucaaauguuauggucuuaauuuaaauauaacugaaaauaaacaaaaaucugauuuaauuagugaguugaaaagucaaaaaacuauaacugaucaugacauaccugauuuuaauauaauugauaugaaaacagagucugcauucgaaaagaucgaaacagcagaaaauauacacagaauggcauuuuuagaauauauauuauauaaaauggaaucuaaauuaaauacuauuaagacuaauucaggaccauauaauguagcauggcgaacauauauuaaauaccacaacuuagaugcauguggaaaauacccacauaagacuauaugcacauguauaaaugcucauuugucuuguagucagccaacaguugauucuaacagcgaaauuaagacauuuuauucuaaucaucagucagcuuuuaaaaaugauauaaaugugcuaauugaaacaaucucaauugcuuuuagaggaauuauuaagguuucuauaaauuuacuauuaaagaauaacaaaauagaugagcucaaggaauuguugaccaacauaucaaaaaaauuagacacaaauauucaaaugaaagggauuuuauuguuuacagcagagcaguugaagacacaagagacaacuguuaaaucuaugcagcaaacaagaauggccauaauagucaaaccuuuagaaucuaugacaggagauaaauuugacaauuuuaguacaaccaauagaaacauaacaaaaugcaaagaagcuaaaucauuaagcuguuauaugaccaggaaaaauucuauaaauaaauaucuacuuuguaacuuagaugguuauaaaauauuuucuuggccagaaaaaccuacacucaguauaaacaauaauauuuguauuggugacucgcauuguaauuuauauuuuaaaccaaucuuaaaugaugaagcuauaaaaacuauuaacugcuauaaaggugauuucacuccuaauccaauggauaugggaucugcaaucaaaaaaugugaggccaaggagauuggcgauuguuuaguaggugauaauaacauguggccuauuauacaaugcaguaaugaaaaguauuauuacgcugaugggaagaaucaugccaaagagggagauauaaauucauauuguuuaucagaaaaaugcaauacugauagguuuccaauucauaaugaaugguuuaaaaguugcaaauggauaaguacuauuaaagaguccauuucuguuaaagaauuuguucauuuagauauagaaucauauaaaaagggcauugagucagauauuagaacagauuuaauuauacauaaauucagaccuguaaaaaacuuaccacauauagcuccaaaguauaaauccauaacuauaagugguauauuaguugcagauggaauacaaaaugcuuuuguaucuggcgaaaugccugcaauaaguggauugggaauagguuauaauuuguauucaccugaugggacaaaauuguucgauauaguauuguuuuugagaaaggcaauauacaaaucaucauauaaauuaauuuauaaaacagguccaacaauaggaauuaauguagaacauaaugagcagugcacuggcucaugcccaucaacaauuccuaaacaagaagguugguugaccuuuucaaaagaacacacaagccaauggggcugugaagaauuuggauguuuagcuauagauacuggauguuuauaugguucaugucaagacauuauaagaccagaaaugucuaucuauaaaauguuaggugaagaaaugacaucaauagaaauaugcuuaacuacuccuaaagaaacauacuguaaugacuuagacuugcuugaaccauuaauuggugacaaaauugaaguuaguuuccaaacuguacaauccagucauaugccaaaaauuauugcaguuaaaaauaauaagguuuauacuggacaaaucaaugauauagggaauacagcaaauauuuguggaucuguacaaauaauaaauaaaacuguuauuggucaaggaaauccuaaauuugacuacuuaugucacgcaaugaaaaggaaggauguuauaguuaggaaauguuaugauaaccauuuugagacuugcaaauuguuggaagaaagaagugaaauauugauaaaucaacaaucagacacaauagcagcaaguaugaguggaaaaaauuugggaauuaugaacuuuaaauuugcacuaggugauauugauuauaaaacauuuacggaagaugcaaguuuugauauuaaaggccaguguguuggguguauaaauugcauagaagaaauuguaugugaauuaaauauuguaagcacaucaucuauauuauguacaauuaaaacaccaugugaaaacuaccauaauucauuagaaauuaacccagcaacuacuaaauaucauauuaaaaugucuugcccucauaauaucgacaagaugaaaaucacaauuuguucuaaagacuuagaaaugccauugacauuaaaacagcaugaucaaaaaauagaucuaucuaaauuagaugaaucuaauuauauaaaggaagaagauuuaaggugcaguacauggcuuugcaaaguuaaagaagaagggauaggauucauauuuucugguauuuuuggaaauuuuggaaaauacuggacaaucuucuugauuguuuuaguaauucuggcaacugggcuauuggguauauuuguaauuuauccaugcuguaaaagauuaagaggauucuuagaaauuaaugauauagcuuauuuggcugaacaaaaaaugaaauaa

SEQ ID NO: 4322 - RNA, 3231 nt, Artificial Sequence
  derived and/or modified CDS sequence (wt) from HRTV(TN)__KJ740147.1__GP
augauugucccgauuguccuguuucucacgcucuguccguccgaacucagugccuggggcucuccaggagacccuauuguuuguggugugaggacugaaacaaacaaauccauucagauugaauggaaggagggaagaucagagaagcuaugccagauugacaggcuuggacaugucacaagcugguuaagaaaccacucaucuuuucaggggcuuguuggucaggugaagggaagaccaaguguuuccuacuucccggaaggggcuucuuacccaagguggagcggucuauuaagcccaugugaugcugaauggcugggaaugauagcagugagcaaggcuggagacacagacaugauugucccagggccaacuuacaaaggcaaaaucuuuguugagagaccaacauacaacggauacaaaggcugggggugugcagaugggaagucacuaagccacucaggcacauauugugaaacugacagcucagugaguucugguuuaauucagggagauaggguucucuggguuggggaaguggucugucagagagggaccccugugccagaagauguauuuagugaacugguuagcuugagucaaagugaguucccagaugugugcaagauugaugguguugcacugaaccagugugagcaggagagcaucccccagccacuggacguugcauggauugauguuggaaggucucauaagguacugaugagagaacacaaaacuaaauggguccaagagagcucagcaaaggacuuugugugcuucaaggugggucaggggccauguucaaaacaagaggaagaugacugcaugaguaagggcaacugccauggggaugaggucuucugcaggauggcaggaugcucugcccguaugcaagauaaucaagaaggcuguaggugcgaacugcuucagaaaccuggagaaaucauugugaauuauggaggcgucucugugagaccaaccuguuauggauucuccagaaugauggcaacauuggaaguucacaaaccugauagagaauuaacagggugcacggguugucaccuagagugcauagagggaggaguuaaaauuguaacgcuuacaagcgagcugagaagugcaacagucugugcuucacauuuuugugcaucugcaaaggggggcucaaagacaacugacauacucuuccacacuggugcucucguuggacccaauuccaucagaauaacuggucaguuguuagaugggagcaaguucuccuucgaugggcacugcauauucccagaugggugcauggcacuugacugcaccuucuguaaggaguucuuaagaaacccacaauguuacccaguaaagaaauggcucuuccuggugguaguuauaaugugcugcuauugcgcccugaugcugcuuacuaacauacugagagcuauagguguuugggggacauggguuuuugcuccaauaaaguuggcucuagcauuaggguugaggcuugccaaacugucaaagaagggguugguugcugugguuacaaggggccaaaugaucgugaaugaugagcugcaccagauucgaguggagagaggugagcaaaaugagggaagacaagguuauggcccaagaggccccauccgucacuggcuauacucaccugcccucauccucauucucaccacuucaauuugcucuggaugugaugagcuuguucaugcugagaguaaaucuaucacaugcaagucugcaucugggaaugagaaggagugcucagugacaggcagagcuuugcucccagcugucaauccagggcaggaagccugcuugcacuucagcaugccaggaagcccagacucuaagugccucaagaucaaagugaaaucaauaaaucucagauguaagcaagccucuucauauuauguuccugaagcaaaggcaagguguacaucugucagaaggugcaggugggcaggugacugucaaucuggguguccaacauauuucagcucaaacucauucucagaugauugggcaaacaggauggacagggcugggcucgggaugagugggugcucagaugggugugguggagcugcauguggguguuucaaugcagcgccauccugcaucuuuuggagaaaguggguggagaacccauccaaucgugucuggaaggugucaccuugugcaucaugggugcuagcugcaaccauugaguugacuuugccaucaggagagguuaagacucuagagccugucacagggcaagcaacucagauguucaaggguguugcaaucacauaucugggaucauccauugagauuguuggcaugaccaggcuaugugagaugaaagagaugggaacugggauaauggcacuagcccccugcaaugauccagggcacgccauaaugggaaaugugggugagauccaaugcaguaguauagaaagcgcaaagcacaucagaucugaugggugcauuuggaaugcugaccuaguugggauagaauugaggguugaugaugcuguguguuucucgaaacucacuaguguugaggcaguugcgaauuuuucaaaaaucccggcaacaauuucugggguucgcuuugaucaagggaaucauggagaaucacguaucuaugguagcccauuagauaucacgaggguuaguggggaauucucagugucauucagagggaugaggcucaaacuaucugagauaucagcaagcugcacaggugagauaacaaacgucuccgguuguuacuccugcaugacuggggccucagucagcauaaaauuacauagcaguaagaacacaacaggucaucuuaagugugauucagaugagacugcauucagugucauggaggggacacacacauauaggccucacaugagcuuugauaaagcaguaauagaugaggagugugugcuaaacugugguggccacucaucaaaacuguugcuuaaagggagccuuguuuucauggacgugccaagguuuguugaugggaguuauguccaaacauaucacagcaaggugccugcugggggaagggucccaaauccaguagacuggcucaaugcacuguuuggagauggcauaacacgauggauucuugggauuauagggguucugcuggcaugugucaugcuauuugugguggugguugccaucacuaggcgauugaucaagggacugacucaaagggcgaagguggcauga

SEQ ID NO: 4323 - RNA, 3231 nt, Artificial Sequence
  derived and/or modified CDS sequence (wt) from HRTV(Patient2)__JX005844.1__GP
augauugucccgauuguccuguuucucacgcucuguccguccgaacucagugccuggggcuccccaggagacccuauuguuuguggugugaggacugaaacaaacaaauccauucagauugaguggaaggagggaagaucagagaagcuaugccagauugacaggcuugggcaugucacaagcugguuaagaaaccacucaucuuuccaggggcuuauuggucaggugaaggggagaccaaguguuuccuacuucccggaaggggcuucuuacccaagguggagcggccuauuaagcccaugugaugcugaauggcugggacugauagcagugagcaaggcuggagacacagacaugauugucccaggcccaacuuacaaagggaaaaucuuuguugagagaccaacauacaacgguuacaaaggcugggguugugcagauggaaagucacuaagccacucaggcacauauugugaaacugacagcucagugaguucugguuuaauucagggagauaggguucucuggguuggggaaguagucugucagagagggaccccugugccagaagauguauuuagugaacugguuagcuugagucaaagugaguucccagaugugugcaagauugaugguguugcacugaaccagugugagcaggagagcaucccccagccacuggacguugcauggauugauguuggaaggucucauaagguacugaugagagaacacaaaacuaaauggguccaagagagcucagcaaaggacuuuguguguuucaaggugggucaggggccauguucgaaacaagaggaagaugacugcaugaguaagggcaacugccauggggaugagguuuucugcaggauggcaggaugcucugcccguaugcaagauaaucaagaaggcugcaggugcgaacugcuucaaaaaccuggagaaaucauugugaauuauggaggcgucucugugagaccaaccuguuauggauucuccagaaugauggcaacauuggaaguucacaaaccugauagagaauuaacagggugcacggguugucaccuagagugcauagagggaggaguuaaaauuguaacgcuuacaagcgagcugagaagugcaacaguuugugcuucacauuuuugugcaucugcaaaggggggcucaaagacaacugacauacucuuccacacuggugcucucguuggacccaauuccauuagaauaacuggucaguuguuagaugggagcaaguucuccuuugaugggcacugcauauucccagaugggugcauggcucuugacugcaccuucuguaaagaguuccugagaaacccgcaauguuacccuguaaagaaauggcucuuccuggugguaguuauaaugugcugcuauugugcccugaugcugcuuacuaacauacugagagcuauagguguuugggggacauggguuuuugcuccaauaaaguuggcucuagcauuaggguugaggcuugccaaacugucaaagaaggggcugguugcugugguuacaaggggccaaaugaucgugaaugaugagcugcaccagguucgaguggagagaggugagcaaaaugagggaagacaagguuauggcccaagaggccccauccgucacuggcuauacucaccugcccucauucucauucucaccacuucaauuugcucuggaugugaugagcuuguucaugcugagaguaaauccaucacaugcaagucugcaucugggaaugagaaggagugcucagugacaggcagagcuuugcucccagcugucaauccagggcaggaggccugcuugcacuuuagcgugccaggaagcccagacuccaagugccuuaagaucaaagugaaaucaauaaaucucagauguaagcaagccucuucauauuauguuccugaagcaaaggcaagauguacaucugucagaaggugcaggugggcaggugacugucaaucuggguguccaacauauuucagcucaaacucauucucagaugauugggcaaacaggauggacagggcugggcucgggaugagugggugcucagaugggugugguggagcugcauguggguguuuuaaugcagcgccauccugcaucuuuuggagaaaguggguggagaacccauccaaucgugucuggaaggugucaccuugugcaucaugggugcuagcugcaaccauugaguugacuuugccaucaggagagguuaagacucuagagccugucacagggcaagcaacucagauguucaaggguguugcaaucacauaucugggaucauccauugagauuguuggcaugaccaggcuaugugagaugaaagagauggggacugggauaauggcacuggcccccugcaaugauccagggcacgccauaaugggaaaugugggugagauccaaugcaguaguauagaaagcgcaaagcacaucaggucugaugggugcauuuggaaugcugaccuaguuggaauagaauugaggguugaugaugcuguguguuucucgaaacucacuaguguugaggcaguugcaaauuuuucaaaaaucccggcaacaauuucugggguucgcuuugaucaagggaaucauggagaaucacguaucuaugguagcccauuagauaucacgaggguuaguggggaauucucagugucauucagagggaugaggcucaaacuaucugagauaucagcaagcugcacaggugagauaacaaacgucucugguuguuacuccugcaugacuggggccucagucagcauaaaauuacauagcaguaagaacacaacaggucaucuuaagugugauucagaugagacugcauucagugucauggagggaacacacacauauaggccucacaugagcuuugauaaagcaguaauagaugaggagugugugcuaaacugugguggccacucaucaaaacuguugcuuaaagggagccuuguuuuuauggacgugccaagguuuguugauggaaguuauguccaaacauaucacagcaaggugcccgcugggggaagggucccaaauccgguagacuggcucaacgcacuguuuggagauggcauaacacgauggauucuugggauuauagggguucugcuggcaugugucaugcuauuugugguggugguugccaucacuaggcgauugaucaagggacugacucaaagggcgaagguggcauga

SEQ ID NO: 4324 - RNA, 3231 nt, Artificial Sequence
  derived and/or modified CDS sequence (wt) from HRTV(Patient1)__JX005845.1__GP
augauugccccaguuguccuguuuuucacucucuguccgucccaacucagcgccuggggcucuccaggagaccccauuguuuguggugugaggaccgaaacaaacaaauccauucagauugaguggaaggaggggagaucagagaaauuaugccagauugacagacuuggacaugucacaagcugguuaagaaaucacucaucuuuccaggggcuuauuggucaggugaaggggaggccaaguguuuccuacuucccggaaggagcuucuuacccuagguggagcgggcuauuaagcccaugugaugcugaauggcugggacuaauagcagugagcaaggcuggggauacagacaugauugucccaggcccaacuuacaaaggcaaaaucuuuguugagagaccaacguacaaugguuauaaaggcugggggugugcagaugggaagucacuaagccacucuggcacauauugugaaacugacagcucaguaaguucuggguuaauucagggugauaggguucucuggguuggggaaguagucugucagagagggacaccugugccagaagauguauuuagugaacugauuagcuugagucaaagugaguucccagaugugugcaagguugaugggguugcacugaaccaaugugagcaggagagcaucccccagccacuggacguugcauggauugauguuggaaggucucauaaagugcugaugagagaacacaaaacuaaauggguccaagagagcucagcaaaggacuuugugugcuucaaggugggucaggggccauguucaaaacaagaggaagaugacugcaugaguaagggcaacugccauggggaugagguuuucugcaggauggcaggaugcucugcccguaugcaagauaaucaagaaggcuguaggugcgaacugcuccaaaaaccuggagaaaucauugugaauuauggaggcgucucuguaagaccaacuuguuauggauucucuagaaugauggcaacauuggaaguucacaagccugauagagaauuaacagggugcacggguugucaccuagagugcauagagggaggggucaaaauuguaacacuuacaagcgagcugagaagugcaacaguuugugcuucacauuuuugugcauccgcaaaagggggcucaaagacaacugacauacucuuccacacuggugcucucguuggacccaaauccauuagaauuacgggccaguuguuagaugggagcaaguucuccuuugaugggcacugcauauucccagaugggugcauggcacuugacugcaccuucuguaaggaguuccugagaaacccacaauguuacccaguaaagaaauggcucuucuuggugguaguugugaugugcugcuauugcgcacugaugcugcuuacuaacauacugagagcuauagguguuuggggaacauggguuuuugcuccaauaaaguuaguucuagcauuaggauugaggcuugccaaacuaucaaagaagggguugguugcugugguuacaaggggccaaaugaucgugaaugaugagcugcaccagauucgaguggagagaggugagcaaaaugagggaagacuaggucauggcccaagaggucccguccgucacuggcuauacucaccugcccucauucucauucugaccacuucaauuugcucuggaugugaugagcucguucaugcugagaguaaaucuaucacaugcaagucugcaucugggaaugagaaggagugcucagugacaggcagagcuuuacucccagcuguuaauccaggacaggaggccugcuugcacuucaguaugccagggagcccagacucuaagugccucaagaucaaagugaaaucaauaaaucucagaugcaagcaagccucuucauauuauguuccugaagcaaaggcaagauguacaucuguaagaaggugcaggugggcaggugacugucaaucuggguguccaacauauuucagcucaaacucauucucagaugacugggcaaacaggauggacagggcugggcucgggaugagugggugcucagaugggugugguggggcugcauguggguguuucaaugcagcgccauccugcaucuuuuggagaaaguggguggagaacccauccaaucgugucuggaaggugucaccuugugcaucaugggugcuagcugcaaucauugaguugacuuugccaucaggagagguuaagacucuagagccugucacagggcaagcaacucaaauguuuaaggguguugcaaucacguaucuggguucauccauugagauuguuggcaugaccaggcuaugcgagaugaaagagaugggaacugggauuauggcacuagcccccugcaaugacccugggcacgccauaaugggaaaugugggugagauccaaugcaguaguauagaaagcgcaaagcacaucagaucugaugggugcauuuggaaugcugaccuaguugggauagaauuaaggguugaugaugcuguguguuucucaaaacucaccaguguugaggcagucgcaaauuucucaaaaaucccggcaauaauuucugggguccguuuugaucaagggaaucauggagaaucgcgaaucuaugguagcccauuagacaucacgaagguuaguggggaauucucagugucauucagggggaugaggcuuaaacugucugagauaucagcaagcugcacaggugagauaacaaacgucucugguugcuacuccugcaugacuggggccucugucagcauaaagcuacauagcaguaagaacacaacaggucaucuuaaaugugauucagaugagacugcauucagugucauggagggaacacacacuuauaggccucacaugagcuuugauaaagcagugguagaugaggagugugugcuaaacugugguggccauucaucaaagcuguugcuuaaggggagccuugucuucauggacgugccaagguuuguugaugggaguuauguucaaacauaccauagcaaggugccugcugggggaagggucccaaauccaguagauuggcucaacgcgcuguuuggagauggcauaacacgauggauucuugggauuauaggaguucuguuggcaugugucuugcuauuugugguggugguggccaucacuaggcgauugaucaaggggcugacucaaagggcgaagguggcauga

SEQ ID NO: 4325 - RNA, 3942 nt, Artificial Sequence
  derived and/or modified CDS sequence (wt) from PTV(PAN472868)__NC_027201.1__GP
augauuuuuacaauuuuaaauguuuuaacaagagccaugcucguaaugagcauguauucuuuaacuacgugggauagcaccagcagaaaugacaugugcuuuucuaaugacucaccucuagaaggccuaguuuacuacugggagacacacucaaaaaaacaugacuauaagaagcaagagucucagagaugcagaguuggagauucagauaaaaaaaugauaacuaaugucacaauaaucucucugauuucugaaauacaaaaaaguaucucugaguugucacuaucaugugguaaugaugacaauucuacuggacaagucuuaacauucaauggauuggaagacacaauacaaggugauuauauuguagacugcgugacuggcuuguaucagucagauaucggagucggugugggguuagggaagacucaccaugaucaucagcaagugaaaaacaaagcaguugugauagaugaaaaagaaagaaugauaucauuccuagagacucaacaaagcgagaacgacauaaagaugcaaguacuaaugucugaaauugaacaacugaagaaucaacugucaaagaagcggaaugagagaggccaggagaaaagagaugcugagaaggugaugucagacuugauggccaggaauucugauuuacggaagcauaaugauauucucacugcugagauaucucagauggaaaauaauaacacaauccaaagaaacaaaaauguaaugaguacuacuguagucccagcaauacuuucaguggccuuacugucaucaucaauugcucccauuauggcugcaucuccagauucaccgaugauuaauccauggccucaugcaaaaaacaggguuggcacaggaauguacaaauaugaugaaaaugaugacucaggcugcagaccaaucagauaugggguuucaugcauaggauuugacuuuaugcuuaaaauggacaaauauccuuucuuuaaugcauuuauaggccauaaaacucccuuagaauccuuugcugauaaaauaauugagaaagaggaagaaacaugugagauaggaacaaacaaagaguuuaaauguuucgaagagagagcuuacauaaaggggacaugcccaacuaacaucaaugcaguucacuacauugacaauaaagguaaauugcgauauguaaaaugcaaggaaaaucuggaaaugacugaggauugugcuuucuguaggaaaaucaagaagaaagcuggucagucuauucaggugcagaaaacuucagucccacuucaagaugcaauuugucaagaaaauucugauacuuauucuggaccaaaaauacccuuuaaagggguuuguaagauuggucuaauuaaauauaaagagugcaaguuuaaaacaucuucuuaugaaacugucucauucaucacacucaaagagaaggggaaaauuuacauugagcaccugauguugaaaaauauagaggugguuacaaaugucucuuuuguuugcuacgaacaugcaggucaggaugagcaagagguagaacacagggcucugaagagaguaucaguuaaugauuguaagauuguggacaacucuaaacagaaaauuugcacaggagaucacauuuucugugaaaaguaugauuguucuacaucuuauccagauguuacuuguauccaugcgccaggaucaggaccauuguacauaaaucucaugggcucauggauaaaaccccaaugugugggcuacgagagagucuuaguagauagagaagucaagcagccauugcuggcaccagaacagaacugugacaccuguguuucagagugucuagaugaggggguccauauaaaguccaccgguuuugagauaacaucagcaguagccugcucucauggaucuugcaucucagcucaucaagaagcguccacaucaguaauugucccauauccaggauuguuggccagugugggcggaagaauugggauucaccucucgcacacuucugauucugcuagugugcacaugguagugguuugcccucccagagacaguugugcagcucauaauugccugcuaugcuaucaugguauccugaauuaucagugccauucaacauuaagugcuauccugacuuccuuucuauuaauucucuucauauacacuguuuuuucugucacgacaaauauguuauaugugcucagacuaauaccuaaacagcuaaagaguccaguuggauggcucagacucuucauuaacuggcuauuaacugcuuuaagaaucaaaacuaggaauguuauggggaggauaaaccagaggauaggauggguugaccaucaugauguagagaggccaaggcacagagaaccuaugaggagauucaaaacaacucuauuguugacucugauaaugaugacuggaggaaaugcuugcucuaauacaguaguagccaauucaaagcaaaccagaugugugcaggaaggaucaagcacaaaguguucaaucacugcaacgauaacuuuaagggcaggugugauuggugcagagucauguuuuaucauaaaaggcccuauggaaaaucagcagaaaacaauaucaaucaaaaccaucucuagugaaacaguaugcagggagggaucaagcuucuggacuaguuuauauaucccauccugucuuaguucuaggaggugccaucuuguuggugauuguguaggcaauaaaugccagucguggagagaugaucaacuaucuagggaauuuucaggaguaaaggauaaccauauuaugaacgaaaauaaaugcuuugaacaguguggcgcaauugguugugguugcuuuaacauuaauccuuccugcuuguauguucaugcuuaccucaagagugcuagaaaugaagcaguuaggguuuucucauguucugauuggguacacagaguuucuuuugagguaaaagguccugauggugaaacagagcuggucacauugggaagccuaggcacuaaguuuuuaaacugggguacccugucuuuaucccuggaugcagaaggcaucagcggaaccaacagcaucagcuuucuggaaaguaguaaaggaggauuugccuuauaugaugaaggcuacagugagauaccaagagagggauuucuuggugagauaagguguaguucugaauccgcagcuauaucagcucacaagucuuguauuagagcuccugguuuaaucaaguacaagcccaugacagaucaaauagaauguacugcaucuuuaguggauccauucgcaauuuuccuuaagggaucucuuccucagacuagaaaugggcaaacauucaccagcacaaaagacaagaagacaguccaggcuuucacuaauggagcgauaaaagcacuauugucuauuaauuuagaugaucaugaaauugucuuuauuaacaaagugagaagcugugaugcaacauuucuaaauguuagugguugcuacuccugugauuauggagcucaugucugugugaaagucaaaucuucagagucagcugauuucuuugcagaaucagaagacaagacaacaguuuuaucuuucccaauacagucuggcacccaugauuacugucagguuuuacauuuucaaaaaccauuaguagaugaaagacuaucauauucuuguggaucugagccuaagcugauagugaucaagggaacacuggucuacaugggugucuaugauuucagaaacaaaacaggugguucuucaacaguaguaaauccuucagaaggugccuggagcauuucaaauugguuuucuggccuucuagacugguuaggugggccuaugaaggccauacuaaagauucugggcuuuauugccauugggauugucugcuuuauuuuauucaugauucugaucagaauugcagucaacucgauaaacaucaagaagaaaaacuag

SEQ ID NO: 4326 - RNA, 3942 nt, Artificial Sequence
  derived and/or modified CDS sequence (wt) from PTV(Adames)__KR912209.1__GP
augauuuuuacaauuuuaaauguuuuaacaagagccaugcucguuaugagcauguacucuuuaacaacgugggacagcuccaguaggaaugacauauguuuuucuaacgacucaccucuagagggccuugucuacuacugggagacacacucaaaaaaacaugacuauaagaaacaagguucucagaaguguagaguuggagauucugauaaaaagaugauuucuaauguuacaauaaucucucuaauuucugaaauacaaaaaagcaucucugagcuaucacugucaugugguaauaaugacaauucuacuggacaagucuugacauucaauggauuagaagauacaauacgaggcgacuacauuguggacugugugacuggauuauaccagucagacauuggagucgguguagggcuggggagaaucaaccaugaucaucagcaaguaaaaaauaaagcaguuguuauagaugagaaagaaaaaaugauaucacuucuagagacucaacaaagugagaaugacauaaagacacaaguacugaugucugaaauugaacaacugaagaaucaacuaucaaaaagacgaaaugagaggggacaggagaagagagaugcugaaaagcugaugucagaccugauggcuagaaauucugacuuacggaaucacaauguuauucuaacugacgaaauaucucaaauaaaaaauaauaucacaauucacagaaacagaaacaugaugaguacuacuguggucccagcaauacuuucgguggcucugcuaucaucaucaguuggucccauuacggcugcaccuccagauucaacuaugaucaauccauggccucaugcaaaaaauagaguuggcacaggaauguacaaauaugaugaaaaugaugagucaggguguagaccaaucagauaugguguuuccugcauaggauuugauuucaugcuuaagauggauaaguauccuuucuuuaaugcauuuauaggucauaaaacuccuuuagaauccuucgcagauaaaauaauugagaaagaagaagagacaugugaaauaggaacaaacaaagaguuuaaauguuuugaggagagagcuuacauaaaggggacauguccgaccaacaucaaugcaguucauuacauugacaauaaaggcaaguugcgauauguaaaaugcaaagagaaucuggaaaugacugaagacugugcuuucugcaggaaaaucaagaagaaagcuggucagucuguucaggugcagaaaacuucaguaccguuacaagaugcaauuugucaagagaacucagacauuuacuccggaccaaagauaccuuucaagggaguuuguaagaucggucuaauaaaguauaaagaguguaaguuuaaaacaucaucuuaugagaccauuucauucaucacacucaaagggaaaggaaaaauuuacauugagcacuugauguuaaaaaacauagagguggucacaaauguuucuuuuguuugcuaugaacaugcaggucaagaugaacaagagguagaacacagggcccugaagagaguaucagucaaugauuguaagauuguggacaacucuaagcagaagauuugcacaggagaccacauuuucugugagaaguaugacuguucuacaucuuauccagaugugacuuguauccacacaccaggaucagggccauuauacauaaaucucaugggcucauggauaaaaccccaauguguuggcuacgagagagucuuaguagauagggagguuaagcagccauugcuuguaccagagcagaacugugacaccuguguuucagagugucuagaugaaggaguacacauaaaauccacugguuuugaaauaacaucagcaguggccugcucacauggauccuguaucucagcucaucaggaagcauccacaucaguaauuauuccauauccaggcuuguuggcuagugugggcgggagaauugggauacaccucucacauacuucugauucugcuaguguacacaugguagugguuugcccucccagagauaguugugcagcucauaauugcuuacuaugcuaucauggcauucugaacuaucagugccauucaacacugagugcuauccugacuuccuuucuacuaauucuuuucauauacacugcuuuuucugugacaacaaauguuuuguaugugcucagacuaauaccgaaacagcugaaaaguccagugggauggcucaaacucuuugucaacuggcuacuaacugcucuaagaaucaaaacuaggcgaguaauggggaggauaaaucagagaauaggguggguugaucaucaugauguagagagaccaaggcacagagaaccuaugaggagauucaagacaacucuauugcuaacucugauaauggugacaggaggaaaugccugcuccaauacaguaguggccaauucgaagcaaaccagauguguccaagaaggaucaaacacaaaguguucuauuacugcaacuauaacuuuaagggcaggugugauuggugcugagucauguuucauaauaaaaggccccauggaaaaccagcagaaaacaauaucaauuaaaaccaucucuagugagacaguaugcagagaagguucgaguuucuggaccaguuuguacaucccaucuugucuuaguucuaggagaugucaucuuguuggugauuguguggguaacaaaugccagucauggcgagaugaucagcuauccagggaguuuucaggaguaaaggauaaccauauuaugaaugaaaauaaaugcuuugaacaauguggugcaauuggcugugguuguuucaacaucaauccuuccugcuuguauguccaugcuuaucucaagagugcuagaaaugaagcagucaggguauucucauguucugacugggugcacagaguuuccuuugaggucaaaggcccugauggcgagauggaguuggucacacuagggagccugggcacuaaguuuuuaaacuggggcacuuugucauuauccuuggaugcagaagguaucagcggaaccaacaguaucaguuuuuuggaaaguaguaaaggaggguuugcucuguacgaugaaggauauagugaaauaccaagagaaggauuucuuggagagauaaggugcaguucugaauccgcagccauaucagcucauaagucaugcauuagagcuccugguuugaucaaguacaagcccaugacagaucaaauagaauguacugcaucuuuaguagauccauuugcaauuuuccucaaaggaucucuuccucagacuaggaauggacagacauucaccaguacaaaagacaaaaaaacaguacaggccuucaccaauggagcaauaaaagcauuauugucgauuaauuuagaugaucaugaaaucaucuuuauuaauaaagugaaaagcugugaugccacauuuuuaaauguuaguggaugcuacucuugugauuauggagcacaugucugugugaaaguaaagucuucggagucagccgacuucuuugcagaaucggaggacaaaacaacaguccugucuuuuccaauacaaucuggcacacgugacuacugucagguuuuacauuuucaaaagccauuaguagaugaaagacuuucauauucuuguggaucugagccuaagcugauagugauuaagggaacauuaguuuacaugggugucuaugauuuuagggauaaaacaggugguucuucaacagugauaaauccuucagaaggaaccuggagcaucuccaauugguuuucugggcuucuggacuggcuaggugggccuaugaaggccauacugaagauacugggcuucauugcuauugggauuguuugcuucauuuuguucaugauucugauuagaauugcagucaacucaauaaauaucaagaagaaaaacuaa

SEQ ID NO: 4327 - RNA, 3942 nt, Artificial Sequence
  derived and/or modified CDS sequence (wt) from PTV(Balliet)__KR912213.1__GP
augauuuuuacaauuuuaaauguuuuaacaagagccaugcucguaaugagcauguauucuuuaacuacgugggacagcaccagcagaaaugacaugugcuuuucuaaugacucaccucuagaaggccuaguuuacuacugggagacacacucaaaaaagcaugacuauaagaagcaagagucucagagaugcagaguuggagauucagacaaaaaaaugauaacuaaugucacaauaaucucucugauuucugaaauacaaaaaagcaucucugaguugucacuaucauguggcaaugaugacaauucuacuggacaagucuuaacauucaauggauuagaagacacaauacgaggugauuacauuguagacugcgugacuggcuuguaucagucagauauuggagucgguguggggcuagggaggacucaccauggucaucagcaaaugaaaaacaaagcaguuguaauagaugagaaagaaaggaugauaucacuccuagagacucaacaaagugagaaugacauaaagaugcaaguacuaaugucugaaauugaacaacugaagaaucaacugucaaagaagcgaaaugagagaggccaggagaaaagagaugcugagaaggugaugucagacuugauggccaggaauucugacuuacggaagcauaaugacauucucacugcugaaauaucucagaugaaaaauaaaaacacaauccaaagaaauaaaaauacagugaguacuacuguagucccagcaauacuaucaguggccuuacugucaucaucaguugcucccauuauagcugcaccuccagauucaccgaugauuaauccauggccucaugcaaaaaauagaguuggcacaggaauguacaaauaugaugaaaaugaugacucaggcuguagaccaauaagauauggaguuucaugcauaggauuugacuuuaugcucaagauggacaaauacccuuucuuuaaugcauucauaggucacaaaacucccuuagaaucuuuugcugauaaaauaauugagaaagaagaagaaacaugugagauaggaacaaacaaagaguuuaaauguuucgaggagagagcuuauauaaaggggacauguccgaccaacaucaaugcaguccauuacauugacaauaaaggcaaauugcgauauguaaaauguaaggaaaaucuggaaaugacugaggauugugcuuucuguaggaaaaucaagaagaaagcuggucagucuguucaggugcagaaaacuucaguuccacuccaggaugcaauuugucaagaaaauucagacacuuauucuggaccaaagauacccuuuaaagggguuugcaaaauuggucuaaucaaauauaaagaaugcaaguuuaaaacaucuucuuaugagacugucucauucauaacacucaaggagaaggggaagauuuacauugagcaccuaauguugaaaaauauagaggugguuacgaaugucucuuuuguuugcuacgaacauguagggcaggaugagcaagagguggaacauagggcucugaagagaguaucaguuaaugauuguaagauuguggacaacucaaagcagaaaauuugcacaggagaucacguuuucugugaaaaguaugauuguuccacauccuauccagauguuacuuguauccaugcgccaggaucaggaccacuguacauaaaucucaugggcucauggauaaaaccccaaugugugggcuaugagagagucuuaguagacagggaagucaagcagccauugcuugcaccagaacagaacugugacaccuguguuucagagugucuagaugaggggguccauauaaaguccacugguuuugagauaacaucagcaguagccugcucacaugggucuugcaucucagcucaucaagagccauccacaucaguaauugucccauacccaggauuguuggccagugugggcggaagaauugggauucaccucucacauacuucugauucugcuagugugcacaugguagugguuugcccuccuagagacaguugugcagcucauaauugcuugcuaugcuaucauggcauccuaaauuaucagugccauucaacauuaagugccauccugacuuccuuucuauuaauucucuucauauacacugucuuuucugugacgacaaauauauuauaugugcucagacuaauaccaaaacagcuaaagaguccagugggauggcucaagcucuucaucaacuggcugcuaacugcucuaagaaucaaaacuagaaauguuaugaggaggauaaaccagagaauaggauggguugaccaucaugauguagagagaccaaggcacagagaaccuaugagaagauucaaaacaacucuauuguugacucugauaaugaugacuggaggaaaugcuugcuccaauacaguaguggcuaacucaaagcaaaccagauguguacaggaaggaucaaacacaaagugcucaaucacugcaacuauaacuuuaagggcaggugugauuggugcagagucgugcuuuauaauaaaaggcccuauggagaaucagcagaaaacaauaucaaucaaaacuaucuccagugagacaguaugcagagagggaucaagcuucuggacuaguuuauauaucccaucaugucuuagcucuaggaggugucaucuuguuggugauuguguaggcaauaaaugccagucguggagagaugaucagcuaucuagggaauuuucaggaguaaaggauaaccauaucaugaacgaaaauaaaugcuuugaacaauguggcgcaauugguugugguuguuuuaacauuaauccuuccugcuuguacguucaugcuuaccucaaaagugcuagaaaugaagcaguuaggguuuucucauguucugauugggugcacagaguuucuuuugagguaaaagguccugauggugaaacagagcuggucacauugggaagucuaggcaccaaguuuuuaaacuggggcacccugucauuaucccuggaugcagaaggcaucagcggaaccaacagcaucagcuuucuggaaaguaguaaaggaggauuugccuuauacgaugaaggcuacaaugagauaccaagagagggauuucuaggugagauaagguguaguucugaauccgcagcuauaucagcucauaagucuuguauuagagcuccugguuuaaucaaguacaagccuaugacagaucaaauagaauguacugcaucuuuaguggauccauucgcaauuuuccuuaaaggaucucuuccucagacuagaaauggacaaacauucaccagcacaaaagacaagaagacaguucaggcuuucacuaauggagcgauaaaagcgcuauugucuauuaauuuagaugaucaugaaauugucuuuauuaacaaagugaaaaacugugaugcaacauuucuaaauguuagugguugcuacuccugugauuauggagcucaugucugugugaaaguuaaaucuucagagucagcugauuucuuugcagaaucagaagacaagacaacaguuuuaucuuucccaauacagucuggcacccaugauuacugucagguuuuacauuuucaaaaaccauuaguagaugaaagacuaucauauucuuguggaucagagccuaagcugauagugaucaagggaacauugguuuacaugggugucuaugauuucagaaacaaaacagguggcucuucaacaguaguaaacccuucagaaggugccuggagcauuucaaauugguuuucuggccuucuagacugguuaggugggccuaugaaggccauacuaaagauuuugggcuuuauugccauugggauugucugcuuuguuuuauucaugauucugaucagaauugcagucaacucaauaaauaucaagaagaaaaacuag

SEQ ID NO: 4328 - RNA, 3942 nt, Artificial Sequence
  derived and/or modified CDS sequence (wt) from PTV(PaAR2381)__KP272005.1__GP
augauuuuuacaauuuugaauauuuuaacaagagccaugcucgugaugagcauguauucuuuaacaacaugggauagcaccagcagaaaugacaugugcuucucuaaugacucaccucuagaaggccuaguuuacuacugggagacacacucaaaaaaacaugacuauaagaagcaagagucucagaaaugcagaguuggagacucagauaaaaaaaugauaucuaaugucacaauaaucucucugauuucugaaauacaaaagagcaucucugaguugucacuaucaugugguaaugaugacaauucuacugggcaagucuuaacauucaauggauuagaagauacaauacgaggcgauuacauuguagacugugugacuggcuuguaucagucagauauuggagucgguguggggcuggggaggacucaccaugaucaucaucaagugaaaaacaaggcagucgugauagaugagaaagaaagaaugauaucacuccuagagacucaacaaagugagaaugauauaaagaugcaaguacuaaugucugaaauugaacaacugaagaaucaacugucaaggaagcgaaaugagagaggacaggagaaaagagaugcugaaaaggugaugucagacuugauggccaggaauucugauuuacggaagcauaaugauauucucacugcugagauaucucagaugaaauauaauaacacaauccaaagaagcaaaaauguaaugaguacuacuguagucccagcaauacuuucaguggccuuacugucaucaucaguugcucccauuauggcugcgccuccagauucaccgaugauuaauccauggccucaugcaaaaaauagaguuggaacagggauguacaaauaugaugauaaugaugacucaggcuguagaccaaucagauauggaguuucaugcauaggauuugacuuuaugcucaagauggacaaauacccuuucuuuaaugcauucauaggccauaaaacucccuuagaaucauuugcugauaaaauaaucgagaaagaagaagaaacaugugagauagggacaaacaaagaguuuaaauguuucgaggagagagcuuacauaaaggggacauguccgacuaacaucaaugcaguccauuacauugacaauaaaggcaaauugcgauaugugaaauguaaggaaaaucuggagaugacugaggauugugcuuucuguaggaaaaucaagaagaaagcuggucagucuguucaggugcaaaaaacuucagucccucuucaagaugcaauuugucaggaaaauucagacaauuauucuggaccaaagauacccuuuaaagggguuugcaggauuggucuaaucaaauauaaagagugcaaguuuaaaacgucuucuuaugagacugucucauucauaacacucaaggagaaagggaagauuuauauugagcaccuaauguugaaaaauauagagguaguuacgaaugucucuuuuguuugcuacgaacaugcaggucaggaugagcaagagguagaacacagggcuuugaagaggguaucaguuaaugauuguaagauuguggacaacuccaagcagaaaauuugcacaggagaucacguuuucugugaaaaguaugauuguucgacaucuuauccagauguuacuuguauccaugcgccaggaucaggaccauuguacauaaaucucaugggcucauggauaaaaccccaaugugugggcuaugagagagucuuaguugacagggaagucaagcagccacugcuugcaccagaacagaacugugacaccuguguuucagagugucuagacgaggggguucauauaaaguccacuggcuuugagauaacaucagcaguagccugcucacaugggucuugcauuucagcucaucaagaggcguccacaucaguaauugucccauacccaggauuauuggccagugugggcggaagaauugggauucaccucucacauacuucugauucugcuagugugcacaugguagugguuugcccuccuagagacaguugugaagcucacaauugcuuacuaugcuaucaugguauccuaaauuaucagugccauucaacauuaagugcuauccugacuuccuuucuauuaauucucuucauauauacuguuuuuucugugacgacaaauauguuauaugugcucagacuaauaccaaaacagcuaaagaguccagugggauggcucaaacucuucaucaacuggcugcuaacugcucuaagaaucaaaacuagaaauguuauggggaggauaaaccagagaauaggauggguugaccaucaugauguagagagaccaaggcacagagaaccuaugagaagauucaaaacaacucuauuguuaacucugauaaugaugacuggagggaaugcuugcuccaauacaguaguagcuaauucaaagcaaaccagauguguacaggaaggaucaaacacaaagugcucaaucacugcaacuauaacuuuaagggcaggcgugauuggugcagagucauguuuuauaauaaaaggcccuauggagaaucagcagaagacaauaucaaucaagaccaucuccagugagacaguaugcagggagggaucaagcuucuggacuaguuuauauaucccaucaugucuuagcucuaggaggugccaucuuguuggugauuguguaggcaauaaaugccagucguggagagaugaucaacuaucuagggaauuuucaggaguaaaggauaaccauauuaugaacgaaaauaaaugcuuugaacaguguggcgcaauugguugugguugcuuuaacauuaauccuuccugcuuguauguucaugcuuaccucaagagugcuagaaaugaagcaguuaggguuuucucauguucugauuggguucacagaguuucuuuugagguaaagggcccugauggugagacagagcuggucacauugggaagccuaggcaccaaguuuuuaaacuggggcacccugucuuuauccuuggaugcagaaggcaucagcggaaccaacagcaucaguuuucuggaaaguaguaaaggaggauuugccuuauacgaugaaggcuauagugagauaccaagagagggauuucuuggcgagauaagguguaguucugaauccgcagcuauaucagcucacaagucuuguauuagagcuccugguuuaaucaaguacaagccuaugacagaucaaauagaauguacugcaucuuuaguggauccauucgcaauuuuccuuaaaggaucucuuccucagacuagaaauggacaaacauucacuagcacaaaagacaagaagacaguacaggcuuucacuaauggagcgauaaaagcgcuauugucuauuaauuuagaugaucaugaaauugucuuuauuaacaaagugaaaagcugugaugcaacauuucuaaauguuagugguugcuacuccugugauuauggagcacaugucugugugaaagucaaauccucagaaucagcugauuucuuugcagaaucagaagacaagacaacaguuuuaucuuucccaauacagucuggcacccaugauuacugucagguuuuacauuuucaaaaaccauuaguagaugaaagacuuucauauucuuguggaucugagccuaagcuuauagugauuaagggaacauuaguuuacauggguguauaugauuucagaaacaaaacaggugguucuucaacagugguaaauccuucagaaggcgccuggagcaucucaaauugguuuucaggccuucuagacugguuaggcgggccuaugaaggcuauacugaagauucugggcuucauugcuauugggauuguuugcuuuauuuuauucaugauuaugaucagaauugcagucaacucaauaaauaucaagaagaaaaacuag

SEQ ID NO: 4329 - RNA, 3942 nt, Artificial Sequence
  derived and/or modified CDS sequence (wt) from PTV(PAN483391)__KP272008.1__GP
augauuuuuacaauuuuaaauauuuuaacaagagccaugcucguaaugagcauguauucuuuaacuacgugggauagcacuagcagaaaugacaugugcuuuucuaaugacucaccucuagaaggccuaguuuacuacugggagacacacucaaaaaaacaugacuauaagaagcaagagucucagagaugcaggguuggagauucagauaaaaaaaugauaacuaaugucacaauaaucucucugauuucugaaauacagaaaaguaucucugaguugucacuaucaugugguaaugaugacaauucuacuggacaagucuuaacauucaauggauuagaagacacaauacgaggcgauuacauuguagacugcgugacuggcuuguaucagucagauauuggagucggcgugggguuagggaggacucaccaugaucaucagcaagugaaaaacaaagcaguugugauagaugaaaaagaaagaaugauaucacuccuagagacucaacaaagugagaaugauauaaagaugcaaguacuaaugucugaaauugaacaacugaagaaucaacugucaaagaagcgaaaugagagaggccaggagaaaagagaugcugagaaggugaugucagacuugauggccaggaauucugacuuacggaagcauaaugauauucucacugcugaaauaucucagaugaaauaugauaacacaauccaaagaaacaaaaauguaaugaguacuacuguagucccagcaauacuuucaguggccuuacugucaucaucaauugcucccauuauggccgcaucuccagauucaccgaugauuaauccauggccucaugcaaaaaacaggguuggcacaggaauguacaaauaugaugaaaaugaugacucaggcugcagaccaaucagauaugggguuucaugcauaggauuugacuuuaugcucaagauggacaaauauccuuucuuuaaugcauuuauaggccauaaaacucccuuagaauccuuugcugauaaaauaauugagaaagaggaagaaacaugugagauaggaacaaacaaagaguuuaaauguuucgaggagagagcuuacauaaaggggacaugcccaacuaacaucaaugcaguucauuacauugacaauaaagguaaauugcgauauguaaaaugcaaggaaaaucuggaaaugacugaggauugugcuuucuguaggaaaaucaagaagaaagcuggucagucuguucaggugcagaaaacuucaguuccacuucaagaugcaauuugucaagaaaauucagauacuuauucuggaccaaagauacccuuuaaagggguuuguaagauuggucuaauuaaauauaaagagugcaaguuuaaaacaucuucuuaugagacugucucauucaucacacucaaggagaaggggaaaauuuacauugagcaccugauguugaaaaauauagaggugguuacaaaugucucuuuuguuugcuacgagcaugcaggucaggaugagcaagagguagaacacagggcucugaagagaguaucaguuaaugauuguaagauuguggacaacucuaaacagaaaauuugcacaggagaucauguuuuuugugaaaaguaugauuguucuacaucuuauccagauguuacuuguauccaugcaccaggaucaggaccauuguauauaaaucucaugggcucauggauaaaaccccaaugugugggcuacgagaaagucuuaguagauagagaagucaagcagccguugcuugcaccagaacagaauugugacaccuguguuucagagugucuagaugaggggguccauauaaaguccaccgguuuugagauaacaucagcaguagccugcucacauggaucuugcaucucagcucaucaagaagcgucuacaucaguaauugucccauauccaggauuguuggccagugugggcgggaaaauugggauucaccucucgcacacuucugauucugcuagugugcacaugguagugguuugcccucccagagacaguugugcagcucauaauugucugcugugcuaucaugguauccugaauuaucagugccauucaacauuaagugcuauccugacuuccuuucuauuaauucucuucauauacacuguuuuuucugucacgacaaauauguuauaugugcucagacuaauaccaaaacagcuaaagaguccaguuggauggcucagacucuucauuaacuggcuguuaacugcuuuaagaaucaaaacuaggaauguuauggggaggauaaaccagaggauaggauggguugaccaucaugauguagagagaccaaggcacagagaaccuaugaggagauucaaaacaacucuauuguugacucugauaaugaugacuggaggaaaugcuugcuccaacacaguaguagcuaauucaaagcaaaccagauguguacaggaaggaucaaacacaaagugcucaaucacugcaacuauaacuuuaaaggcaggugugauuggugcagagucauguuuuauaauaaaaggcccuauggagaaucagcagaaaacaauaucaaucaaaaccaucuccagugagacaguaugcagggagggaucaagcuuuuggacuaguuuauauauuccaucaugucuuagcucuaggaggugccaucuuguuggugauuguguaggcaauaaaugccagucguggagagaugaucaacuaucuagggaauuuucaggaguaaaggauaaccauauuaugaacgaaaauaagugcuuugaacaguguggcgcaauugguugugguuguuuuaacauuaauccuuccugcuuguacguucaugcuuaccucaagagugcuagaaaugaagcaguuaggguuuucucauguucugauuggguacacagaguuucuuuugagguaaaagguccugauggugaaacagagcugguuacauugggaagccuaggcacuaaguuuuuaaacuggggcacccugucuuuaucccuggaugcagaaggcaucagcggaaccaacagcaucagcuuucuggaaaguagcaaaggaggguuugccuuauaugaugaaggcuacagugagauaccaagagagggauuucuuggugagauaagguguaguucugaauccgcagcuauaucagcucauaagucuuguauuagagcuccugguuuaaucaaguacaagcccaugacagaucaaauagaaugcacugcaucuuuaguggauccauucgcaauuuuccuuaaaggaucucuuccucaaacuagaaaugggcaaacauucaccagcacaaaagacaagaagacaguucaggcuuucacuaauggggcgauaaaagcacuauugucuauuaacuuagaugaucaugaaauugucuuuauuaacaaagugagaagcugugaugcaacauuucuaaauguuaguggcugcuacuccugugauuauggagcucaugucugugugaaagucaaaucuucagagucagcugauuucuuugcagaaucagaagacaagacaacaguuuuaucuuucccaauacagucuggcacccaugauuacugucagguuuuacauuuucaaaaaccauuaguagaugaaagacuaucauacucuuguggaucugagccuaagcugauagugaucaagggaacauugguuuacaugggugucuaugauuucagaaacaaaacaggugguucuucaacaguaguaaauccuucagaaggugccuggagcauuucaaauugguuuucuggccuucuagacugguuaggugggccuaugaaggcuauacuaaagauucugggcuuuauugccauugggauugucugcuuuauuuuauuuaugauucugaucagaauugcagucaacucaauaaacaucaagaagaaaaacuag

SEQ ID NO: 4330 - RNA, 3942 nt, Artificial Sequence
  derived and/or modified CDS sequence (wt) from PTV(GML902876)__KP272011.1__GP
augauuuuuacaauuuugaacguuuuaacaagagccaugcucgugaugagcauguauucuuuaacaacaugggauaguaccagcagaaaugacaugugcuucucuaaugacucaccucuagaaggccuaguuuacuacugggagacacacucaaaaaaacaugacuauaagaagcaagagucucagaaaugcagaguuggagacucagauaaaaaaaugauaucuaaugucacaauaaucucucugauuucugaaauacaaaagagcaucucugaguugucacuaucaugugguaaugaugacaauucuacugggcaagucuuaacauucaauggauuagaagauacaauacgaggcgauuacauuguagacugugugacuggcuuguaucagucagauauuggagucgguguggggcuggggaggacucaccaugaucaucaucaagugaaaaacaaggcagucgugauagaugagaaagaaagaaugauaucacuccuagagacucaacaaagugagaaugauauaaagaugcaaguacuaaugucugaaauugaacaacugaagaaucaacugucaaggaagcgaaaugagagaggacaggagaaaagagaugcugaaaaggugaugucagacuugauggccaggaauucugauuuacggaagcauaaugauauucucacugcugagauaucucagauggaaaauaauaacacaauccaaagaaauaaaaauguaaugaguacuacuguagucccagcaauacuuucaguggccuuacugucaucaucaauugcccccauuauggcugcaucuccagauucaccgaugauuaauccauggccucaugcaaaaaacaggguuggcacaggaauguacaaauaugaugaaaaugaugacucaggcugcagaccaaucagauaugggguuucaugcauaggauuugacuuuaugcuuaaaauggacaaauauccuuucuuuaaugcauuuauaggccauaaaacucccuuagaauccuuugcugauaaaauaauugagaaagaggaagaaacaugugagauaggaacaaacaaagaguuuaaauguuucgaagagagagcuuacauaaaggggacaugcccaacuaacaucaaugcaguucacuacauugacaauaaagguaaauugcgauauguaaaaugcaaggaaaaucuggaaaugacugaggauugugcuuucuguaggaaaaucaagaagaaagcuggucagucuauucaggugcagaaaacuucagucccacuucaagaugcaauuugucaagaaaauucugauacuuauucuggaccaaaaauacccuuuaaagggguuuguaagauuggucuaauuaaauauaaagaguguaaguuuaaaacaucuucuuaugaaacugucucauucaucacacucaaagagaaggggaaaauuuacauugagcaccugauguugaaaaauauagaggugguuacaaaugucucuuuuguuugcuacgaacaugcaggucaggaugagcaagagguagaacacagggcucugaagagaguaucaguuaaugauuguaagauuguggacaacucuaaacagaaaauuugcacaggagaucacauuuucugugaaaaguaugauuguucuacaucuuauccagauguuacuuguauccaugcgccaggaucaggaccauuguacauaaaucucaugggcucauggauaaaaccccaaugugugggcuacgagagagucuuaguagauagagaagucaagcagccauugcuggcaccagaacagaacugugacaccuguguuucagagugucuagaugaggggguccauauaaaguccaccgguuuugagauaacaucagcaguagccugcucucauggaucuugcaucucagcucaucaagaagcguccacaucaguaauugucccauauccaggauuguuggccagugugggcggaagaauugggauucaccucucgcacaccucugacucugcuagugugcacaugguggugguuugcccucccagagacagcugugcagcucauaauugccugcuaugcuaucaugguauccugaauuaucagugccauucaacauuaagugcuauccugacuuccuuucuauuaauucucuucauauacacuguuuuuucugucacgacaaauauguuauaugugcucagacuaauaccuaaacagcuaaagaguccaguuggauggcucagacucuucauuaacuggcuauuaacugcuuuaagaaucaaaacuaggaauguuauggggaggauaaaccagaggauaggauggguugaccaucaugauguagagaggccaaggcacagagaaccuaugaggagauucaaaacaacucuauuguugacucugauaaugaugacuggaggaaaugcuugcuccaauacaguaguagccaauucaaagcaaaccagaugugugcaggaaggaucaagcacaaaguguucaaucacugcaacgauaacuuuaagggcaggugugauuggugcagagucauguuuuaucauaaaaggcccuauggaaaaucagcagaaaacaauaucaaucaaaaccaucucuagugaaacaguaugcagggagggaucaagcuucuggacuaguuuauauaucccauccugucuuaguucuaggaggugucaucuuguuggugauugugugggcaauaaaugccagucguggagagaugaucagcuaucuagggaauucucaggaguaaaggauaaucauaucaugaaugaaaauaaaugcuuugaacaauguggcgcaauugguugugguuguuuuaacauuaauccuuccugcuuguacguucaugcuuaccucaagagugcuagaaaugaagcaguuaggguuuucucauguucugauuggguucacagaguuucuuuugagguaaagggcccugauggugagacagagcuggucgcauugggaagccuaggcaccaaguuuuuaaacuggggcacccugucuuuauccuuggaugcagaaggcaucagcggaaccaacagcaucaguuuucuggaaaguaguaaaggaggauuugccuuauacgaugaaggcuauagugagauaccaagagagggauuucuuggcgagauaagguguaguucugaauccgcagcuauaucagcucacaagucuuguauuagagcuccugguuuaaucaaguacaagccuaugacagaucaaauagaauguacugcaucuuuaguggauccauucgcaauuuuccuuaaaggaucucuuccucagacuagaaauggacaaacauucacuagcacaaaagacaagaagacaguacaggcuuucacuaauggagcgauaaaagcgcuauugucuauuaauuuagaugaucaugaaauugucuuuauuaacaaagugaaaagcugugaugcaacauuucugaauguuagugguugcuacuccugugauuauggagcacaugucugugugaaagucaaauccucagaaucagcugauuucuuugcagaaucagaagacaagacaacaguuuuaucuuucccaauacagucuggcacccaugauuacugucagguuuuacauuuucaaaaaccauuaguagaugaaagacuuucauauucuuguggaucugagccuaagcuuauagugauuaagggaacauuaguuuacauggguguauaugauuucagaaacaaaacaggugguucuucaacagugguaaauccuucagaaggcgccuggagcaucucaaauugguuuucaggccuucuagacugguuaggcgggccuaugaaggcuauacugaagauucugggcuucauugcuauugggauuguuugcuuuauuuuauucaugauuaugaucagaauugcagucaacucaauaaauaucaagaagaaaaacuag

SEQ ID NO: 4331 - RNA, 3942 nt, Artificial Sequence
  derived and/or modified CDS sequence (wt) from PTV(PAN479603)__KP272014.1__GP
augauuuuuacaauuuuaaauauuuuaacaagagccaugcucguaaugagcauguauucuuuaacaacaugggauagcaccagcagaaaugacaugugcuucucuaaugacucaccucuagaaggcuuaguuuacuacugggagacacacucaaaaagacaugauuauaagaagcaagagucucagaaaugcagaguuggagacucagauaaaaaaaugauaucuaaugucacaauaaucucccugauuucugaaauacaaaaaagcaucucugaauugucacuaucauguggcaaugaugacaauucuaccgggcaagucuuaacauucaauggacuagaagauaccauacgaggcgauuacauuguagacugugugacuggcuuguaucagucagauauuggagucgguguggggcuggggaggacucaccaugaucaucaucaagugaaaaacaaggcaguugugauagaugagaaggaaagaaugauaucacuccuggagacucaacaaagugagaaugauauaaagaugcaaguacuaaugucugagauugaacaacugaagaaucaacugucaaggaagcgaaaugagagaggccaggagaaaagagaugcugagaaggugaugucagacuugauggccaggaauucugacuuacggaagcauaaugauauucucacugcugaaauaucucagaugaaauaugauaacacaauccaaagaaauaaaaaugucaugaguacuacuguagucccagcaauacuuucaguggccuuacugucaucaucaguugcucccauuauagcugcgccuccagauucaccgaugauuaauccauggccucaugcaaaaaauagaguuggaacagggauguacaaauaugaugauaaugaugacucaggcuguagaccaaucagauauggaguuucaugcauaggauuugacuuuaugcucaagauggacaaauacccuuucuucaaugcauucauaggccauaaaacucccuuagaaucauuugcugauaaaauaauugagaaagaagaagaaacaugugagauagggacaaacaaagaguucaaauguuucgaggagagagcuuacauaaaggggacauguccgacuaacaucaaugcaguccauuacauugacaauaaaggcaaauugcgauaugugaaauguaaggaaaaucuggaaaugacugaggauugugcuuucuguaggaaaaucaagaagaaagcuggucagucuguucaggugcagaaaacuucagucccacuucaagaugcaauuugucaagaaaauucagacacuuauucuggaccaaagauacccuuuaaagggguuugcaagauuggccuaaucaaauauaaagagugcaaguuuaaaacgucuucuuaugagacugucucauucauaacacucaaggagaaagggaagauuuauauugagcaccuaauguugaaaaauauagagguaguuacgaaugucucuuuuguuugcuacgaacaugcaggucaggaugagcaagagguagaacacagggcucugaagagaguaucaguuaaugauuguaagauuguggacaacuccaagcagaaaauuugcacaggagaucacguuuucugugaaaaguaugauuguucgacaucuuauccagauguuacuuguauucaugcgccaggaucaggaccauuguacauaaaucuuaugggcucauggauuaaaccccaaugugugggcuacgagagagucuugguagacagggaaguuaagcagccauugcuugcaccagaacagaacugugacaccuguguuucagagugucuagaugaggggguccauauaaaguccacuggcuuugagauaacaucagcaguagccugcucacaugggucuugcaucucagcucaucaagaggcguccacaucaguaauugucccauacccaggauuauuggccagugugggcggaagaauugggauucaccucucacauacuucugauucugcuagugugcacaugguagugguuugcccuccuagagacaguugugcagcucauaauugcuugcuaugcuaucaugguauccuaaauuaucagugccauucaacauuaagugccauccugacuuccuuucuauuaauucucuucauauacacuguuuuuucugugacgacaaauauguuauaugugcucagacuaauaccaaaacagcuaaagaguccagugggauggcucaaacucuucaucaacuggcugcuaacuacucuaagaaucaaaacuagaaauguuauggggaggauaaaccagagaauaggauggguugaccauuuugauguagagagaccaaggcacagagagccuaugagaagauucaaaacaacucuauuguugacucugauaaugaugacuggagggaaugcuugcuccaauacaguaguagccaauucaaagcaaaccagaugugugcaggaaggaucaaacacaaaauguucaaucacugcaacgauaacuuuaagggcaggugugauuggugcagaaucauguuuuaucauaaaagggccuauggaaaaucagcagaaaacaauaucaaucaaaaccaucucuagugagacaguaugcagggagggaucaagcuucuggacuaguuuauauaucccaucuugucuuaguucuaggaggugucaucuuguuggugauugugugggcaauaaaugccagucguggagagaugaucagcuaucuagggaauucucaggaguaaaggauaaccauaucaugaaugaaaacaaaugcuuugaacaauguggcgcaauugguugugguuguuuuaacauuaauccuuccugcuuguacguucaugcuuaccucaagagugcuagaaaugaagcaguuaggguuuucucauguucugauuggguucacagaguuucuuuugaggugaagggcccugauggugagacagagcuagucacauugggaagcuuaggcaccaaguuuuuaaacuggggcacccugucuuuauccuuggaugcagaaggcaucaguggaaccaacagcaucaguuuucuggaaaguaguaaaggaggauuugccuuauacgaugaaggcuauagugagauaccaagagaaggguuucuuggcgagauaagguguagcucugaauccgcagcuauaucagcucauaaguccugcauuagggcuccugguuuaaucaaguacaagcccaugacagaucaaauagaauguacugcaucuuuaguggauccauucgcaauuuuccuuaaaggaucucuuccucagacuagaaauggacagacauucaccagcacaaaagacaagaagacaguacaggcuuucacuaauggagcgauaaaggcgcuauugucuauuaauuuagaugaucaugaaauugucuuuauuaacagagugaaaagcugugaugcaacauuucuaaauguuagugguugcuacuccugugauuauggagcacaugucugugugaaagucaaauccucagaaucagcugauuucuuugcagaaucagaagacaagacaacaguucuaucuuucccaauacagucuggcacccaugauuacugucagguuuuacauuuucaaaaaccauuaguagaugagagacuuucauauucuuguggaucugagccuaagcuuauagugauuaagggaacauuaguuuacaugggugucuaugauuucagaaacaaaacaggugguucuucaacaguggugaauccuucagaaggcgccuggagcaucucaaauugguucucuggccuucuagacugguuaggugggccuaugaaggccauacugaagauucugggcuucauugcuauugggauuguuugcuuuauuuuauuuaugauucugaucagaauugcagucaacucaauaaauaucaagaagaaaaacuaa

SEQ ID NO: 4332 - RNA, 3942 nt, Artificial Sequence
  derived and/or modified CDS sequence (wt) from PTV(PAN478718)__KP272017.1__GP
augauuuucacaauuuuaaauguuuuaacaagagccaugcucguaaugagcauguauucuuuaacuacgugggacaguuccagcagaaaugacauguguuuuucuaaugacucaccucuagaaggucuaguuuacuacugggagacacacucaaaaaaacaugacuauaagaagcaagagucucagagaugcagaguuggagauucagauaagaaaaugauaacuaaugucacaauaaucucucugauuucugaaauacaaaaaagcaucucugaguugucacuaucaugugguaaugaugacaauucuacuggacaagucuuaacauucaauggauuggaagacacaauacgaggugauuacauuguagacugcgugacuggcuuguaucagucagauauuggagucggugugggguuagggaggacucaccaugaucaucagcaagugaaaaacaaagcaguugugauagaugaaaaagaaagaaugauaucacuccuagagacucaacaaagugagaacgacauaaagaugcaaguacuaaugucugagauugaacaacugaagaaucaacugucaaagaagcgaaacgagagaggccaggagaaaagagaugcugagaaggugaugucagacuugauggccaggaauucugacuuacggaagcauaaugauauucucaccgcugaaauaucucagaugaaauauaauaacacaauccaaagaaacaaaaauauaaugaguacuacuguagucccagcaauacuuucaguggccuuacugucaucaucaguugcucccauuauggcugcgccuccagacucaccgaugauuaauccauggccucaugcaaaaaauagaguuggaacagggauguacaaauaugaugauaaugaugacucaggcuguagaccaaucagauauggaguuucaugcauaggauuugacuuuaugcucaagauggacaaauacccuuucuuuaaugcauucauaggccauaaaacucccuuagaaucauuugcugauaaaauaauugagaaagaagaagagacaugugagauagggacaaacaaagaguuuaaauguuuugaggagagagcuuacauaaaggggacauguccgacuaacaucaaugcaguccauuacauugacaauaaaggcaaauugcgauaugugaaauguaaggaaaaucuggagaugacugaggauugugcuuucuguaggaaaaucaagaagaaagcuggucagucuguucaggugcagaaaacuucaguuccacuucaagaugcaauuugucaagagaauucagacacuuauucuggaccaaagauacccuuuaaaggggucugcaagauugguuuaaucaaauauaaagaaugcaaguuuaaaacgucuucuuaugagacugucucauucauaacacucaaggagaaagggaagauuuauauugagcaccuaaugcugaaaaauauagagguaguuacgaaugucucuuuuguuugcuacgaacaugcaggucaggaugagcaagagguagaacacagggcucugaagagagugucaguuaaugauuguaagauuguggacagcuccaagcagaaaauuugcacaggagaucacguuuucugugaaaaguaugauuguucgacaucuuauccagauguuacuuguauccaugcgccaggaucaggaccauuguacauaaaucucaugggcucauggauaaaaccccaaugugugggcuacgagagagucuuaguagacagggaagucaagcagccauugcuugcaccagaacagaacugugacaccuguguuucggagugucuagaugaggggguccauauaaaguccacuggcuuugagauaacaucagcaguagccugcucacaugggucuugcaucucagcucaucaagaagcguccacaucaguaauugucccauacccaggauuauuggccagugugggcggaagaauugggauucaccucucacauacuucugauucugcuagugugcacaugguggugguuugcccuccuagagacaguugugcagcucauaauugcuuacuaugcuaucaugguauccuaaauuaucagugccauucaacauuaagugccauccugacuuccuuucuauuaauucucuucauauauacuguuuuuucugugacgacaaauauguuauaugugcucagacuaauaccaaaacaacuaaagaguccagugggauggcucaaacucuucauuaacuggcugcuaacugcucuaagaaucaaaacuagaaauguuauggggaggauaaaccagagaauaggauggguugaccaucaugauguagagagaccaaggcacagagaaccuaugagaagauucaaaacaacucuauuguugacucugauaaugaugacuggagggaaugcuugcuccaauacaguaguagcuaauucaaagcaaaccagauguguacaggaaggaucaaacacaaagugcucaaucacugcaacuauaacuuuaagagcaggugugauuggugcagagucauguuuuauaguaaaaggcccuauggagaaucagcagaagacaauaucaaucaaaaccaucucuagugagacaguuugcagggaggggucaagcuucuggacuaguuuauauaucccaucaugucuuagcucuaggaggugccaucuuguuggugauuguguaggcaauaaaugccagucguggagagaugaucaacuaucuagggaauuuucaggaguaaaggauaaccauauuaugaacgaaaauaaaugcuuugaacaguguggcgcaauugguugugguugcuuuaacauuaauccuuccugcuuguauguucaugcuuaccucaagagugcuagaaaugaagcaguuaggguuuucucauguucugauuggguacacagaguuucuuuugagguaaaagguccugauggugaaacagagcuggucacauugggaagccuaggcacuaaguuuuuaaacuggggcacccugucuuuaucccuggaugcagaaggcaucagcggaaccaacagcaucagcuuucuagaaaguaguaaaggaggauuugccuuauaugaugaaggcuacagcgagauaccaagagagggauuucuuggugagauaagguguaguucugaauccgcagcuauaucagcucacaagucuuguauuagagcuccugguuuaaucaaguacaagcccaugacagaucaaauagaauguacugcaucuuuaguggauccauucgcaauuuuccuuaaagggucucuuccucagacuagaaaugggcaaacauucaccagcacaaaagacaagaagacaguccaggcuuucacuaauggagcgauuaaagcacuauugucuauuaauuuagaugaucaugaaauuguauuuauuaacaaagugauaagcugugaugcaacauuucuaaauguuagugguugcuacuccugugauuauggagcucaugucugugugaaagucaaaucuucagagucagcugauuucuuugcagaaucagaagacaagacaacaguuuuaucuuucccaauacagucuggcacccaugauuacugucagguuuuacauuuucaaaaaccauuaguagaugaaagacuaucauauucuuguggaucugagccuaagcugauagugaucaagggaacauugguuuacaugggugucuaugauuucagaaacaaaacaggugguucuucaacaguaguaaauccuucagaaggugccuggagcauuucaaauugguuuucuggccuucuagacugguuaggugggccuaugaaggccauacuaaagauucugggcuuuauugccauugggauugucugcuucauuuuauucaugauucugaucagaauugcagucaacucaauaaacaucaagaagaaaaacuag

SEQ ID NO: 4333 - RNA, 3942 nt, Artificial Sequence
  derived and/or modified CDS sequence (wt) from PTV(Balliet)__KP272023.1__GP
augauuuuuacaauuuuaaauguuuuaacaagagccaugcucguaaugagcauguauucuuuaacuacgugggacagcaccagcagaaaugacaugugcuuuucuaaugacucaccucuagaaggccuaguuuacuacugggagacacacucaaaaaagcaugacuauaagaagcaaaagucucagagaugcagaguuggagauucagacaaaaaaaugauaacuaaugucacaauaaucucucugauuucugaaauacaaaaaagcaucucugaguugucacuaucauguggcaaugaugacaauucuacuggacaagucuuaacauucaauggauuagaagacacaauacgaggugauuacauuguagacugcgugacuggcuuguaucagucagauauuggagucgguguggggcuagggaggacucaccauggucaucagcaaaugaaaaacaaagcaguuguaauagaugagaaagaaaggaugauauuacuccuagagacucaacaaagugagaaugacauaaagaugcaaguacuaaugucugaaauugaacaacugaagaaucaacugucaaagaagcgaaaugagagaggccaggagaaaagagaugcugagaaggugaugucagacuugauggccaggaauucugacuuacggaagcauaaugacauucucacugcugaaauaucucagaugaaaaauaaaaacacaauccaaagaaauaaaaauacagugaguacuacuguagucccagcaauacuaucaguggccuuacugucaucaucaguugcucccauuauagcugcaccuccagauucaccgaugauuaauccauggccucaugcaaaaaauagaguuggcacaggaauguacaaauaugaugaaaaugaugacucaggcuguagaccaauaagauauggaguuucaugcauaggauuugacuuuaugcucaagauggacaaauacccuuucuuuaaugcauucauaggucacaaaacucccuuagaaucuuuugcugauaaaauaauugagaaagaagaagaaacaugugagauaggaacaaacaaagaguuuaaauguuucgaggagagagcuuauauaaaggggacauguccgaccaacaucaaugcaguccauuacauugacaauaaaggcaaauugcgauauguaaaauguaaggaaaaucuggaaaugacugaggauugugcuuucuguaggaaaaucaagaagaaagcuggucagucuguucaggugcagaaaacuucaguuccacuccaggaugcaauuugucaagaaaauucagacacuuauucuggaccaaagauacccuuuaaagggguuugcaaaauuggucuaaucaaauauaaagaaugcaaguuuaaaacaucuucuuaugagacugucucauucauaacacucaaggagaaggggaagauuuacauugagcaccuaauguugaaaaauauagaggugguuacgaaugucucuuuuguuugcuacgaacaugcagggcaggaugagcaagagguggaacauaaggcucugaagagaguaucaguuaaugauuguaagauuguggacaacucaaagcagaaaauuugcacaggagaucacguuuucugugaaaaguaugauuguuccacauccuauccagauguuacuuguauccaugcgccaggaucaggaccacuguacauaaaucucaugggcucauggauaaaaccccaaugugugggcuaugagagagucuuaguagacagggaagucaagcagccauugcuugcaccagaacagaacugugacaccuguguuucagagugucuagaugaggggguccauauaaaguccacugguuuugagauaacaucagcaguagccugcucacaugggucuugcaucucagcucaucaagagccauccacaucaguaauugucccauacccaggauuguuggccagugugggcggaagaauugggauucaccucucacauacuucugauucugcuagugugcacaugguagugguuugcccuccuagagacaguugugcagcucauaauugcuugcuaugcuaucauggcauccuaaauuaucagugccauucaacauuaagugccauccugacuuccuuucuauuaauucucuucauauacacugucuuuucugugacgacaaauauauuauaugugcucagacuaauaccaaaacagcuaaagaguccagugggauggcucaagcucuucaucaacuggcugcuaacugcucuaagaaucaaaacuagaaauguuauggggaggauaaaccagagaauaggauggguugaccaucaugauguagagagaccaaggcacagagaaccuaugagaagauucaaaacaacucuauuguugacucugauaaugaugacuggaggaaaugcuugcuccaauacaguaguggcuaacucaaagcaaaccagauguguacaggaaggaucaaacacaaagugcucaaucacugcaacuauaacuuuaagggcaggugugauuggugcagagucgugcuuuauaauaaaaggcccuauggagaaucagcagaaaacaauaucaaucaaaacuaucuccagugagacaguaugcagagagggaucaagcuucuggacuaguuuauauaucccaucaugucuuagcucuaggaggugucaucuuguuggugauuguguaggcaauaaaugccagucguggagagaugaucagcuaucuagggaauuuucaggaguaaaggauaaccauaucaugaacgaaaauaaaugcuuugaacaauguggcgcaauugguugugguuguuuuaacauuaauccuuccugcuuguacguucaugcuuaccucaaaagugcuagaaaugaagcaguuaggguuuucucauguucugauugggugcacagaguuucuuuugagguaaaagguccugauggugaaacagagcuggucacauugggaagucuaggcaccaaguuuuuaaacuggggcacccugucauuaucccuggaugcagaaggcaucagcggaaccaacagcaucagcuuucuggaaaguaguaaaggaggauuugccuuauacgaugaaggcuacaaugagauaccaagagagggauuucuaggugagauaagguguaguucugaauccgcagcuauaucagcucauaagucuuguauuagagcuccugguuuaaucaaguacaagccuaugacagaucaaauagaauguacugcaucuuuaguggauccauucgcaauuuuccuuaaaggaucucuuccucagacuagaaauggacaaacauucaccagcacaaaagacaagaagacaguucaggcuuucacuaauggagcgauaaaagcgcuauugucuauuaauuuagaugaucaugaaauugucuuuauuaacaaagugaaaaacugugaugcaacauuucuaaauguuagugguugcuacuccugugauuauggagcucaugucugugugaaaguuaaaucuucagagucagcugauuucuuugcagaaucagaagacaagacaacaguuuuaucuuucccaauacagucuggcacccaugauuacugucagguuuuacauuuucaaaaaccauuaguagaugaaagacuaucauauucuuguggaucagagccuaagcugauagugaucaagggaacauugguuuacaugggugucuaugauuucagaaacaaaacagguggcucuucaacaguaguaaacccuucagaaggugccuggagcauuucaaauugguuuucuggccuucuagacugguuaggugggccuaugaaggccauacuaaagauuuugggcuuuauugccauugggauugucugcuuuguuuuauucaugauucugaucagaauugcagucaacucaauaaauaucaagaagaaaaacuag

SEQ ID NO: 4334 - RNA, 3942 nt, Artificial Sequence
  derived and/or modified CDS sequence (wt) from PTV(Adames)__KP272029.1__GP
augauuuuuacaauuuuaaauguuuuaacaagagccaugcucguuaugagcauguacucuuuaacaacgugggacagcuccaguaggaaugacauauguuuuucuaacgacucaccucuagagggccuugucuacuacugggagacacacucaaaaaaacaugacuauaagaaacaagguucucagaaguguagaguuggagauucugauaaaaagaugauuucuaauguuacaauaaucucucuaauuucugaaauacaaaaaagcaucucugagcuaucacugucaugugguaauaaugacaauucuacuggacaagucuugacauucaauggauuagaagauacaauacgaggcgacuacauuguggacugugugacuggauuauaccagucagacauuggagucgguguagggcuggggagaaucaaccaugaucaucagcaaguaaaaaauaaagcaguuguuauagaugagaaagaaaaaaugauaucacuucuagagacucaacaaagugagaaugacauaaagacacaaguacugaugucugaaauugaacaacugaagaaucaacuaucaaaaagacgaaaugagaggggacaggagaagagagaugcugaaaagcugaugucagaccugauggcuagaaauucugacuuacggaaucacaauguuauucuaacugacgaaauaucucaaauaaaaaauaauaucacaauucacagaaacagaaacaugaugaguacuacuguggucccagcaauacuuucgguggcucugcuaucaucaucaguuggucccauuacggcugcaccuccagauucaacuaugaucaauccauggccucaugcaaaaaauagaguuggcacaggaauguacaaauaugaugaaaaugaugagucaggguguagaccaaucagauaugguguuuccugcauaggauuugauuucaugcuuaagauggauaaguauccuuucuuuaaugcauuuauaggucauaaaacuccuuuagaauccuucgcagauaaaauaauugagaaagaagaagagacaugugaaauaggaacaaacaaagaguuuaaauguuuugaggagagagcuuacauaaaggggacauguccgaccaacaucaaugcaguucauuacauugacaauaaaggcaaguugcgauauguaaaaugcaaagagaaucuggaaaugacugaagacugugcuuucugcaggaaaaucaagaagaaagcuggucagucuguucaggugcagaaaacuucaguaccguuacaagaugcaauuugucaagagaacucagacauuuacuccggaccaaagauaccuuucaagggaguuuguaagaucggucuaauaaaguauaaagaguguaaguuuaaaacaucaucuuaugagaccauuucauucaucacacucaaagggaaaggaaaaauuuacauugagcacuugauguuaaaaaacauagagguggucacaaauguuucuuuuguuugcuaugaacaugcaggucaagaugaacaagagguagaacacagggcccugaagagaguaucagucaaugauuguaagauuguggacaacucuaagcagaagauuugcacaggagaccacauuuucugugagaaguaugacuguucuacaucuuauccagaugugacuuguauccacacaccaggaucagggccauuauacauaaaucucaugggcucauggauaaaaccccaauguguuggcuacgagagagucuuaguagauagggagguuaagcagccauugcuuguaccagagcagaacugugacaccuguguuucagagugucuagaugaaggaguacacauaaaauccacugguuuugaaauaacaucagcaguggccugcucacauggauccuguaucucagcucaucaggaagcauccacaucaguaauuauuccauauccaggcuuguuggcuagugugggcgggagaauugggauacaccucucacauacuucugauucugcuaguguacacaugguagugguuugcccucccagagauaguugugcagcucauaauugcuuacuaugcuaucauggcauucugaacuaucagugccauucaacacugagugcuauccugacuuccuuucuacuaauucuuuucauauacacugcuuuuucugugacaacaaauguuuuguaugugcucagacuaauaccgaaacagcugaaaaguccagugggauggcucaaacucuuugucaacuggcuacuaacugcucuaagaaucaaaacuaggcgaguaauggggaggauaaaucagagaauaggguggguugaucaucaugauguagagagaccaaggcacagagaaccuaugaggagauucaagacaacucuauugcuaacucugauaauggugacaggaggaaaugccugcuccaauacaguaguggccaauucgaagcaaaccagauguguccaagaaggaucaaacacaaaguguucuauuacugcaacuauaacuuuaagggcaggugugauuggugcugagucauguuucauaauaaaaggccccauggaaaaccagcagaaaacaauaucaauuaaaaccaucucuagugagacaguaugcagagaagguucgaguuucuggaccaguuuguacaucccaucuugucuuaguucuaggagaugucaucuuguuggugauuguguggguaacaaaugccagucauggcgagaugaucagcuauccagggaguuuucaggaguaaaggauaaccauauuaugaaugaaaauaaaugcuuugaacaauguggugcaauuggcugugguuguuucaacaucaauccuuccugcuuguauguccaugcuuaucucaagagugcuagaaaugaagcagucaggguauucucauguucugacugggugcacagaguuuccuuugaggucaaaggcccugauggcgagauggaguuggucacacuagggagccugggcacuaaguuuuuaaacuggggcacuuugucauuauccuuggaugcagaagguaucagcggaaccaacaguaucaguuuuuuggaaaguaguaaaggaggguuugcucuguacgaugaaggauauagugaaauaccaagagaaggauuucuuggagagauaaggugcaguucugaauccgcagccauaucagcucauaagucaugcauuagagcuccugguuugaucaaguacaagcccaugacagaucaaauagaauguacugcaucuuuaguagauccauuugcaauuuuccucaaaggaucucuuccucagacuaggaauggacagacauucaccaguacaaaagacaaaaaaacaguacaggccuucaccaauggagcaauaaaagcauuauugucgauuaauuuagaugaucaugaaaucaucuuuauuaauaaagugaaaagcugugaugccacauuuuuaaauguuaguggaugcuacucuugugauuauggagcacaugucugugugaaaguaaagucuucggagucagccgacuucuuugcagaaucggaggacaaaacaacaguccugucuuuuccaauacaaucuggcacacgugacuacugucagguuuuacauuuucaaaagccauuaguagaugaaagacuuucauauucuuguggaucugagccuaagcugauagugauuaagggaacauuaguuuacaugggugucuaugauuuuaggaauaaaacaggugguucuucaacagugauaaauccuucagaaggaaccuggagcaucuccaauugguuuucugggcuucuggacuggcuaggugggccuaugaaggccauacugaagauacugggcuucauugcuauugggauuguuugcuucauuuuguucaugauucugauuagaauugcagucaacucaauaaauaucaagaagaaaaacuaa

SEQ ID NO: 4335 - RNA, 3942 nt, Artificial Sequence
  derived and/or modified CDS sequence (wt) from PTV(GML488831)__KP272032.1__GP
augauuuuuacaauuuuaaauguuuuaacaagagcuaugcucguaaugagcauguauucuuuaacuacgugggauagcaccagcagaaaugacauguguuuuucuaaugacucaccucuagaaggccuaguuuacuacugggagacacacucaaaaaaacaugacuauaagaagcaagagucucagagaugcagaguuggagauucagauaaaaagaugauaacuaaugucacaauaaucucucugauuucugaaauacagaaaaguaucucugaguugucacuaucaugugguaaugaugacaauucuacuggacaagucuuaacauucaauggauuggaagacacaauacgaggugauuacauuguagacugcgugacuggcuuguaucagucagauauuggggucggugugggguuagggagggcucaccaugaucaucagcaagugaaaaacaaagcaguugugauagaugaaaaagaaagaaugauaucacuccuagagacucaacaaagugagaacgauauaaaaaugcaaguacuaaugucugaaauugaacaacuaaagaaucaacugucaaagaagcgaaaugagagaggccaggagaagagagaugcugagaaagugaugucagacuugauggccaggaauucugacuuacggaagcauaaugauauucucacugcugaaauaucucagaugaaauauaauaacacaauccaaagaagcaaaaauguaaugaguacuacuguagucccagcaauacuuucaguggccuuacugucaucaucaguugcucccauuauggcugcgccuccagauucaccgaugauuaauccauggccucaugcaaaaaauagaguuggaacagggauguacaaauaugaugauaaugaugacucaggcuguagaccaaucagauauggaguuucaugcauaggauuugacuuuaugcucaagauggacaaauacccuuucuuuaaugcauuuauaggccauaaaacucccuuagaaucauuugcugauaaaauaauugagaaagaagaagaaacaugugagauagggacaaacaaagaguuuaaauguuucgaggagagagcuuacauaaaggggacauguccgacuaacaucaaugcaguccauuacauugacaauaaaggcaaacugcgauaugugaaauguaaggaaaaucuggagaugacugaggauugugcuuucuguaggaaaaucaagaagaaagcuggucagucuguucaggugcagaaaacuucagucucacuucaagaugcaaucugucaagaaaauucagacaauuauucuggaccaaagauacccuuuaaagggguuugcaagauuggucuaaucaaauauaaagagugcaaguuuaaaacgucuucuuaugagacugucucauucauaacacucaaggagaaagggaagauuuauauugagcaccuaauguugaaaaauauagagguaguuacgaaugucucuuuuguuugcuacgaacaugcaggucaggaugagcaagagguagaacacagggcucugaagaggguaucaguuaaugauuguaagauuguggacaacuccaagcagaaaauuugcacaggagaucacguuuucugugaaaaguaugauuguucgacaucuuauccagauguuacuuguauccaugcgccaggaucaggaccauuguacauaaaucucaugggcucauggauaaaaccccaaugugugggcuacgagagagucuuaguagacagggaaguuaagcagccauugcuugcaccagaacagaacugugacaccuguguuucagagugucuagaugaggggguucauauaaaguccacuggauuugagauaacaucagcaguagccugcucacaugggucuugcauuucagcucaucaagaggcguccacaucaguaauugucccauacccaggauuauuggccaguguaggcggaagaauugggauccaccucucacauacuucugauucugcuagugugcacaugguagugguuugcccuccuagagacaguugugcagcucacaauugcuuacuaugcuaucaugguauccuaaauuaucagugccauucaacauuaagugccauccugacuuccuuucuauuaauucucuucauauauacuguuuuuucugugacgacaaauauguuauaugugcucaggcuaauaccaaaacagcuaaagaguccagugggauggcucaaacucuucaucaacuggcugcuaacugcucuaagaaucaaaacuagaaauguuauggggaggauaaaccagagaauaggaugggucgaccaucaugauguagagagaccaaggcacagagaaccaaugagaagauucaaaacaacucuauuguuaacucugauaaugaugacuggagggaaugcuugcuccaauacaguaguagcuaauucaaagcaaaccagauguguacaggaaggaucaaacacaaagugcucaaucacugcaacuauaacuuuaagggcaggugugauuggugcagagucauguuuuauaauaaaaggcccuauggagaaucagcagaagacaauaucaaucaaaaccaucuccagugagacaguaugcagggagggaucaagcuucuggacuaguuuauauaucccaucaugucuuagcucuaggaggugccaucuuguuggugauuguguaggcaauaaaugccagucguggagagaugaucaauuaucuagggaauuuucaggaguaaaagauaaccauauuaugaacgaaaauaaaugcuuugaacaguguggcgcaauugguugugguugcuuuaacauuaauccuuccugcuuguacguucaugcuuaccucaagagugcuagaaaugaagcaguuaggguuuuuucauguucugauuggguacacagaguuucuuuugagguaaaagguccugauggugaaacagagcuggucacauugggaagccuaggcacuaaguuuuuaaacuggggcacccugucuuuaucccuggaugcagaaggcaucagcggaaccaacagcaucagcuuucuggaaaguaguaaaggaggauuugccuuauaugaugaaggcuacagugagauaccaagagagggauuucuuggugagauaagguguaguucugaauccgcagcuauaucagcucacaagucuuguauuagagcuccugguuuaaucaaguacaagcccaugacagaucaaauagaauguacugcaucuuuaguggauccauucgcaauuuuccuuaaaggaucucuuccucagacuagaaaugggcaaacauucaccagcacaaaagacaagaaaacaguccaggcuuucacuaauggagcgauaaaagcacuauugucuauuaauuuagaugaucaugaaauugucuuuauuaacaaagugagaagcugugaugcaacauuucuaaauguuagugguugcuacuccugugauuauggagcucaugucugugugaaagucaaaucuucagagucagcugauuucuuugcagaaucagaagacaagacaacaguuuuaucuuucccaauacagucuggcacccaugauuacugucagguuuuacauuuucaaaaaccguuaguagaugaaagacuaucauauucuuguggaucugagccuaagcugauagugaucaagggaacauugguuuacauaggugucuaugauuucagaaacaaaacaggugguucuucaacaguaguaaauccuucagaaggugccuggagcauuucaaauugguuuucuggccuucuagacugguuaggugggccuaugaaggccauacuaaagauucugggcuuuauugccauugggauugucugcuuuauuuuauucaugauucuaaucagaauugcagucaacucaauaaacaucaaaaagaaaaacuag

SEQ ID NO: 4336 - RNA, 3942 nt, Artificial Sequence
  derived and/or modified CDS sequence (wt) from PTV(GML488778)__KP272038.1__GP
augauuuuuacaauuuuaaauguuuuaauaagagcuaugcucguaaugagcauguauucuuuaacuacgugggauagcaccagcaggaaugacaugugcuuuucuaaugacucaccucuagaaggccuaguuuacuacugggagacacacucaaaaaaacaugacuauaagaagcaagagucucagagaugcagaguuggagauucagacaaaaaaaugauaacuaaugucacaauaaucucucugauuucugaaauacaaaaaaguaucucugaguugucacuaucaugugguaaugaugacaauucuacuggacaagucuuaacauucaauggauuggaagacacaauacgaggugauuacauuguagacugcgugacuggcuuguaucagucagauaucggagucggugugggguuagggaggacucaccaugaucaucaacaagugaaaaacaaagcaguugugauagaugaaaaagaaagaaugauaucacuccuagagacucaacaaagcgagaacgacauaaagaugcaaguacuaaugucugaaauugaacaacugaagaaucaacugucaaagaagcgaaaugagagaggccaggagaaaagagaugcugagaaggugaugucagacuugauggccaggaauucugacuuacggaagcauaaugguauucucacugcugaaauaucucagaugaaauauaauaacacaguccaaagaagcaaaaauguaaugaguacuacuguagucccagcaauacuuucaguggccuuacugucaucaucaguugcucccauuauggcugcgccuccagauucaccgaugauuaauccauggccucaugcaaaaaauagaguuggaacagggauguacaaauaugaugauaaugaugacucaggcuguagaccaaucagauauggaguuucaugcauaggauuugacuuuaugcucaagauggacaaauacccuuucuuuaaugcauucauaggccauaaaacucccuuagaaucauuugcugauaaaauaauugagaaagaagaagaaacaugugagauagggacaaacaaagaguuuaaauguuucgaggagagagcuuacauaaaggggacauguccgacuaacaucaaugcaguccauuacauugacaauaaaggcaaauugcgauaugugaaauguaaggaaaaucuggagaugacugaggauugugcuuucuguaggaaaaucaagaagaaagcuggucagucuguucaggugcagaaaacuucagucucacuucaagaugcaauuugucaagaaaauucagacaauuauucuggaccaaagauacccuuuaaagggguuugcaagauuggucuaaucaaauauaaagagugcaaguucaaaacgucuucuuaugagacugucucauucauaacacucaaggagaaagggaagauuuauauugaacaccuaauguugaaaaauauagagguaguuacgaaugucucuuuuguuugcuacgaacaugcaggucaggaugagcaagagguagaacacagggcuuugaagaggguaucaguuaaugauuguaagauuguggacagcuccaagcagaaaauuugcacaggagaucacguuuucugugaaaaguuugauuguucgacaucuuauccagauguuacuuguauccaugcgccaggaucaggaccauuguacauaaaucucaugggcucauggauaaaaccccaaugugugggcuacgagagagucuuaguagacagggaagucaagcagccauugcuugcaccagaacagaacugugacaccuguguuucagagugucuagaugaggggguucauauaaaguccacuggcuuugagauaacaucagcaguagccugcucacaugggucuugcauuucagcucaucaagaggcguccacaucaguaauugucccauacccaggauuauuggccagugugggcggaagaauugggauucaccucucacauacuucugauucugcuagugugcacaugguagugguuugcccuccuagagacaguugugcagcucacaauugcuuacuaugcuaucaugguauccuaaauuaucagugccauucaacauuaagugccauccugacuuccuuucuauuaauucucuucauauauacuguuuuuucugugacaacaaauauguuauaugugcucagacuaauaccaaaacagcuaaagaguccagugggauggcucaaacucuucaucaacuggcugcuaacugcucuaagaaucaaaacuagaaauguuauggggaggauaaaccagagaauaggauggguugaccaucaugauguugagaggccaaggcacagagaacccaugagaagauucaaaacaacucuauuguuaacucugauaaugaugacuggagggaaugcuugcuccaauacaguaguagcuaauucaaagcaaaccagauguguacaggaaggaucaaacacaaagugcucaaucacugcaacuauaacuuuaagggcaggcgugauuggugcagagucauguuuuauaauaaaaagcccuauggagaaucagcagaagacaauaucaaucaaaaccaucuccagugagacaguaugcagggagggaucaagcuucuggacuaguuuauauaucccaucaugucuuagcucuaggaggugccaucuuguuggugauuguguaggcaauaaaugccagucguggagagaugaucaacuaucuagggaauuuucaggaguaaaggauaaccauauuaugaacgaaaauaaaugcuuugaacaguguggcgcaauugguugugguugcuuuaacauuaauccuuccugcuuguacguucaugcuuaccucaagagugcuagaaaugaagcaguuaggguuuucucauguucugauuggguacacagaguuucuuuugaagugaaagguccugauggugaaacagagcuggucacauugggaagccuaggcacuaaguuuuuaaacuggggcacccugucuuuaucccuggaugcagaaggcaucagcggaaccaacagcaucagcuuucuggaaaguaguaaaggaggauuugccuuauaugaugaaggcuacagugagauaccaagagagggauuucuuggugagauaagguguaguucugaauccgcagcuauaucagcucacaagucuuguauuagagcuccugguuuaaucaaguacaagcccaugacagaucaaauagaauguacugcaucuuuaguggauccauucgcaauuuuccuuaaaggaucucuuccucagacuagaaaugggcaaacauucaccagcacaaaagacaagaagacaguccaggcuuucacuaauggagcgauaaaagcacuauugucuauuaauuuggaugaucaugaaauuaucuuuauuaacaaagugagaagcugugaugcaacauuucuaaaugucagugguugcuacuccugugauuauggagcucaugucugugugaaagucaaaucuucagagucagcugauuucuuugcagaaucagaagacaagacaacaguuuuaucuuucccaauacagucuggcacccaugauuacugucagguuuuacauuuucaaaaaccauuaguagaugaaagacuaucauauucuuguggaucugagccuaagcugauagugaucaagggaacacugguuuacaugggugucuaugauuucagaaacaaaacaggugguucuucaacaguaguaaauccuucagaaggugcuuggagcauuucaaauugguuuucuggccuucuagacugguuaggugggccuaugaaggccauaauaaagauucugggcuuuauugccauugggguugucugcuucauuuuauucaugauucugaucagaauugcagucaacucaauaaacaucaagaagaaaaacuag

SEQ ID NO: 4337 - RNA, 3945 nt, Artificial Sequence
  derived and/or modified CDS sequence (wt) from PTV(Adames)__DQ363407.1__GP
augauuuuuacaauuuuaaauguuuuaacaagagccaugcucguuaugagcauguacucuuuaacaacgugggacagcuccaguaggaaugacauauguuuuucuaacgacucaccucuagagggccuugucuacuacugggagacacacucaaaaaaacaugacuauaagaaacaagguucucagaaguguagaguuggagauucugauaaaaagaugauuucuaauguuacaauaaucucucuaauuucugaaauacaaaaaagcaucucugagcuaucacugucaugugguaauaaugacaauucuacuggacaagucuugacauucaauggauuagaagauacaauacgaggcgacuacauuguggacugugugacuggauuauaccagucagacauuggagucgguguagggcuggggagaaucaaccaugaucaucagcaaguaaaaaauaaagcaguuguuauagaugagaaagaaaaaaugauaucacuucuagagacucaacaaagugagaaugacauaaagacacaaguacugaugucugaaauugaacaacugaagaaucaacuaucaaaaagacgaaaugagaggggacaggagaagagagaugcugaaaagcugaugucagaccugauggcuagaaauucugacuuacggaaucacaauguuauucuaacugacgaaauaucucaaauaaaaaauaauaucacaauucacagaaacagaaacaugaugaguacuacuguggucccagcaauacuuucgguggcucugcuaucaucaucaguuggucccauuacggcugcaccuccagauucaacuaugaucaauccauggccucaugcaaaaaauagaguuggcacaggaauguacaaauaugaugaaaaugaugagucaggguguagaccaaucagauaugguguuuccugcauaggauuugauuucaugcuuaagauggauaaguauccuuucuuuaaugcauuuauaggucauaaaacuccuuuagaauccuucgcagauaaaauaauugagaaagaagaagagacaugugaaauaggaacaaacaaagaguuuaaauguuuugaggagagagcuuacauaaaggggacauguccgaccaacaucaaugcaguucauuacauugacaauaaaggcaaguugcgauauguaaaaugcaaagagaaucuggaaaugacugaagacugugcuuucugcaggaaaaucaagaagaaagcuggucagucuguucaggugcagaaaacuucaguaccguuacaagaugcaauuugucaagagaacucagacauuuacuccggaccaaagauaccuuucaagggaguuuguaagaucggucuaauaaaguauaaagaguguaaguuuaaaacaucaucuuaugagaccauuucauucaucacacucaaagggaaaggaaaaauuuacauugagcacuugauguuaaaaaacauagagguggucacaaauguuucuuuuguuugcuaugaacaugcaggucaagaugaugaacaagagguagaacacagggcccugaagagaguaucagucaaugauuguaagauuguggacaacucuaagcagaagauuugcacaggagaccacauuuucugugagaaguaugacuguucuacaucuuauccagaugugacuuguauccacacaccaggaucagggccauuauacauaaaucucaugggcucauggauaaaaccccaauguguuggcuacgagagagucuuaguagauagggagguuaagcagccauugcuuguaccagagcagaacugugacaccuguguuucagagugucuagaugaaggaguacacauaaaauccacugguuuugaaauaacaucagcaguggccugcucacauggauccuguaucucagcucaucaggaagcauccacaucaguaauuauuccauauccaggcuuguuggcuagugugggcgggagaauugggauacaccucucacauacuucugauucugcuaguguacacaugguagugguuugcccucccagagauaguugugcagcucauaauugcuuacuaugcuaucauggcauucugaacuaucagugccauucaacacugagugcuauccugacuuccuuucuacuaauucuuuucauauacacugcuuuuucugugacaacaaauguuuuguaugugcucagacuaauaccgaaacagcugaaaaguccagugggauggcucaaacucuuugucaacuggcuacuaacugcucuaagaaucaaaacuaggcgaguaauggggaggauaaaucagagaauaggguggguugaucaucaugauguagagagaccaaggcacagagaaccuaugaggagauucaagacaacucuauugcuaacucugauaauggugacaggaggaaaugccugcuccaauacaguaguggccaauucgaagcaaaccagauguguccaagaaggaucaaacacaaaguguucuauuacugcaacuauaacuuuaagggcaggugugauuggugcugagucauguuucauaauaaaaggccccauggaaaaccagcagaaaacaauaucaauuaaaaccaucucuagugagacaguaugcagagaagguucgaguuucuggaccaguuuguacaucccaucuugucuuaguucuaggagaugucaucuuguuggugauuguguggguaacaaaugccagucauggcgagaugaucagcuauccagggaguuuucaggaguaaaggauaaccauauuaugaaugaaaauaaaugcuuugaacaauguggugcaauuggcugugguuguuucaacaucaauccuuccugcuuguauguccaugcuuaucucaagagugcuagaaaugaagcagucaggguauucucauguucugacugggugcacagaguuuccuuugaggucaaaggcccugauggcgagauggaguuggucacacuagggagccugggcacuaaguuuuuaaacuggggcacuuugucauuauccuuggaugcagaagguaucagcggaaccaacaguaucaguuuuuuggaaaguaguaaaggaggguuugcucuguacgaugaaggauauagugaaauaccaagagaaggauuucuuggagagauaaggugcaguucugaauccgcagccauaucagcucauaagucaugcauuagagcuccugguuugaucaaguacaagcccaugacagaucaaauagaauguacugcaucuuuaguagauccauuugcaauuuuccucaaaggaucucuuccucagacuaggaauggacagacauucaccaguacaaaagacaaaaaaacaguacaggccuucaccaauggagcaauaaaagcauuauugucgauuaauuuagaugaucaugaaaucaucuuuauuaauaaagugaaaagcugugaugccacauuuuuaaauguuaguggaugcuacucuugugauuauggagcacaugucugugugaaaguaaagucuucggagucagccgacuucuuugcagaaucggaggacaaaacaacaguccugucuuuuccaauacaaucuggcacacgugacuacugucagguuuuacauuuucaaaagccauuaguagaugaaagacuuucauauucuuguggaucugagccuaagcugauagugauuaagggaacauuaguuuacaugggugucuaugauuuuagggauaaaacaggugguucuucaacagugauaaauccuucagaaggaaccuggagcaucuccaauugguuuucugggcuucuggacuggcuaggugggccuaugaaggccauacugaagauacugggcuucauugcuauugggauuguuugcuucauuuuguucaugauucugauuagaauugcagucaacucaauaaauaucaagaagaaaaacuaa

SEQ ID NO: 4338 - RNA, 3942 nt, Artificial Sequence
  derived and/or modified CDS sequence (wt) from PTV__M11156.1__GP
augauuuuuacaauuuuaaauguuuuaacaagagccaugcucguaaugagcauguauucuuuaacuacgugggacagcaccagcagaaaugacaugugcuuuucuaaugacucaccucuagaaggccuaguuuacuacugggagacacacucaaaaaggcaugacuauaagaagcaagagucucagagaugcagaguuggagauucagacaaaaaaaugauaacuaaugucacaauaaucucucugauuucugaaauacaaaaaagcaucucugaguugucacuaucaugugucaaugaugacaauucuacuggacaagucuuaacauucaauggauuagaagacacaauacgaggugauuacauuguagacugcgugacuggcuuguaucagucagauauuggagucgguguggggcuagggaggacucaccauggucaucagcaaaugaaaaacaaagcaguuguaauagaugagaaagaaaggaugauaucacuccuagagacucaacaaagugagaaugacauaaagaugcaaguacuaaugucugaaauugaacaacugaagaaucaacugucaaagaagcgaaaugagagaggccaggagaaaagagaugcugagaaggugaugucagacuugauggccaggaauucugacuuacggaagcauaaugacauucucacugcugaaauaucucagaugaaaaauaaaaacacaauccaaagaaauaaaaauacagugaguacuacuguagucccagcaauacuaucaguggccuuacugucaucaucaguugcucccauuauagcugcaccuccagauucaccgaugauuaauccauggccucaugcaaaaaauagaguuggcacaggaauguacaaauaugaugaaaaugaugacucaggcuguagaccaauaagauauggaguuucaugcauaggauuugacuuuaugcucaagauggacaaauacccuuucuuuaaugcauucauaggucacaaaacucccuuagaaucuuuugcugauaaaauaauugagaaagaagaagaaacaugugagauaggaacaaacaaagaguuuaaauguuucgaggagagagcuuauauaaaggggacauguccgaccaacaucaaugcaguccauuacauugacaauaaaggcaaauugcgauauguaaaauguaaggaaaaucuggaaaugacugaggauugugcuuucuguaggaaaaucaagaagaaagcuggucagucuguucaggugcagaaaacuucaguuccacuccaggaugcaauuugucaagaaaauucagacacuuauucuggaccaaagauacccuuuaaagggguuugcaaaauuggucuaaucaaauauaaagaaugcaaguuuaaaacaucuucuuaugagacugucucauucauaacacucaaggagaaggggaagauuuacauugagcaccuaauguugaaaaauauagaggugguuacgaaugucucuuuuguuugcuacgaacauguagggcaggaugagcaagagguggaacauagggcucugaagagaguaucaguuaaugauuguaagauuguggacaacucaaagcagaaaauuugcacaggagaucacguuuucugugaaaaguaugauuguuccacauccuauccagauguuacuuguauccaugcgccaggaucaggaccacuguacauaaaucucaugggcucauggauaaaaccccaaugugugggcuaugagagagucuuaguagacagggaagucaagcagccauugcuugcaccagaacagaacugugacaccuguguuucagagugucuagaugaggggguccauauaaaguccacugguuuugagauaacaucagcaguagccugcucacaugggucuugcaucucagcucaucaagagccauccacaucaguaauugucccauacccaggauuguuggccagugugggcggaagaauugggauucaccucucacauacuucugauucugcuagugugcacaugguagugguuugcccuccuagagacaguugugcagcucauaauugcuugcuaugcuaucauggcauccuaaauuaucagugccauucaacauuaagugccauccugacuuccuuucuauuaauucucuucauauacacugucuuuucugugacgacaaauauauuauaugugcucagacuaauaccaaaacagcuaaagaguccagugggauggcucaagcucuucaucaacuggcugcuaacugcucuaagaaucaaaacuagaaauguuaugaggaggauaaaccagagaauaggauggguugaccaucaugauguagagagaccaaggcacagagaaccuaugagaagauucaaaacaacucuauuguugacucugaucaugaugacuggaggaaaugcuugcuccaauacaguaguggcuaacucaaagcaaaccagauguguacaggaaggaucaaacacaaagugcucaaucacugcaacuauaacuuuaagggcaggugugauuggugcagagucgugcuuuauaauaaaaggcccuauggagaaucagcagaaaacaauaucaaucaaaacuaucuccagugagacaguaugcagagagggaucaagcuucuggacuaguuuauauaucccaucaugucuuagcucuaggaggugucaucuuguuggugauuguguaggcaauaaaugccagucguggagagaugaucagcuaucuagggaauuuucaggaguaaaggauaaccauaucaugaacgaaaauaaaugcuuugaacaauguggcgcaauugguugugguuguuuuaacauuaauccuuccugcuuguacguucaugcuuaccucaaaagugcuagaaaugaagcaguuaggguuuucucauguucugauugggugcacagaguuucuuuugagguaaaagguccugauggugaaacagagcuggucacauugggaaguccaggcaccaaguuuuuaaacuggggcacccugucauuaucccuggaugcagaaggcaucagcggaaccaacagcaucagcuuucuggaaaguaguaaaggaggauuugccuuauacgaugaaggcuacaaugagauaccaagagagggauuucuaggugagauaagguguaguucugaauccgcagcuauaucagcucauaagucuuguauuagagcuccugguuuaaucaaguacaagccuaugacagaucaaauagaauguacugcaucuuuaguggauccauucgcaauuuuccuuaaaggaucucuuccucagacuagaaauggacaaacauucaccagcacaaaagacaagaagacaguucaggcuuucacuaauggagcgauaaaagcgcuauugucuauuaauuuagaugaucaugaaauugucuuuauuaacaaagugaaaaacugugaugcaacauuucuaaauguuagugguugcuacuccugugauuauggagcucaugucugugugaaaguuaaaucuucagagucagcugauuucuuugcagaaucagaagacaagacaacaguuuuaucuuucccaauacagucuggcacccaugauuacugucagguuuuacauuuucaaaaaccauuaguagaugaaagacuaucauauucuuguggaucagagccuaagcugauagugaucaagggaacauugguuugcaugggugucuaugauuucagaaacaaaacagguggcucuucaacaguaguaaacccuucagaaggugccuggagcauuucaaauugguuuucuggccuucuagacugguuaggugggccuaugaaggccauacuaaagauuuugggcuuuauugccauugggauugucugcuuuguuuuauucaugauucugaucagaauugcagucaacucaauaaauaucaagaagaaaaacuag

SEQ ID NO: 4339 - RNA, 3852 nt, Artificial Sequence
  derived and/or modified CDS sequence (wt) from Phlebovirus(CoAr170255)__HM566149.1__GP
auguauaaacuuauaacaaauauuuuaaaacucucaguggugucugccauguacagcaucauguucugggacccaacugguauaucuaaacuuugccugagcaacaauucaccccuagagggucuuguuuauuacugggaaaacacuaugagagaaggcgaguucaaaagagaaaagaggaagaagugucguuuaggaauaucugagccagccccugucaguaaucagacaauaguaucucuuauugaggagguucaaaaaaguccugcugagaugauuuugauuugugaggcuaauggaaauaguacaggaagcucucuaucauuugauggucuuucugauaaugagauaaaaccuagcauuguugacugcacaacaggugauagaaccucugacuuacguguucuuguugggaaggguauauuugagaagaaaaugaguaugucuaaugagauugauaggguugugucacuagaagaucaucuacagagagaaaaggaauugguucaaacauuccaggaucugcaccauaaugaaucugaaaagaauaaacuauuagagcaugaguuagaaaauguccgucagcaguuaaagagggaaagagaaucuaacaagauuaagauguggaccacaaaaagaccagaaaucaccacaauugggcugacaacgacuauugcaacaauccucuuggcaucacaaucuguagccuccucaguccccaugccuggacaauuaaacacauggccacaugccaaaaauagaguggggggaggaguguucaaagcuaaugaugaugaugaggauaguuguaaacuaauugauuauggaauagcuugucaugguuuugacuaucuuuugagaacugacauuuauccauucuucaaugcgcauguaagccacagaucauuacuugaagcuaguaaugagggcauuauauuaaaagacgaggcgucaugugaaauagaaacaaacaaggacuucaagugcuaugaagagagagcuuuucugaagugguccugcccacaucuggugaauucagcucauuuuauugauaguaaggguaagcuacguauaauuaaaugcaaagcugaguacgagauaacagaggacugcacguacuguagacggaucaagaaaaaagccgcacaacaaaaacaaguuuauaaaucuucuauugcucuucaagaugcaguuugccaggaaaacucagauuauuaugauggaccgaggaucacuuucaccggagucuguaaaauuggaacaauggaguauaaaaaaugcaaacacaaauccuccucauuugagaacauaggcuuuaucacaauuagggacaagggcaaguacuauauagaaaauaugagaacuaaaaacauugagaugguuucuaaugucucuuuuaucuguuauaaucacaauggucaggauaccgagaaggacgugcgauuacuaaagagaguuaagccaggggacugcaaaguugucgaugacaguaaaacuaaacacugcacaggagaucauguauuuugugaaaaauacgauugcaccaaaucuuacccagaggcaaccugcaugcaugccccaggcucaggaccuauacuaguuuuggugaugggaguaugguuuaaaccacaguguguuggcuaugagagaguucuggucgagagagaagucaaggcuccaguuuugauccaagagaaagacugugacacauguguguuugagugucuggaggacaagauuuugaucaaguccaccggauucaagaugaucucugcuguugccugcucacaugggucuugugucucaucccaucaaucccccucuaccuuucucuacauugauuauccuggacucacagcaucaguugggggugagauuggauuacacuugucucacacagaugauucgguaagugugcauaagaagauccauuguccugcaagggauccuugugaagcccacagcugcauaguguguuaucaugggcuagucaauuaccagugccacacaguccuaagcuauucuguaguguccuuccuucuugucugcaugauguaucuggccuucuuuauuacuaguagauugcuguucuuucucaggauaaugcccagaagacugaggaacccaaucagcuggcuaacacuacuuauuagguggguuuugcagacuuuguuggcgaucuuacgacuaucuuuuaagaagcugagugagacaauuggcuggaauucuccuaauaacagacaacagauggauguggaagcuaacagaaggccucucaggagguauagaaccacuuuuauucucacuuuauuauuuguagggcuaacuagugcuugcucaaacacugcagugucaaauuccaaacagaccaagugucuucagucuggaggaucuguaaaauguucaauuacagcaaccauuaccuuaaaagcaggcaccauaggagcugaaucuuguuuuauuaucaaggguccaucagaaaaccaacagaagguuauaagaguuaaaacagucucaagugagacaguuuguagagaaggaucuaguuucuggacuggacaauucacuccuagcugugucagcucuagaagaugccacuugguaggggacuguguagggaauagaugucaagcuuggagagaugaaguugugucaagagaauuuggcaauaugaaggauaacaauguaaugucugaaaacaaguguuuugaacaauguggagcagcagguugugguugcuucaauauaaauccaucaugcuuguauguccauuccacauucaaaagugugaggagagaggcaauucggguauuuaagugcaaugacugggugcacagacuaaccuuugaaguuagugggccaucuggagagaaagacagaauaguucucaauagucucaguacaaaauuucuccaauggggaaccaucucauugagucuugaugcggaaggaauaucagggacaaauaguuauucauucuuggaaagcaacaaggguggauuugcuauacaugaugaggaguucucugaaauuccaagagaaggauauuuaggugaaauucgcugcuccucugaaucagcagucauagcagcacacaaguccugcauaagggccccgaaucuaauaaaauauaagccuaugacugaucaaauagauuguacagcuucuuugguggauccauuugcaaucuuuuuaaaaggaucacuaccucaaagcaggucuggauauacauucacgagcucaacugacaaaaagacugugcaggccuuuaauaguggcucgaucaaggcuuugauuuccauuaauauggaugaucaugaaauagaauuccuaaaugacgcagcugacugugaugcaacuuucuuaaauguuucaggaugcuacucuugcaauuauggggcucaaguuugcauuaaagucaggucaucaaaaucaucaaucuuuagcucuaauaauaaugacaacuccauuguaauaaacuuugaugcagaucaagggacuagggauuauugccggauaauacauuucaaugggccauuaguagaugagacucuacauuauagcuguggaggugaaucuaaacucuuacaaaugaaagggucacuaauaacagugggccccuaugacuucagaaacacgacugggggaaaaucaacgauugucaauccacaugaagagucauggaaucucuucagcugguucucuggucuuuuagauuggcugggugggccacuacgagcaauucugaaaauugugcuaaucauuaucauuggaaucauauuguucauuguuguagccuuccucauaagacuuguaauauucaauguuuugcuaaagucaaaaaagaacuaa

SEQ ID NO: 4340 - RNA, 3873 nt, Artificial Sequence
  derived and/or modified CDS sequence (wt) from Phlebovirus(CoAr171616)__HM566154.1__GP
auguuucagauuauauacuuacuaaccaagcuguaccugguaucauccauguauagcauuauguuuugggagaaugaaaauauauccaagcuaugucuuaguaacaauucaccccuagagggucuuguuuacuacugggagaaugugaugaaagagggagacuuuaaggaagaaaagagaaaaaaauguagaauugguccuucugaucugaagaggguaacuaaucaaacauuaacaacuuugaucgaagaagugcagaaaagccccuccgagauccaacuacugugugaagaagauggcaauaagacgggaauaucaauguuuuuugauggauugucagaugacaucucaaccccaagcauaguagacugcaauggcaauaucaggauuucagaucuaaggguucaggugggaagaggucauuuugaaaaggagaaugagauaagaaagauagaagaaauagugacuuuagaagaugaucuuaggagggaaagagaccuaaacaaguugcuacaggauuugaauaagaaggaugcagaggagagaagaauuauugaacaugagcuaaccaauaugagagagcagcugcagagagaaagagagaggagcaagcaacaaauuaaggaacaugagaagauugaagugaauaaccacaaagagccugcaacucauuuaaaugugucaaaacucuuaacaauugggcuccuggcucaacagguuggacaaguaauagcuacagaaccuggucagcugaacaccuggauccaugcaaagaauaggauaggaaagggguuauacaaaacagaagacacugaugaggauggauguagaggcuuggauuauggugucaguugcuuagguuuugacuacuugcuuagaacugauauauaucccuuuuucaauucuuuuguuagucacuuaucaaugcuugaggcuagcacagaagaucuaauugagaaagagggaacaucuugugagauagaaacaaauaaagaguucaaguguuaugaagaaagagcauucauaaaaggcucuuguccucauuuaguuaauucagcacauuuucuagauaacaaggggaagcucagaauagucaaaugcaagacagauuuugaaaugacagaagacuguacauucugcaggaaaauuaaaaagaaaaauagccaacacaagcagguuuuuaagacaucuauugcucugcaagaugcuguaugccagaacaacucagaucuauauaauggcccuaggauuguauacaguaauguguguaaaauuggaaugguuuccuacaagcaguguaagucuaagaccaguaguuaugagucuguuggcuuuguuauucugaaagggaaagggaaguuuuacauagaaaacaugaagauaaaaaauaucgaagugaucgcuaauguuucuuucauuugucaucaguaucaaggucaagauggaacagaaaaggagcagagaucucucaagagaauuaguguuggagaguguaaaagugugaacccucagaagacaaagcacugcacaggugaucauguguucugugagaaauaugacugcacuaaauccuauccugaagugaccugcuuaauggcaccugguucuggacccauucuaguccaaauuauggguucuuggauuaaaccacaguguguugguuaugaaaaagugcuaguugagagagaggugaaaucgccaacucucacugaagagagagacugugacacuuguguauaugaaugcuuagaagauaaaauauugauaaaaucaacaggcuucaagaugaucucugcuguggcaugcucacauggcauguguguaucaucacaucaggagccuucuacauucuuguacauaaacuacccuggaaugagcgcaucaauaggaggagagauuggacugcacuugucacacacugaugacucucuaagccuucacaaggugauaucguguccaucacgaaacccuugugauguacauagcugcauuauuugcuaccaugguauaaucaauuaucaaugucauacagcucuuaguuacacaauuguugcauuuucuuucauaucuuuucuuuaucugacauucaaagugaucagucaacuacuuuacacuuuuaagguuguccccaagaaauuaaaaggccccuucuacuggaugggauaccugauuaaauggauagugaagaccauuuugggaguuguaagaaauaccuucuuuacuaugagcaauaggauugggugggaaagaagagaugaaauccaugaggauauagaagcaaauccaagacggcacuugcagagauuuaagaccacauuuguauuaaccauguuaaugaucaauggagguuuauguugcucaaauacucugguaucaaacucaaagcaaacucgauguguucagucaggaaacgagguuaagugcucuguuagugcuacaguagucuugaaagcaggaguuauaggggcagaaucuuguuuuauaauaaaaggaccaucugagaaucagcacaagaugauaaguguucgaacacuuucuagugaaacuguuuguagggaaggagcaagcuuuuggacaggccauuucucacccuccuguguaaguucuagaagaugccacuuaguuggagaaugccauggaaauagaugucagucuuggagggaugaucagauuucucgagaguucgggggcguaaaagauaauaauaggaugucagagaauaaguguuuugagcaguguggauccauuggcugugguuguuuuaauaugaauccaucaugcuuguacguacacaccacucuuaagagugcuaggaaugaagcaguucgaguguucaaauguaaugauuggauucaccguuuaaauuucgaggugauuggaccaucuggagagaaggauguaguaacccugaauagcaugagcacuaaauuuuugcaauggggcacuauaucacucagucuugaugcagagggaauuacuggaacaaacagcuauucuuuucuagaaaguaguaaggguggauuugcuauccaugaugaggaguucucagacaucccaagggaaggcuauuuaggggaaauucgaugcucaucagaaucugcuguaauaucagcucacuccucaugcauaagagcuccugacuugauaaaguauaagccaaugacagaucaaauugagugcacaucaacuuuaauagauccauuugccauuuucaugaaaggaucacuaccccaaacaaggucuggcuauacauucacaagcuccaaggauaagaaaaccauucaggcuuucaauacaaauucuauuaaggcucugauauccuuaaauuuagacgaccaugaaauugucuuugugucugaccaaacaaauugugagugcacauuucuaaaccucacagguuguuacuccugugauuauggagcacauguguguuuuagaaucaaaucugacaaaaagggugucuuuguuagcaauacagaggcaaaagauauuucuuuuggcuuugaaguuuuaacagguacucaugacuauugucaaauacaacauuuuaacagcccaucaguguacaaaacuuuaaguuacaguugcgggggagaaucaaaauuacuggucauuaaggggucacuaauaaccauagguccucaugauuacagaaacaagacaggaggggcuuccacuguugugaaucccucugaggaaggauggagugugaccaacuggauugguggcuuuauauccugguuaggaggaccacugaaggccuuacuaaaaauagccgugacaauacuagccggaguagugauauuucucaucauauauuucuucuuaaggcuaauugcaacaaauaucuugaugaagacuaaaaagaacuaa

SEQ ID NO: 4341 - RNA, 3852 nt, Artificial Sequence
  derived and/or modified CDS sequence (wt) from Buenaventura virus(CoAr3319)__KP272002.1__GP
auguauaaacuuauuacuaauaucuuaaaacucucaauggugucugcuauguacagcaucauguuuugggaucccacugggauaucaaaacucugccugaguaauaauucaccauuagagggucuuguuuauuacugggaaaauaccaugagagaaggugaguucaagagagagaagaggaaaaagugucguuuagggaucucugagccagccccugucagcaaucagacaauagugucucucauugaggaaguucagaaaaguccugcugagaugauucugaucugugaaaccagcggaaaugcuacaggaagcucucuaucauuugaugggcuuucugauaaugaaguuaaaccuaguauugucgacugugccacaggugaaagaacaucagaccugcgaguucuggucgggaagggcaccuuugaaaagaaaaugagcaugucaaaugagauugauagaguggucucacuagaagaucaucuacaaagagaaagggaauuaguucaaaccuuccaagaucugcaccauaaugaguccgaaaagaauaagcuguuggaacaugaacucgaaaauguacgacagcaauugagaagagaaagagaaucuaauaagguuaaaguguggacuaccaagaaaccggaggucaccaccauagggcugaccacaacuauugcaacaauucuguuagcaucucaauccauagccuccucuguucccaugccuggccagcugaauacauggccacaugcaaaaaauagagugggaggaggugucuucaaagccaaugaugaugaugaagacaguugcaaacugauugacuacggaaucgccugccauggcuuugacuaccuccugagaacugauauauacccauucuuuaaugcacaugugagccauagaucaaugcuugaggccagcaaugagggcaucauauuaaaagaugaggcaucaugugaaauagaaacaaauaaagauuuaaaauguuaugaagagagagccuuuuuaaagugguccugcccccaucugguaaacucagcccauuucauagauagcaagggcaaauuacgcauaauaaaaugcaaagcugaauacgagauaacagaggacugcacuuauuguaggcgaaucaagaagaaggcugcucaacaaaaacaaguauacaaguccucuauugcucuucaagaugcagucugccaggagaacucagacuauuaugacggaccaaggauuacuuucacugggguuugcaaaauuggcucaauggaguacaagaaaugcaaacacaaguccucaucauucgaaaacguuggcuucauaacgauuagagacaaagguaaguauuacauagaaaauaugaggauaaagaauauugaaaugguuucuaauguuucuuucaucugcuacaaucacaauggucaagacacugaaaaggacauacgauuacuaaagagggucaaaccaagcgacugcaagguuguggaugauagcaaaucuaagcacugcacaggggaucauauauuuugugauaaauacgacugcaccaaaucauauccagaagcauccugcaugcaugcuccaggcucaggacccauauuagucuuaguaaugggagucugguucaaaccacagugcguaggauacgaaaggguucugguugagagagaaguuaaaguuccuguuuugacccaagaaaaggacugugacacauguguauuugaaugccaagaagauaagauucuaauuaaaucaacuggauuuaagaugaucucugcuguugcuuguucacauggguccugugucucaucucaucagucuccuucuacuuuucucuauauugauuauccugguuuaacagcaucaguuggaggugagauuggacuacaucuuucucauacugacgacucgauaagugugcacaagaagauccacuguccagcaagggauccuugugaggcucacaacugugugauaugcuaucaugggcuaaucaacuaccagugccauacguucuugaguuacucuguuguguccuuucucuucauuagcguauuauacuugaccuucuuuauuguaagcagauuacugcuguuccucaagauaaugcccaaaagacuaaaaaauccaaucagcuggcuaacuuugcucaucagaugggugcuacagaccuugauaacgauccuacgucuaucauuuaagaagcugagugagacaauuggcuggaccacuaaugacaauaggcagcauguugauguagaagcaaacagaaggccccucaggagauauaggaccaccuuuauucuaacuuuguuguuuauagguuuagcuaguggcuguucaaauaccgcugugucaaauucuaagcagaccaagugucuucagucuggagguucugugaaaugcucaauaacagcaaccaucacccuaaaagcagguaucauaggagcugaguccuguuucauuaucaaagguccaucagagaaucagcaaagaguuauaagaguuaaaacaauuucaagcgaaacagucuguagagaaggaucuagcuuuuggacuggucuauucacuccuagcuguguuagcucuagacggugccacuugguuggggacuguguagggaauaggugucaaucuuggagagaugaaguugugucaagagaauuugguaacaugaaggacaacaaugcaaugucugaaaacaaaugcuucgaacaguguggagcagcaggcugugguugcuucaauauaaacccuucaugccuguacguucacucaguauucaagagugugagaagagaggcaauucgggucuucaaguguaaugacuggguacacaggcugacuuuugagguuagugggccaucuggugaaaaagacaggauaguucucaauagucuaagcacuaaauuucuucaauggggaacaaucucacugagucuggaugcagaagggauaucuggaaccaauaguuauucuuucuuagagaguaacaaggguggauucgcaauacacgaugaggaguuuucugaaaucccaagagagggauacuugggugagauucguuguucuucugaaucagcagucauagcagcacacaaaucuugcauaagggccccgaaucugauaaaauauaagccuaugacggaccaaauagacugcacagcuucucugguagauccuuuugcaauuuuccugaaaggaucauugccccaaaguaggucuggauauacguucacgagcucaacugauaaaaagacuguucaggccuuuaauaguggggcaauuaaagcauuaauuucuauuaaccuggaugaucaugaaauugaguuccugagugacacagcugauugugaugcaacauuucugaauauuucaggaugcuauuccugcaauuauggggcucaggucugcauuaaagucagaucaucaaaaucaucaaucuucagcucuaacaacaaugacaacucuauugugauuaacuuugacgcagagcaaggaacuagagauuauugcaggauaauacacuucaauggaccauuaguugaugagacucuacauuacagcugugggggugaguccaaacuuuuacagaugaaaggaucacuaauaacagugggcccuuaugacuucaggaauacaacuggaggaaaaucaacaguugucaauccgcacgaagaguccuggaaucucuuuagcugguucucaggguuacuugauugguuaggaggaccauugcgagcaauuuuaaaaauagugcuaauagugaucauugggaucauacuguuuauuguugugguuuuccucaugagacuugccauauuaaacguucuacuaaaauccaagaaaaacuag

SEQ ID NO: 4342 - RNA, 3942 nt, Artificial Sequence
  derived and/or modified CDS sequence (wt) from Cocle virus(GML244915)__KP272034.1__GP
augauguuuacacauuuagauguuuuaacaagggcaaugcucguaaugagcauguacucuuuaaccacgugggacaguaucaggagaaaugauauuugcuucucaaacgacucaccuuuagaaggcuuggucuauuacugggaaacacaaucaaagaugcaugaauauaaaaaagaggacucacagaaaugcagaguuggugauucagaaaaaaagaugauuucuaauguuacgaucauaucucugauuucggaaauucaaaagaguauaucugagcugucacuaucaugcgggaaugaugauaauucaacugggcaggucuugauguucaauggucuagaagacacaaucagaggugauuacauaguugauuguuuaacuggccucuaccaaucugacauaggagugggugucggaucagggaaaacuaaacacgaccauacaaagcugagaaauaaagcaguuauaaucgaugaaaaggaaaaaaugaucuccuugcuugaagcucagcagagugaaaaugauaucaaaacacaagugcuuaugucagagauugagcaauugaagacucaacuucugaauagacgaagugagagaggccaugaaaaaagaaagaaugaggagauuguuucagauuugauggcuaggaacucugaucuacgaaagcacaaugauauucugaaagaugaaauggaucagauaaaggaaaaucugacaauauucaaaucaagaaaugcgauaaguacuacuucagucccggcaaucaugucaauugcacuauugucuuccucgguaaugcccaucauugccgcugugucugauucaccaaugauuaacccauggccucaugcaaagaaucguguuggaucaggaauguauaaguaugaugauaaugaugaaucaggauguagacccauaagguauggagugucuugcauuggcuuugaucacaugcucaagauggacaaauauccauucuuuaacgcauucauaggacacaagacucuuuuagagucuuuuguggauaagauuauugaaaaagaggaugagacaugcgagauugggacaaacaaggaauuuaaguguuuugaagaaagagccuauauaaaagggacuugcccacauaauauaaaugcuguacacuaucuugauaauaaagguaagcuccguuaugugaaaugcaaggaaaauuuggagaugacugaggacugugcauucuguagaaagauuaagaaaaaggcugggcagucaguacaaguacagaaaacuucugugccucugcaagaugcuauuugucaagacaacucugacaucuacacaggaccaagaauuccauauaaagggaugugcaaaauugggcugguaaaauacaaggaauguaaauccaagaccucaucuuaugagacugucucuuucaucacauuaaaaggaaagggcaagauauauauugagcaccucaugcuaaaaaacauagaaguugucacuaauguuucuuuuguuuguuaugagcaugcuggucaaguugagcaggaaguagaacauagagcacuaaaaagagugucuguuaaugauugcaagauuguugauagcucaaagcagaagaucugcacaggagaucauguauucugugagaaauaugauugcucaacgucauacccugaugucacauguauucaagcaccaggauccggcccucuguauguuaaucuuaugggaucauggauaaaaccucagugugugggauaugagagaguuuuaguugaaagagaagugaagcagccacuguugacaccagaacaaaacugugacacauguguuucagaauguuuagaugaagggguucauauaaagucuacagguuuugagaucacuucugcaguugcauguucucaugggucaugcauuucugcucaucaagaggcauccacuucaauaauugugccauauccaggccuauuggcuaguguagguggcaagauaggauuacaucuuucucauacaucugacucugcaagugugcacaugauaguuguaugcccuccuagagauaguugugcagcacacaacugcuuacuuuguuaucacggaauguugaauuaucaaugucacucaacauuaagugcuaucuuaacaucuuuucugcucauuuuauuuauuuauacuacuuucucuuucauuacuaauaucuuauacuuguuacguuuauugcccaaacagcucaagagcccuauugggugguuaaagcuuuucauuaauugguuauuuacuauucuuagaaucagaacgaaauacuuaaugggcagacuaaaucagagaauaggcuggguugagaaucaugauguagaaagaccaagaccuagagagccaaugagaagauucaagacaacucucaugcucacuaugcuaaugauaacggguggcuaugcuugcuccaauacaguuguggccaauucgaagcagaccagauguguccaggagggaucuaacacuaagugcucaguuacagcaacuguuacacugaaagcagguguuauaggugcagaaucaugcuuugucauuaaaggcccaauggaaaaucagcaaaagacgauaucuauuaaaacugucucuagugaaacugucuguagggaaggaucuagcuucuggacgagcuuguauauccccucaugccucaguucuagaagaugccaucuuguaggggacugugugggaaacaggugccaaucauggcgagaagaccaauugucuagagaauucucaggagugaaggacaaucaaauaaugaacgagaacaagugcuuugagcaguguggugcuauaggcugcggcuguuucaacauaaacccaucaugccuauauguccaugcauaucucaaaagugcuaggaaugaagcaguaaggguguucucauguucugacuggguccacagagugucauuugaggucaaggggccagauggagaaacagaguuagucacacuggggaguuuagguacuaaguuuuugaauugggggacucucucuuugucauuagaugcagaaggcauaacuggcacaaauagccuaaguuuuuuagaaagcagcaaaggaggguuugcacuguaugaugaagguuucagugaaauuccuagggaagguuucuuaggggaaauaagguguaguucugaaucugcugcaaucucugcucauaaaucaugcauuagagcaccaggcuugauaaaguacaagccuaugacagaucagauagagugcacugcaucauuaguggacccauuugccauauuccuaaaagguucacuuccucaaacuagaaacggacaaacuuuuacuagcacaaaagacaagaaaacagugcaagcauucacaacuggggcaauaagagcucuucuaucaauaaacuuggaugaucaugaaauaacguuuauaaguaaaauaaaaaacugugaagccacuuuccuaaaugugaguggcuguuacuccugugacuacggagcucaugucugcaucaagauaaaauccucagaaucagcugauuucuacgcggagucagaagauaaaacaacagugcuaucgcuuccgguuagcucaggaacucaggauuacugucaagugcuacauuuucagaagccuuuaguagaugagagguugucauauucaugugggucugaacccaagcuuaugguaaucaaggggacauuagucuacauggguguuuaugauuucagaaacaagacaggaggcucuucaacuguagugaacccgucagaugcuucuuggaguauugcaaacugguuuucuggauuauuagacugguugggggggccuuuaaaagccauccuaaaaauacucggauucauagcaauggguguuguuuguuucauacuauuuaugauccugaucaagauagcagucagaucuguuaauaugaaaaagaaaaacuag

SEQ ID NO: 4343 - RNA, 3873 nt, Artificial Sequence
  derived and/or modified CDS sequence (wt) from Campana virus(VP-334K)__KP272041.1__GP
auguuacauuucauaacuauaacaacuaaguucuuagcuguugcauccauguacaacuuauuguacugggacccuaacgguuuaucuagacugugucuuagcaacaacuccccauuagaagggcuugucuacuauugggaaaauuugaugaaagaaagugauuucaaaaaagauaagaagaaacauugcagaauuggcacuagcguggcugcaccagugacaaaugagacucugacaacauuaauugaagagguucaaaaaagcccaucugaaauuauucuccagugcgagucaaggaauaaugauacugggaauucaauauacuucgauggucuugcggacgauauugaaucaccuaguauugugaacugugaaucagguaaaagggaaucagaucuuagaguccugguaggucagggacucaagaaagagaucauucugaaugaaauugcugcgauugacaggcaagcauccuuagaagagcaccugaggggagaaaaagccuugacaucacuucugcaagagauaagcaagcaggaugaagcagaaagaaagagauuagagcacgaagucuccagucucaggcaacaguuaaugaaugaaagagaggagaacaaaaaaagaaaaaacaucccugcauuuggugucaguucuacaaccucaucuagccuaaugaacauuagcagagugguuacuauugggcuccuaucucagcaggccauagccaauccgucacucccaggucaagugaacacuuggccucaugcgaaaaacagaauuggucaaggauuauacagaauugacacuagugaugaggaugggugcagaggacugaacuaugguguuauuugccugggauuugaucaucugcuuaggauggauuuguauccuuucuuuaaugcuuaugugagccaucugucauuauuagaggcauacacagagaacauaauucaaaaggaugaaacagaaugugagauugagggcggcaaagaauucaaauguuaugaggagagagcauauaucaaaggaguauguccacauagaauuaagucugcacauuacuuagaccagaaggggaagcuaaggaucauaaaauguaaggaaaaucuugaacuuacagaggauuguacuuacugcaggaagauaaagaaagacagaggccacacaaaacaaguuuauaaaaccucuguuccccuccaggaugccauaugccaggacaauucagaugauuacucagggccaaagauuagcuucaaagguguguguaaaauuggcaugauagaauauaaggaaugcaaguacaaauccucuucuuuugaaacuguaggauucaucaccaucaaggagaaagggaaauuuuauauagaagacaugaagcucaaaaaucuugaggugaccaauaauguagcuuuuaucugucaucaguacacaggucaggauggaacuacggaugaagaaaacagacaccuaaagaggaugagugucaaggauugcaaaaauguuaacucuagcaaaagcaaguauuguacaggggaucauauauuuugucaggucuacgacugcacaaagucuuauccagaagccacuuguuuuguagccccagguucaggaccagucuuaguucaggucauggggucuuggauaaaaccacaaugugucgguuacgagaagguccuaguagagcgagaggucaagaugccuauccucacugaagaaagagacugugacacguguguuuaugagugcaaagaagaucacaucuuaauuaaaucaacaggcuucaauaugauaucagcaguggcaugcucacauggaucauguguuucugcccaccaggaucccucaacuuucuugaacauagaguauccaggaaugagugcuucuguugguggugagauuggaauacacauaucacauacagaugacucacuaagccugcauaaaaagauauacuguccugccagagacucuugcgaagcacauaauuguauuauguguuaccacggucuaaucaauuaucagugccacacagcuuugaguuaugcaguggucucauuuauguucguuaguauugcuuaugugauuuuuaaugugcuaaggcuaguuuuaguagcucuccauguaguaccaagaaagcuaaagaguccuaucgacuggcucauucuucuaaucaaguggguauucuuacuguuggcuaaaguaauaagagcuuuccucacacaccugaauacuacuauaggcuggagagaaagacagaacaacuuugcagcagaucuagaggcucaaaggaggccacuacaaagauucaaaaccacaguccuauugaugaugaugcucaucagcguggucaguaguuguucuaauucaguagucucuaauucuaaacagacaagguguauucaaucagguagcaauacuaaauguucugucucugcuacaaucacacuaaaagcuggaguuauaggagcugaaucaugcuuuguaauaaaaggaccuucugaaaaucagcacaaaacuauuguuauuagaacugugucuagugagaccaucugucgagagggaucaaguuucuggacaggacauuuuacuccuucauguuuaagcucaagaaggugccaucuagugggugauugugucgggaguaggugucaagguuggagagaagauguuauuuccagagaauuugguggagugaaagacaauaaccaaaugucggagaauaagugcuuugaacagugcggagcagcuggaugcggauguuucaacauaaauccaucaugcuuauauguacacaccauacugcgaagugcaagaaaugaggcuguuagaguauucaagugcaaugauuggguucauaaacugacauuccauaucaaaggaccaaauggugaagaggaagauguuguccugaauagccuuagcacgaaguuccuaucuuggggcacuauuuccuuaagucuggacucagaagggauaacaggaacaaauaguuauucguuuuuagagaguagcaaaggggguuuugcaauucaugaugaggaguuuucugaaaucccaagagaaggguuccuuggagaaauccgcugcucgucugaaucagcuguugucucugcccauaaaucaugcauaagagcucccggcuuaauaaaauacaagccaaugacugaucagguugaguguucugcuucucuaguggacccauuugcaauuuuuauaaaagguucacuaccccagacucggucgggauacaccuuuacuaguucuagagauaagagaacaauccaggccuuuaauaauggagcuauaaaagcacucuuaacccuaaauuuggaugaccaugaagugaucuucucagaaucuguaauaacaugugagugcacuuuccucaauaucucaggauguuauucuugcaauuuuggugcucagguaugcuuuaaaauuaaaucaagcggcauaggugauuuugucaguagcucagagacaggaaauauucuuuuuaguuuuccagugaagucagggacagaagacuacugccagauucagcacuuuaauaguccaauggugucagagucacuacaauauaguugugguggagaaagcaaguuauuguuaauaaaaggguccuuaaucucuguugguccuuaugauuauaggaauaaaacaggcggcucuucaacaguuguaaauccagcagaagacucauggaguauuuucaauuggcuuucaggauuccuagauuggcuaggaggaccucuucgagcuuuaguuaaaaucgcucuugcuauuauuggugcucuugcucuacuauucaucaccaucaugcuggccagauccgugauaagcaacacucuaucaagaaagaagaaaaacuga

SEQ ID NO: 4344 - RNA, 3594 nt, Artificial Sequence
  derived and/or modified CDS sequence (wt) from RVFV(ZH-548)__DQ380206.1__GP
auguauguuuuauuaacaauucuaaucucgguucuggugugugaagcgguuauuagagugucucuaagcuccacaagagaagagaccugcuuuggugacuccacuaacccagagaugauugaaggagcuugggauucacucagagaggaggagaugccggaggagcucuccuguucuauaucaggcauaagagagguuaagaccucaagccaggaguuauacagggcauuaaaagccaucauugcugcugauggcuugaacaacaucaccugccaugguaaggauccugaggacaagauuucccucauaaaggguccuccucacaaaaagcggguggggauaguucggugugagagacgaagagaugcuaagcaaauagggagagaaaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccucauag

SEQ ID NO: 4345 - RNA, 3594 nt, Artificial Sequence
  derived and/or modified CDS sequence (wt) from RVFV(ZS-6365)__DQ380205.1__GP
auguauguuuuauuaacaauucuaaucucgguucuggugugugaagcgguuauuagagugucucuaagcuccacaagagaagagaccugcuuuggugacuccacuaacccagagaugauugaaggagcuugggauucacucagagaggaggagaugccggaggagcucuccuguucuauaucaggcauaagagagguuaagaccucaagccaggaguuauacagggcauuaaaagccaucauugcugcugauggcuugaacaacaucaccugccaugguaaggauccugaggacaagauuucccucauaaaggguccuccucacaaaaagcggguggggauaguucggugugagagacgaagagaugcuaagcaaauagggagagaaaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucagagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaagaagaucaaaccaaguucuuaaagauaaaaacugucucaagugagcuaucaugcagggagggccagaguuauuggacuggguccuuuaguccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguccaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuucuccuuauauaucuuggaagaacaggccucucuaaaauguggcuugcugccacuaagaaggccucauag

SEQ ID NO: 4346 - RNA, 3594 nt, Artificial Sequence
  derived and/or modified CDS sequence (wt) from RVFV(CAR-R1622)__DQ380219.1__GP
auguauguuuuauuaacaauucuaaucucgguucuggugugugaagcgguuaucagagugucucuaagcuccacaagagaagagaccuguuuuggugacuccaccaacccagagaugauugaaggagcuugggauucacucagagaggaggagaugccagaggagcucuccuguucuauaucaggcauaagggagguuaagaccucaagccaggaguuauacagggcauuaaaagccaucauugcugcugauggcuugaacaacaucaccugccaugguaaggauccugaggacaagauuucucucauaaaggguccuccucauaaaaagcggguggggauaguucggugugagagacgaagagaugcuaagcaaauagggagagaaaccauggcagggauugcaaugacaguccuuccagccuuagcaguuuuugcuuuggcaccuguuguuuuugcugaggacccccaucucagaaacagaccagggaaggggcacaacuacauugacgggaugacccaggaggaugccacaugcaaaccugugacauaugcuggggcauguagcaguuuugaugucuugcuugagaaggggaaauuuccccuuuuccagucguaugcucaucauagaacucuacuagaggcaguucacgacaccaucauugcaaaggcugauccaccuagcugugaccuucagagugcucaugggaaucccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccuaaagaaggggucuuauccucuccaagacuuauuuugccagucaagugaggaugauggaucaaaauuaaaaacaaaaaugaaaggggucugcgaaguggggguccaagcacucaaaaagugugauggccaacucagcaccgcacaugagguugugcccuuugcaguguuuaagaacucaaagaagguuuaccucgauaagcuugaccucaagacugaggagaaucugcugccagacucauuugucugcuucgagcauaagggacaguauaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaagugucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucugcaguugcuugugcuagcggaguuugcguuacaggaucacagaguccuucuaccgagauuacacucaaguauccagggauaucccaguccucagggggggacauagggguucacauggcacacgaugaucagucaguuagcuccaaaauaguagcucacugcccuccccaggacccaugcuuagugcacggcugcauagugugugcucauggccugauaaauuaccagugucacacugcucucagugccuuuguuguuguguuuguauucaguucuauugcaauaauuuguuuagccauucuuuauagggugcucaagugcuuaaagauugccccaaggaaaguucugaauccacuaauguggaucacagccuucaucagauggguguauaagaagaugguugccagaguggcagacaauauuaaucaagugaacagggagauaggauggauggaaggaggucaguugguucuagggaacccugccccuauuccucgucaugccccaaucccacguuauagcacauaccuaaugcuacugcuaauugucucauaugcaucagcauguucagaacuaauucaggcaagcuccagaaucacuacuugcuccacagagggugucaacaccaaguguagacugucugguacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaaaugucugagcucaaggagaugccaucuugucggggaaugucaugugaauaggugucugucuuggagggacaaugaaacuucagcagaguuuucauuuguuggggaaaguacaaccaugcgagagaauaaguguuuugagcaguguggaggauggggauguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagccaaugauagaucaauuggagugcacaacaaaucugauugaucccuuuguuguauuugagagggguucucugccacagacaaggaaugacaaaaccuuugcagcuucaaaaggaaauagagguguucaagcuuucucuaagggcucugugcaagcugaucuaacucugauguuugacaauuuugagguggacuuugugggagcagcuguaucuugugaugccgccuucuuaaauuugacagguugcuauucuugcaaugcaggggccagggucugccugucuaucacauccacaggaacuggaacucucucugcccacaauaaggaugggucucugcauauaguucuuccaucagagaauggaacaaaagaucagugccagauacuacacuucacuguaccugaaguagaggaggaguuuauguacucuugugauggagaugagcggccucuauuagugaaagggacccugauagcuauugauccauuugaugauaggcgggaagcagggggagaaucaacaguugugaauccaaaaucuggaucuuggaauuucuuugacugguuuucuggacucaugaguugguuuggagggccucucaaaacuauacuccucauuugccuguauguugcauuaucaauugggcucuuuuuccuccucauauaucuuggaagaacagggcucucuaaaauguggcuugcugcuacuaagaaggccucauag

SEQ ID NO: 4347 - RNA, 3594 nt, Artificial Sequence
  derived and/or modified CDS sequence (wt) from RVFV(2250/74)__DQ380209.1__GP
auguauguuuuauuaacaauucuaaucucgguucuggugugugaagcgguuauuagagugucucuaagcuccacaagagaagagaccugcuuuggugacuccacuaacccagagaugauugaaggagcuugggauucacucagagaggaggagaugccggaggagcucuccuguucuauaucaggcauaagagagguuaagaccucaagccaggaguuauacagggcauuaaaagccaucauugcugccgauggcuugaacaacaucaccugccaugguaaggauccugaggacaagauuucccucauaaaggguccuccucacaaaaagcggguggggauaguucggugugagagacgaagagaugcuaagcaaauagggagagaaaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaaggggaaauuuccccuuuuccagucguaugcucaucauagaacucuacuagaggcaguucacgacaccaucauugcaaaggcugauccaccuagcugugaccuucagagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaaaguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggauaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcauggcugcauagugugugcucauggccugauaaauuaccagugccacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaauauuaaucaagugaacagggaaauaggauggauggaaggaggucaguugguucuagggaacccugccccuauuccucgucaugccccaaucccacguuauagcacauaccugauguuacuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaguguggaggauggggguguggguguuuuaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagagauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccaaggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccucauag

SEQ ID NO: 4348 - RNA, 3594 nt, Artificial Sequence
  derived and/or modified CDS sequence (wt) from RVFV(T1)__DQ380201.1__GP
auguauguuuuauuaacaauucuaaucucgguucuggugugugaagcgguuauuagagugucucuaagcuccacaagagaagagaccugcuuuggugacuccacuaacccagagaugauugaaggagcuugggauucacucagagaggaggagaugccggaggagcucuccuguucuauaucaggcauaagagagguuaagaccucaagccaggaguuauacagggcauuaaaagccaucauugcugcugauggcuugaacaacaucaccugccaugguaaggauccugaggacaagauuucccucauaaaggguccuccucacaaaaagcggguggggauaguucggugugagagacgaagagaugcuaagcaaauagggagagaaaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucagagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguuguuguguuuguauucaguucuauugcaauaauuuguuuagcuguucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcaucucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugauaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccucauag

SEQ ID NO: 4349 - RNA, 3594 nt, Artificial Sequence
  derived and/or modified CDS sequence (wt) from RVFV(1853/78)__DQ380220.1__GP
auguauguuuuauuaacaauucuaaucucgguucuggugugugaagcgguuaucagagugucucuaagcuccacaagagaagagaccuguuuuggugacuccaccaacccagagaugauugaaggagcuugggauucacucagagaggaggagaugccagaggagcucuccuguuccauaucaggcauaagggagguuaagaccucaagccaggaguuauacagggcauuaaaagccaucauugcugcugauggcuugaacaacaucaccugccaugguaaggauccugaggacaagauuucucucauaaaggguccuccucauaaaaagcggguggggauaguucggugugagagacgaagagaugcuaagcaaauagggagagaaaccauggcagggauugcaaugacaguccuuccagccuuagcaguuuuugcuuuggcaccuguuguuuuugcugaagacccccaucucagaaacagaccagggaaggggcacaacuacauugacgggaugacccaggaggaugccacaugcaaaccugugacauaugcuggggcauguagcaguuuugaugucuugcuugagaaggggaaauuuccccuuuuccagucguaugcucaucauagaacucuacuagaggcaguucacgacaccaucauugcaaaggcugauccaccuagcugugaccuucagagugcucaugggaaucccugcaugaaagagaaacucgugaugaagacacacuguccaaaugacuaccagucagcucauuaccucaacaaugacgggaaaauggcuucagucaagugcccuccuaaguaugagcucacugaagacugcaacuuuuguagacagaugacaggugcuagccuaaagaaggggucuuauccucuccaagacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaccucgauaagcuugaccucaagacugaggagaaucugcuaccagacucauuugucugcuucgagcauaagggacaguauaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggguugugcagauacaagugucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucugcaguugcuugugcuagcggaguuugcgucacaggaucgcagaguccuucuaccgagauuacacucaaguauccagggauaucccaguccucugggggggacauagggguucacauggcacacgaugaucagucaguuagcuccaaaauaguagcucacugcccuccccaggacccgugcuuagugcacggcugcauagugugugcucauggccugauaaauuaccagugucacacugcucucagugccuuuguuguuguguuuguguucaguucuauugcaauaauuuguuuagcuauucuuuauagggugcucaaaugcuuaaagauugccccaaggaaaguucugaauccacuaauguggauuacagccuucaucagauggguguauaagaagaugguugccagaguggcagacaauauuaaucaagugaacagggagauaggauggauggaaggaggucaguugguucuaggaaacccugccccuauuccucgucaugccccaauuccacguuauagcacauaccuaaugcuacuacuaauugucucauaugcaucagcauguucagaacugauucaggcaagcuccagaaucacuacuugcuccacagagggugucaacaccaaguguagacugucuggcacagcauugaucagggcagggucaguuggggcagaggcuuguuugauguugaagggggucaaggaagaucaaaccaaguuccuaaagauaaaaacugucucaagugagcuaucgugcagggagggccagagcuauuggacuggguccuuuagccccaaaugucugagcucaaggagaugccaucuugucggggaaugucaugugaauaggugucugucuuggagggacaaugaaacuucagcagaguuuucauuuguuggggaaaguacgaccaugcgagagaauaaguguuuugagcaguguggaggauggggauguggauguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguuguauuugagagggguucucugccacagacaaggaaugacaaaaccuuugcagcuucaaaaggaaauagagguguucaagcuuucucuaagggcucugugcaagcugaucuaacucugauguuugacaauuuugagguggacuuugugggagcagcuguaucuugugaugccgccuucuuaaauuugacagguugcuauucuugcaaugcaggggccagggucugccugucuaucacauccacaggaacuggaacucucucugcccacaauaaggaugggucucugcauauaguucuuccaucagagaauggaacaaaagaucagugccagauacuacacuucacuguaccugaaguagaggaggaguuuauguacucuugugauggagaugagcggccucuguuggugaaggggacccugauagcuauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccucauauaucuuggaagaacaggccucucuaaaauguggcuugcugcuacuaagaaggccucauag

SEQ ID NO: 4350 - RNA, 3594 nt, Artificial Sequence
  derived and/or modified CDS sequence (wt) from RVFV(MP-12)__DQ380208.1__GP
auguauguuuuauuaacaauucuaaccucgguucuggugugugaagcgauuauuagagugucucuaagcuccacaagagaagagaccugcuuuggugacuccacuaacccagagaugauugaaggagcuugggauucacucagagaggaggagaugccggaggagcucuccuguucuauaucaggcauaagagagguuaagaccucaagccaggaguuauacagggcauuaaaagccaucauugcugcugauggcuugaacaacaucaccugccaugguaaggauccugaggacaagauuucccucauaaaggguccuccucacaaaaagcggguggggauaguucggugugagagacgaagagaugcuaagcaaauagggagagaaaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucaucaccucaacaaugacgggaaaauggcuucagucaagugcccuccuaaguaugagcucacugaagacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaaguuaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaggaacaggccucucuaaaauguggcuugcugccacuaagaaggccucauag

SEQ ID NO: 4351 - RNA, 3594 nt, Artificial Sequence
  derived and/or modified CDS sequence (wt) from RVFV(ZM-657)__DQ380204.1__GP
auguauguuuuauuaacaauucuaaucucgguucuggugugugaagcgguuauuagagugucucuaagcuccacaagagaagagaccugcuuuggugacuccacuaacccagagaugauugaaggagcuugggauucacucagagaggaggagaugccggaggagcucuccuguucuauaucaggcauaagagagguuaagaccucaagccaggaguuauacagggcauuaaaagccaucauugcugcugauggcuugaacaacaucaccugccaugguaaggauccugaggacaagauuucccucauaaaggguccuccucacaaaaagcggguggggauaguucggugugagagacgaagagaugcuaagcaaauagggagagaaaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucagagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaagccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuaguccuaaauguuugagcucaaggagaugccaccuugucggggaaugccaugugaauaggugucugucuuggagggacaaugaaacuucagcagaguuuucauuuguuggggaaagcacaaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuucuccuuauauaucuuggaagaacaggccucucuaaaauguggcuugcugccacuaagaaggccucauag

SEQ ID NO: 4352 - RNA, 3594 nt, Artificial Sequence
  derived and/or modified CDS sequence (wt) from RVFV(ZH-501-777)__DQ380202.1__GP
auguauguuuuauuaacaauucuaaucucgguucuggugugugaagcgguuauuagagugucucuaagcuccacaagagaagagaccugcuuuggugacuccacuaacccagagaugauugaaggagcuugggauucacucagagaggaggagaugccggaggagcucuccuguucuauaucaggcauaagagagguuaagaccucaagccaggaguuauacagggcauuaaaagccaucauugcugcugauggcuugaacaacaucaccugccaugguaaggauccugaggacaagauuucccucauaaaggguccuccucacaaaaagcggguggggauaguucggugugagagacgaagagaugcuaagcaaauagggagagaaaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucagagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacccuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguuguuguguuuguauucaguucuauugcaauaauuuguuuagcuguucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaaggggguaaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcaucucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugauaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccucauag

SEQ ID NO: 4353 - RNA, 3594 nt, Artificial Sequence
  derived and/or modified CDS sequence (wt) from RVFV(OS-3)__DQ380184.1__GP
auguauguuuuacuaacaauucuaaucucgguucuggugugugaagcgguuauuagagugucucuaagcuccacaagagaagagaccuguuuuggugacuccaccaacccagagaugauugagggagcuugggauucacucagagaggaggagaugccagaggagcucuccugcucuauaucaggcauaagggagguuaagaccucaagccaggaauuauacagagcauuaaaagccaucauugcugcugauggcuugaacaacaucaccugccaugguaaggauccugaggacaagauuucucuuauaaaggguccuccucacaaaaagcggguggggauaguucggugugagagacgaagagacgcuaagcaaauagggagagaaaccauggcagggauugcaaugacaguccuuccagccuuagcaguuuuugcuuuggcaccuguuguauuugcugaagacccccaucucagaaauagaccagggaaggggcacaacuacauugacgggaugacucaggaggaugccacuuguaaaccugugacauaugcuggggcauguagcaguuuugaugucuugcucgaaaagggaaaauucccccucuuccagucguaugcucaucauagaacucuacuagaggcaguucaugacaccaucauugcaaaggcugauccaccuaguugugaucuucagagugcucaugggaauccuugcaugaaagagaaacucgugaugaagacacacuguccaaaugacuaccagucagcccacuaccucaacaaugaugggaaaauggccucagucaagugcccuccuaaguaugagcucacugaggacugcaacuuuuguaggcagaugacaggugcuagccugaagaaggggucuuauccucuccaggacuuauuuugucagucaagugaggaugauggaucaaaauuaaaaacaaaaaugaaaggggucugcgaaguggggguucaggcacucaagaagugugauggccagcucagcacugcacaugagguugugcccuuugcaguguuuaagaacucaaagaagguuuaucuugacaagcuugaccucaaaacugaagaaaaucugcuaccagacucauuugucugcuucgagcauaagggacaguauaaaggaacaauggacucuggucaaacuaagagggagcucaaaagcuuugauaucucucagugccccaagauuggaggacaugguagcaagaagugcacuggggacgcagcauuuugcucugcuuaugagugcacugcucaauacgccaaugccuauuguucacaugcuaaugggucaggaguugugcagauacaaguauccggggucuggaagaaaccuuuauguguaggguaugagagagugguugugaagagagaacucucugccaaacccauccagagaguugagccuugcacaaccuguauaaccaaaugugagccucauggauugguuguccgaucaacaggguucaagauaucaucugcaguugcaugugcuagcggaguuugugucacaggaucgcagaguccuucuaccgagaucacacucaaguauccagggauaucccaguccucugggggggacauagggguucacauggcacacgaugaucagucaguuagcuccaaaauaguagcucacugccccccccaggacccgugccuagugcauggcugcauagugugugcucauggccuaauaaauuaccagugucacacugcucucagugccuuuguuguuguguucguauucagcucuguugcaauaauuuguuuggccauucuuuauaaggugcucaagugccuaaagauugccccaaggaaaguucuaaauccacuaauguggauuacugccuucaucagauggguguauaagaagaugguugccaggguggcagacaauauuaaucaagugaacagagaaauaggauggauggagggaggucaguuggcucuagggaacccugccccuauuccucgucaugccccaauuccacguuauagcacauaccugaugcuacuauugauugucucauaugcaucagcauguucagaacugauucaggcaagcucuagaauaaccacuugcuccacagaaggugucaacaccaaguguaggcugucuggcacagcauuaaucagggcagggucaguuggggcagaggcuugcuugauguuaaagggagucaaggaggaccaaacaaaguucuugaagauaaaaacugucucaagugagcuaucgugcagggaaggccagagcuauuggacuggauccuuuagucccaaaugucugagcucaaggagaugccaucuugucggggaaugucaugugaauaggugucugucuuggagggacaaugaaacuucagcagaguuuucauuuguuggggaaagcacgacuaugcgagagaauaaauguuuugagcagugugggggauggggaugugggugcuucaaugugaacccaucuugcuuguuugugcacacguaucugcagucaguuagaaaagaggcccuuagaguuuuuaacuguaucgauugggugcauaaacucacucuagagaucacagacuuugaugguucuguuucaacaauagacuugggagcaucaucuagccguuucacaaacuggggcucaguuagccucucacuggaugcagagggcauuucaggcucaaauagcuuuucuuucauugagagcccaggcaaaggguaugcaauuguugaugagccauucucagaaaucccucggcaaggguucuugggggagaucaggugcaauucagaaucuucaguccugagugcucaugaaucaugccuucgggcaccaaaccucaucucauacaagcccaugauagaccaguuggagugcacaacaaaucugauugaucccuuuguugucuuugagagggguucucugccucagacaaggaaugauaaaacuuuugcagcuucaaaaggaaauagggguguucaagcuuucucuaagggcucuguacaagcugauuuaacucugauguuugacaauuuugagguggacuuugugggagcagccgugucuugugaugccgcuuucuuaaaucugacagguuguuauucuuguaaugcaggggccagagucugccugucuaucacauccacaggaacuggaacucucucugcccacaauaaggaugggucucugcauauaguucuuccaucagagaauggaacaaaagaucagugucagauacuacacuucacuguaccugagguagaggaggaguuuauguacucuugugauggagaugagcggccucuguuggugaaggggacccugaucgccauugauccauuugaugacaggcgggaagcagggggagaaucaacaguugugaauccaaaaucuggaucuuggaauuucuuugacugguuuucuggacucaugaguugguuuggagggccucuuaagacuauacuccucauuugccuguauguugcauuaucaauugggcucuuuuuccuucucauauaucuuggaagaacaggucucucuaaaauguggcuugcugcuacuaagaaggccucauaa

SEQ ID NO: 4354 - RNA, 3594 nt, Artificial Sequence
  derived and/or modified CDS sequence (wt) from RVFV(Sudan 86-2010)__JQ820489.1__GP
auguauguuuuauugacaauucuaaucucgguucuggugugugaagcgguuauuagagugucucuaagcuccacaagagaggagaccuguuuuggugacuccaccaacccagagaugauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcgaguggggauaguccggugugagagacgaagagaugcuaagcaaauagggagagaaaccauggcagggauugcgaugacaguccuuccagccuuagcaguuuuugcuuuggcaccuguugucuuugcugaagacccccaucucagaaacagaccagggaaaggacacaacuacauugacgggaugacucaggaggaugccacaugcaaaccugugacauaugcuggggcauguagcaguuuugaugucuugcuugaaaaggggaaauuuccccuuuuccagucauaugcucaucauagaacccuacuagaggcaguucacgacaccaucauugcaaaggcugauccaccuagcugugaccuccagagugcucaugggaaucccuguaugaaagagaaacuugugaugaagacacauuguccaaacgacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggaugcagcauuuugcucugcuuaugaauguacugcucaguaugccaaugccuauuguucacaugcuaaugggucagggauugugcagauucaaguaucaggggucuggaagaaaccuuuaugugugggguaugagagagugguugugaagagagaacucucagccaaacccauccagagaguugagccuugcacaacuugcauaaccaaaugugagccucauggauugguuguccgaucaacaggguucaagauaucaucugcaguugcuugugcuagcgggguuugcgucacagggucgcaaaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguuguuguauuuguauucaguucuauugcaauaauuugcuuagcuauucuuuauaggguacucaagugccuaaagauugccccaaggaaaguucugaauccacuaauguggauuacagccuucaucagauggguguauaagaagaugguugcuagaguggcggacaauauuaaucaagugaacagagaaauaggauggauggaaggaggucaguugguucuagggaacccugccccuauuccucgucaugccccaaucccacguuauagcacauaccuaaugcuacuacugauugucucauaugcaucagcauguucagaacugauucaggcaaguuccagaaucaccacuugcuccacagagggugucaacaccaaguguagacugucuggcacagcauugaucagggcagggucaguuggggcggaggcuuguuugauguugaagggggucaaggaagaucaaaccaaguucuuaaagauaaaaacugucucaagugagcuaucgugcagggagggccagagcuauuggacuggguccuucagccccaagugccugagcucaaggagaugccaucuugucggggaaugucaugugaauaggugucuguccuggagggacaaugaaacuucagcagaguuuucauuuguuggggaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucguacaagcccaugauagaucaauuggagugcacuacaaaucugauugaucccuuuguuaucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaaucugacagguugcuauucuugcaaugcaggggccagaguuugccugucuaucacauccacaggaacugggacucucucugcccacaauaaggacgggucucugcauauaguucucccaucagagaaugggacaaaagaucagugucagauacuacauuucaccguaccugaaguagaagaggaguuuauguacucuugugauggagaugagcggccucuguuagugaaagggacccugauagcuauugacccauuugaugauaggcgggaggcugggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugcugcuacuaagaaggccucauag

SEQ ID NO: 4355 - RNA, 3594 nt, Artificial Sequence
  derived and/or modified CDS sequence (wt) from RVFV(T-46 (228113))__DQ380199.1__GP
auguauguuuuauuaacaauucuaaucucgguucuggugugugaagcgguuauuagagugucucuaagcuccacaagagaagagaccugcuuuggugacuccacuaacccagagaugauugaaggagcuugggauucacucagagaggaggagaugccggaggagcucuccuguucuauaucaggcauaagagagguuaagaccucaagccaggaguuauacagggcauuaaaagccaucauugcugcugauggcuugaacaacaucaccugccaugguaaggauccugaggacaagauuucccucauaaaggguccuccucacaaaaagcggguggggauaguucggugugagagacgaagagaugcuaagcaaauagggagagaaaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucagagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaaaggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguuguuguguuuguauucaguucuauugcaauaauuuguuuagcuguucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcaucucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugauaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccucauag

SEQ ID NO: 4356 - RNA, 3594 nt, Artificial Sequence
  derived and/or modified CDS sequence (wt) from RVFV(2007000094)__EU574055.1__GP
auguauguuuuauugacaauucuaaucucgguucuggugugugaagcgguuauuagagugucucuaagcuccacaagagaggagaccuguuuuggugacuccaccaacccagagaugauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcgaguggggauaguccggugugagagacgaagagaugcuaagcaaauagggagagaaaccauggcagggauugcgaugacaguccuuccagccuuagcaguuuuugcuuuggcaccuguugucuuugcugaagacccccaucucagaaacagaccagggaaaggacacaacuacauugacgggaugacucaggaggaugccacaugcaaaccugugacauaugcuggggcauguagcaguuuugaugucuugcuugaaaaggggaaauuuccccuuuuccagucauaugcucaucauagaacucugcuagaggcaguucaugacaccaucauugcaaaggcugauccaccuagcugugaccuccagagugcucaugggaaucccuguaugaaagagaaacuugugaugaagacacauuguccuaacgacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggaugcagcauuuugcucugcuuaugaauguacugcucaguaugccaaugccuauuguucacaugcuaaugggucagggauugugcagauucaaguaucaggggucuggaagaaaccuuuaugugugggguaugagagagugguugugaagagagaacucucagccaaacccauccagagaguugagccuugcacaacuugcauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguuguuguauuuguauucaguucuauugcaauaauuugcuuagcuauucuuuauagggugcucaagugccuaaagauugccccaaggaaaguucugaauccacuaauguggauuacagccuucaucagauggguguauaagaagaugguugcuagaguggcggacaauauuaaucaagugaacagagaaauaggauggauggaaggaggucaguugguucuagggaaccccgccccuauuccucgucaugccccaaucccacguuauagcacauaccuaaugcuacuacugauugucucauaugcaucagcauguucagaacugauucaggcaagcuccagaaucaccacuugcuccacagagggugucaacaccaaguguagacugucuggcacagcauugaucagggcagggucaguuggggcggaagcuuguuugauguugaagggggucaaggaagaucaaaccaaguucuuaaagauaaaaacugucucaagugagcuaucgugcagggagggccagagcuauuggacuggguccuuuagccccaagugccugagcucaagaagaugccaucuugucggggaaugucaugugaauaggugucuguccuggagggacaaugaaacuucagcagaguuuucauuuguuggggaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauaguuuuucuuuuauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccugucuaucacauccacaggaacugggacucucucugcccacaauaaggacgggucucugcauauaguucucccaucagagaaugggacaaaagaucagugucagauacuacauuucacuguaccugaaguagaagaggaguuuauguacucuugugauggagaugagcggccucuguuagugaaagggacccugauagcuauugacccauuugaugauaggcgggaggcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugcugcuacuaagaaggccucauag

SEQ ID NO: 4357 - RNA, 3594 nt, Artificial Sequence
  derived and/or modified CDS sequence (wt) from RVFV(ZC-3349)__DQ380207.1__GP
auguauguuuuauuaacaauucuaaucucgguucuggugugugaagcgguuauuagagugucucuaagcuccacaagagaagagaccugcuuuggugacuccacuaacccagagaugauugaaggagcuugggauucacucagagaggaggagaugccggaggagcucuccuguucuauaucaggcauaagagagguuaagaccucaagccaggaguuauacagggcauuaaaagccaucauugcugcugauggcuugaacaacaucaccugccaugguaaggauccugaggacaagauuucccucauaaaggguccuccucacaaaaagcggguggggauaguucggugugagagacgaagagaugcuaagcaaauagggagagaaaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucagagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuacuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucaggcaguuagcuccaaaauaguagcucacugcccuccccaggacccgugcuuagugcauggcugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuuuaucagauggauauauaagaagaugguugccagaguggcagacaacauuaaucacgugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuaaggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccuaucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaaccauacuccucauuugccuguauguugcauuaucaauugggcucuuuuuccuccuuauauaucuuggaagaacaggccucucuaaaauguggcuugcugccacuaagaaggccucauag

SEQ ID NO: 4358 - RNA, 3594 nt, Artificial Sequence
  derived and/or modified CDS sequence (wt) from RVFV(2007001602)__EU574043.1__GP
auguauguuuuauugacaauucuaaucucgguucuggugugugaagcgguuauuagagugucuauaagcuccacaagagaggaaaccuguuuuggugacuccaccaacccagagaugauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcggguggggauaguccggugugagagacgaagagaugcuaagcaaauagggagagaaaccauggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaacgcaggggccagagucugccuguccaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4359 - RNA, 3594 nt, Artificial Sequence
  derived and/or modified CDS sequence (wt) from RVFV(1260/78)__DQ380214.1__GP
auguauguuuuauuaacaauucuaaucucgguucuggugugugaagcgguuauuagagugucucuaagcuccacaagagaagagaccugcuuuggugacuccaccaacccagagaugauugaaggagcuugggauucacucagagaggaggagaugccagaggagcucuccuguucuauaucaggcauaagagagguuaagaccucaagccaggaguuauacagggcauuaaaagccaucauugcugcugauggcuugaacaacaucaccugccaugguaaggauccugaggacaagauuucucucauaaaggguccuccucacaaaaagcgggugggaauaguucggugugagagacgaagagaugcuaagcaaauagggagagaaaccauggcagggauugcaaugacaguccuuccagccuuagcaguuuuugcucuagcaccuguuguuuuugcugaagacccccaucucagaaacagaccggggaaggggcacaacuacauugacgggaugacucaggaggaugccacaugcaaaccugugacauaugcuggggcauguagcaguuuugaugucuugcuugaaaaagggaaauuuccccucuuccagucguaugcucaucauagaacucuacuagaggcaguucacgacaccaucauugcaaaggcugauccaccuagcugugaccuucagagugcucaugggaaucccugcaugaaagagaaacucgugaugaagacacacuguccaaaugacuaccagucagcucauuaccucaacaaugacgggaaaauggcuucagucaagugcccuccuaaguaugagcucacagaggacugcaacuuuuguaggcagaugacaggugcuagccugaagaaggggucuuauccucuccaagacuuauuuugucagucaagugaggacgauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcacaagggacaguauaagggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugcuuauuguucacaugcuaaugggucagggauugugcaaauacaaguaucaggggucuggaagaagccuuuauguguaggguaugagagagugguuguaaagagagaacucucugccaagcccauccagagaguugagccuugcacaacuuguauaaccaaaugugagccucauggauugguuguccgaucaacaggguucaaaauaucaucugcaguugcuugugcuagcggaguuugcgucacaggaucgcagaguccuuccaccgagauuacacucaaguauccagggauaucccaguccucugggggggacauagggguucacauggcacaugaugaccagucaguuagcuccaaaauaguagcucacugcccuccccaggacccgugcuuagugcauggcugcauagugugugcucauggccugauaaauuaccagugucacacugcucucagugccuuuguuguuguguuuguguucaguucuauugcaauaauuuguuuagcuauucuucauagggugcucaagugcuuaaagauugccccaaggaagguucugaauccacuaauguggauuacagccuucaucagauggguguauaagaagaugguugccagaguggcagacaauauuaaucaagugaacagggaaauaggauggauggaaggaggucaguugguucuagggaacccugccccuauuccucgccaugccccaauuccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuugucugauguugaagggggucaaggacgaucaaaccaaguucuuaaagauaaaaacugucucaagugagcuaucgugcagggagggccagagcuauuggacuggguccuuuagcccuaaaugucugagcucaaggagaugccaucuugucggggaaugucaugugaauaggugucugucuuggagggacaaugaaacuucagcagaguuuucauuuguuggggaaagcacgaccaugcgggagaauaaguguuuugagcaguguggaggauggggauguggguguuucaaugugaacccaucuugcuuauuugugcacacguaucugcagucaguuagaaaagaggcccuuagaguuuuuaacuguaucgacugggugcauaaacucacacuagagaucacagacuuugauggcucuguuucaacaauagaccugggggcaucaucuagccguuucacaaacugggguucaguuagccucucacuggacgcagagggcauuucaggcucaaauagcuuuucuuucauugaaagcccaggcaaaggauaugcaauuguugaugagccauucucagaaauuccucgacaaggguuccugggggagaucaggugcaauucagaguccucaguccugagugcucaugaaucaugccuuagggcaccaaaccuuaucucauacaagcccaugauagaccaauuggagugcacaacgaaucugauugaucccuuuguugucuuugagagggguucucugccacagacaaggaaugacaaaaccuuugcagcuucaaaaggaaauagagguguccaagcuuucucuaagggcucuguacaagcugaucuaacucugauguuugacaauuuugagguggacuuugugggagcagccguaucuugugaugccgccuuccuaaauuugacagguugcuauucuugcaaugcaggggccagggucugccugucuaucacauccacaggaacuggaacccucucugcccacaauaaggaugggucucugcauauaguucuuccaucagagaauggaacaaaagaucaaugccagauacuacacuucacuguaccugagguagaggaggaguuuauguacucuugugacggagaugagcggccucuguuggugaaggggacccugauagcuauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccucauauaucuuggaagaacaggccucucuaaaauguggcuugccgcuacuaagaaggccucauag

SEQ ID NO: 4360 - RNA, 3594 nt, Artificial Sequence
  derived and/or modified CDS sequence (wt) from RVFV(2007000324)__JF326195.1__GP
auguauguuuuauugacaauucuaaucucgguucuggugugugaagcgguuauuagagugucucuaagcuccacaagagaggaaaccuguuuuggugacuccaccaacccagagaugauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcggguggggauaguccggugugagagacgaagagaugcuaagcaaauagggagagaaaccauggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaagggaauagagguguucaggcuuucucuaagggcucuguacaagcugaucugacucugauguuugauaauuuugagguggacuuugugggagcagccgugucuugugaugccgccuucuugaauuugacagguugcuauucuugcaacgcaggggccagagucugccuguccaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4361 - RNA, 3594 nt, Artificial Sequence
  derived and/or modified CDS sequence (wt) from RVFV(KEN/Gar-Msq/131B-04/06)__HM586972.1__GP
auguauguuuuauugacaauucuaaucucgguucuggugugugaagcgguuauuagagugucucuaagcuccacaagagaggaaaccuguuuuggugacuccaccaacccagagaugauugaaggagcuugggauucauuuagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcggguggggauaguccggugugagagacgaagagaugcuaagcaaauagggagagaaaccauggcagggauugcgaugacaguccuuccagccuuagcaguuuuugcuuuggcaccuguuguuuuugcugaagacccccaucucagaaacagaccagggaaggggcacaacuacauugacggaaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggauaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccugucuaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4362 - RNA, 3594 nt, Artificial Sequence
  derived and/or modified CDS sequence (wt) from RVFV(2007004194)__EU574031.1__GP
auguauguuuuauugacaauucuaaucucgguucuggugugugaagcgguuauuagagugucucuaagcuccacaagagaggagaccuguuuuggugacuccaccaacccagagaugauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcgaguggggauaguccggugugagagacgaagagaugcuaagcaaauagggagagaaaccauggcagggauugcgaugacaguccuuccagccuuagcaguuuuugcuuuggcaccuguugucuuugcugaagacccccaucucagaaacagaccagggaaaggacacaacuacauugacgggaugacucaggaggaugccacaugcaaaccugugacauaugcuggggcauguagcaguuuugaugucuugcuugaaaaggggaaauuuccccuuuuccagucauaugcucaucauagaacucugcuagaggcaguucaugacaccaucauugcaaaggcugauccaccuagcugugaccuccagagugcucaugggaaucccuguaugaaagagaaacuugugaugaagacacauuguccuaacgacuaccagucagcucauuaccucagcaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggaugcagcauuuugcucugcuuaugaauguacugcucaguaugccaaugccuauuguucacaugcuaaugggucagggauugugcagauucaaguaucaggggucuggaagaaaccuuuaugugugggguaugagagagugguugugaagagagaacucucagccaaacccauccagagaguugagccuugcacaacuugcauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguuguuguauuuguauucaguucuauugcaauaauuugcuuagcuauucuuuauagggugcucaagugccuaaagauugccccaaggaaaguucugaauccacuaauguggauuacagccuucaucagauggguguauaagaagaugguugcuagaguggcggacaauauuaaucaagugaacagagaaauaggauggauggaaggaggucaguugguucuagggaaccccgccccuauuccucgucaugccccaaucccacguuauagcacauaccuaaugcuacuacugauugucucauaugcaucagcauguucagaacugauucaggcaagcuccagaaucaccacuugcuccacagagggugucaacaccaaguguagacugucuggcacagcauugaucagggcagggucaguuggggcggaagcuuguuugauguugaagggggucaaggaagaucaaaccaaguucuuaaagauaaaaacugucucaagugagcuaucgugcagggagggccagagcuauuggacuggguccuuuagccccaagugccugagcucaagaagaugccaucuugucggggaaugucaugugaauaggugucuguccuggagggacaaugaaacuucagcagaguuuucauuuguuggggaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauaguuuuucuuuuauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccugucuaucacauccacaggaacugggacucucucugcccacaauaaggacgggucucugcauauaguucucccaucagagaaugggacaaaagaucagugucagauacuacauuucacuguaccugaaguagaagaggaguuuauguacucuugugauggagaugagcggccucuguuagugaaagggacccugauagcuauugacccauuugaugauaggcgggaggcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugcugcuacuaagaaggccucauag

SEQ ID NO: 4363 - RNA, 3594 nt, Artificial Sequence
  derived and/or modified CDS sequence (wt) from RVFV(73HB1230)__DQ380221.1__GP
auguauguuuuauuaacaauucuaaucucgguucuagugugugaagcgguuauuagagugucucuaagcuccacaagagaagagaccuguuuuggugacuccaccaacccagagaugauugaaggagcuugggauucgcucagagaggaggagaugccagaggagcucuccuguucuauaucaggcauaagggagguuaagaccucaagccaggaguuguacagggcauuaaaagccaucauugcugcugauggcuugaacaacaucaccugccaugguaaggauccugaggacaagauuucucucauaaaggguccuccucacaaaaagcggguggggauaguucggugugagagacgaagagaugcuaagcaaguagggagagaaaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaaggggaaauuuccccuuuuccagucguaugcucaucauagaacucuacuagaggcaguucacgacaccaucauugcaaaggcugauccaccuagcugugaccuucagagugcucaugggaaucccugcaugaaagagaaacucgugaugaagacacacuguccaaaugacuaccagucagcucauuaccucaacaaugacgggaaaauggcuucagucaagugcccucccaaguaugagcucacugaggacugcaacuuuuguaggcagaugacaggugcuagccugaagaaggggucuuauccucuccaagacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcauaagggacaguauaaaggaacaauggacucuggucagacuaagaaggagcucaaaagcuuugauaucucucagugccccaagauuggaggacaugguaguaagaagugcacuggggacgcagcauuuugcucugcuuaugagugcacugcucaguacgccaaugccuauuguucgcaugcuaaugguucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucugcaguugcuugugcuagcggaguuugcgucacaggaucgcagaguccuucuaccgagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguuguuguguuuguauucaguucuauugcaauaauuuguuuagcuauucuuuauagggugcucaagugccuaaagauugcuccaaggaaaguucugaauccacuaauguggauuacagccuucaucagauggguguauaagaagaugguugcuagaguggcagacaauauuaaucaagugaacagggaaauaggauggauggaaggaggucaguugguccuagggaacccugccccuauuccucgucaugccccaaucccacguuauagcacauaccuaaugcuacuauugauugucucauaugcaucagcauguucagaacugauucaggcaagcuccagaaucaccacuugcuccacagaggguguuaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaaaugucugagcucaaggagaugccaucuuguuggagagugucaugugaauaggugucugucuuggagggacaaugaaacuucagcagaguuuucauuuguuggggaaagcacgaucaugcgagagaauaaguguuuugagcaguguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacgacaaaucugauugaucccuuuguugucuuugagagggguucucugccacagacaaggaaugacaaaaccuuugcagcuucaaaaggaaauagagguguucaagcuuucucuaagggcucuguacaagcugaucuaacucugauguuugacaauuuugagguggacuuugugggagcagcuguaucuugugaugccgccuucuuaaauuugacagguugcuauucuugcaaugcaggggccagggucugccugucuaucacauccacaggaacuggaacucucucugcccacaauaaggaugggucucugcauauaguucuuccaucagagaauggaacaaaagaucagugucagauacuacacuucacuguaccugaaguagaggaggaguuuauguacucuugugauggagaugagcggccucuguuggugaaagggacccugauagcuauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugucuguauguugcauuaucaauugggcucuuuuuccuccuuauauaucuuggaagaacaggccucucuaaaauguggcuugcugcuacuaagaaggccucauag

SEQ ID NO: 4364 - RNA, 3594 nt, Artificial Sequence
  derived and/or modified CDS sequence (wt) from RVFV(73HB1449)__DQ380211.1__GP
auguauguuuuauuaacaauucuaaucucgguucuggugugugaagcgguuauuagagugucucuaagcuccacaagagaagagaccugcuuuggugacuccaccaacccagagaugauugaaggagcuugggauucacucagagaggaggagaugccagaggagcucuccuguucuauaucaggcauaagagagguuaagaccucaagccaggaguuauacagggcauuaaaagccaucauugcugcugauggcuugaacaacaucaccugccaugguaaggauccugaggacaagauuucucucauaaaggguccuccucacaaaaagcggguggggauaguucggugugagagacgaagagaugcuaagcaaauagggagagaaaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaaggggaaauuuccccucuuccagucguaugcucaucauagaacucuacuagaggcaguucacgacaccaucauugcaaaggcugauccaccuagcugugaccuucagagugcucaugggaaucccugcaugaaagagaaacucgugaugaagacacacuguccaaaugacuaccagucagcucauuaccucaacaaugacgggaaaauggcuucagucaagugcccuccuaaguaugagcucacagaggacugcaacuuuuguaggcagaugacaggugcuagccugaagaaggggucuuauccucuccaagacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcacaagggacaguauaagggaacaauggacucuggucagacuaagagggagcucaaaagcuuugauauuucucagugccccaagauuggaggacaugguaguaagaagugcacuggggacgcagcauuuugcucugcuuaugagugcacugcucaguaugccaaugcuuauuguucacaugcuaaugggucagggauugugcagauacaaguaucaggggucuggaagaagccuuuauguguaggguaugagagagugguugugaagagagaacucucugccaagcccauccagaggguugagccuugcacaacuuguauaaccaaaugugagccucauggauugguuguccgaucaacaggguucaagauaucaucugcaguugcuugugcuagcggaguuugcgucacaggaucgcagaauccuuccaccgagaucacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugccacacugcucucagugccuuuguuguuguguucguguucaguucuauugcaauaauuuguuuagcuauucuuuauagggugcucaagugccuaaagauugccccaaggaaaguucugaauccacuaauguggauuacagccuucaucagauggguguauaagaagaugguugccagaguggcagacaauauuaaucaagugaauagggaaauaggauggauggaaggaggucaguugguccuagggaacccugccccuauuccucgccaugccccaauuccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuugucugauguugaagggggucaaggacgaucaaaccaaguucuuaaagauaaaaacugucucaagugagcuaucgugcagggagggccagagcuauuggacuggguccuuuagccccaaaugucugagcucaaggagaugccaucuugucggggaaugucaugugaauaggugucugucuuggagggacaaugaaacuucagcagaguuuucauuuguuggggaaagcacgaccaugcgagagaauaaguguuuugagcaguguggaggauggggauguggguguuucaaugugaacccaucuugcuuauuugugcacacguaucugcagucaguuagaaaagaggcccuuagaguuuuuaacuguaucgacugggugcauaaacuaacacuagagaucacagacuuugauggcucuguuucaacaauagaccuaggagcaucaucuagccguuucacaaacugggguucagucagccucucacuggacgcagagggcauuucaggcucaaauagcuuuucuuucauugagagcccaggcaaaggguaugcaauuguugaugagccauucucagaaauuccucggcaaggguuccugggggagaucaggugcaauucagaguccucaguccugagugcucaugaaucaugccuuagggcaccaaaccuuaucucauacaagcccaugauagaccaauuggagugcacaacgaaucugauugauccauuuguugucuuugagagggguucucugccacagacaaggaaugaaaaaaccuuugcagcuucaaaaggaaauagagguguccaagccuucucuaagggcucuguacaagcugaucuaacucugauguuugacaauuuugagguggauuuugugggagcagccguaucuugugaugccgccuucuuaaauuugacagguugcuauucuugcaaugcaggggccagggucugccugucuaucacauccacaggaacuggaacucucucugcccacaauaaggaugggucucugcauauaguucuuccaucagagaauggaacaaaagaucaaugccagauacuacacuucacuguaccugagguagaggaggaguuuauguacucuugugacggagaugagcggccucuguuggugaaggggacccugauagcuauugauccauuugaugauaggcgggaagcagggggggaaucaacaguugugaauccaaaaucuggaucuuggaauuucuuugacugguuuucuggacucaugaguugguuuggagggccucuuaaaacuauacuccuuauuugccuguauguugcauuaucaauugggcucuuuuuccuccucauauaucuuggaagaacaggccucucuaaaauguggcuugcugcuacuaagaaggccucauag

SEQ ID NO: 4365 - RNA, 3594 nt, Artificial Sequence
  derived and/or modified CDS sequence (wt) from RVFV(ZH-548M12)__M25276.1__GP
auguauguuuuauuaacaauucuaaccucgguucuggugugugaagcgauuauuagagugucucuaagcuccacaagagaagagaccugcuuuggugacuccacuaacccagagaugauugaaggagcuugggauucacucagagaggaggagaugccggaggagcucuccuguucuauaucaggcauaagagagguuaagaccucaagccaggaguuauacagggcauuaaaagccaucauugcugcugauggcuugaacaacaucaccugccaugguaaggauccugaggacaagauuucccucauaaaggguccuccucacaaaaagcggguggggauaguucggugugagagacgaagagaugcuaagcaaauagggagaaaaaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucaucaccucaacaaugacgggaaaauggcuucagucaagugcccuccuaaguaugagcucacugaagacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaaguuaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaggaacaggccucucuaaaauguggcuugcugccacuaagaaggccucauag

SEQ ID NO: 4366 - RNA, 3594 nt, Artificial Sequence
  derived and/or modified CDS sequence (wt) from RVFV(ZINGA J83 R1)__KU978776.1__GP
auguauguuuuauuaacaauucuaaucucgguucuggugugugaagcgguuauuagagugucucuaagcuccacaagagaagagaccuguuuuggugacuccaccaacccagagaugauugaaggagcuugggauucacucagagaggaggagaugccagaggagcucuccuguucuauaucaggcauaagggagguuaagaccucaagccaggaguuauacagggcauuaaaagccaucauugcugcugauggcuugaacaacaucaccugccaugguaaggauccugaggacaagauuucucucauaaaggguccuccucauaaaaagcggguggggauaguucggugugagagacgaagagaugcuaagcaaauagggagagaaaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugagaaggggaaauucccccuuuuccagucguaugcucaucauagaacucuacuagaggcaguucacgacaccaucauugcaaaggcugauccaccuagcugugaccuucagagugcucaugggaaucccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcugaugacaggugcuagccugaagaaggggucuuauccucuccaggacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaccuugauaagcuugaccucaagacugaggagaaucugcuaccagacucauuugucugcuucgagcauaagggacaguauaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagaguaguugugaagagagaacucucugccaagcccauccagagaguugagccuugcacaacuuguauaaccaaaugugagccucauggguugguuguccgaucaacaggguucaagauaucaucugcaguugcuugugcuagcggaguuugcgucacaggaucgcagaguccuuccaccgagauuacacucaaguauccagggauaucccaguccucuggaggggacauagggguucacauggcacacgaugaucagucaguuagcuccaaaauaguagcucacugcccuccccaggacccgugcuuagugcacggcugcauagugugugcucauggccugauaaauuaccagugucacacugcucucagugccuuuguuguuguguuuguauucaguucuauugcaauaauuuguuuagcuauucuuuauagggugcucaagugccuaaagauugccccaaggaaaguucugaauccacuaauguggauuacagccuucaucagauggguguauaggaagaugguugccagaguggcagacaauauuaaucaagugaacagggagauaggauggauggaaggaggucaguugguucuagggaacccugccccuauuccucgucauguuccaauuccacguuauagcacauaccuaaugcuacuacugauugucucauaugcaucagcauguucagaacugauucaggcaagcuccagaaucacuacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaaaugucugagcucaaggagaugccaucuugucggggaaugucaugugaauaggugucugucuuggagggacaaugaaacuucagcagaguuuucauuuguuggagaaagcacgaccaugcgagagaauaaguguuuugagcaguguggaggauggggauguggguguuucaaugugaacccaucuugcuuauuugugcacacguaucugcagucaguuagaaaagaggcccuuagaguuuuuaacuguaucgacugggugcauaaacucacucuggagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugagucaugccuuagggcaccaaaccuuaucucauacaagcccaugauagaucaauuggagugcacaacaaaucugauugaccccuuuguuguauuugagagggguucucugccacagacaaggaaugacaaaaccuuugcugcuucaaaaggaaauagagguguucaagcuuucucuaagggcucugugcaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaacucucucugcccacaauaaggaugggucucugcauauaguucuuccaucagagaauggaacaaaagaucagugucagauacuacacuucacuguaccugaaguagaggaggaguuuauguacucuugugauggagaugagcggccucuauuggugagggggacucugauagcuauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugcuuguauguugcauuaucaauugggcucuuuuuccuccucauauaucuuggaagaacaggccucucuaaaauguggcuugcugcuacuaagaaggccucauag

SEQ ID NO: 4367 - RNA, 3594 nt, Artificial Sequence
  derived and/or modified CDS sequence (wt) from RVFV(Sudan 28-2010)__JQ820491.1__GP
auguauguuuuauugacaauucuaaucucgguucuggugugugaagcgguuauuagagugucucuaagcuccacaagagaggagaccuguuuuggugacuccaccaacccagagaugauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcgaguggggauaguccggugugagagacgaagagaugcuaagcaaauagggagagaaaccauggcagggauugcgaugacaguccuuccagccuuagcaguuuuugcuuuggcaccuguugucuuugcugaagacccccaucucagaaacagaccagggaaaggacacaacuacauugacgggaugacucaggaggaugccacaugcaaaccugugacauaugcuggggcauguagcaguuuugaugucuugcuugaaaaggggaaauuuccccuuuuccagucauaugcucaucauagaacucuacuagaggcaguucacgacaccaucauugcaaaggcugauccaccuagcugugaccuccagagugcucaugggaaucccuguaugaaagagaaacuugugaugaagacacauuguccaaacgacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaaaacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggaugcagcauuuugcucugcuuaugaauguacugcucaguaugccaaugccuauuguucacaugcuaaugggucagggauugugcagauucaaguaucaggggucuggaagaaaccuuuaugugugggguaugagagagugguagugaagagagaacucucagccaaacccauccagagaguugagccuugcacaacuugcauaaccaaaugugagccucauggauugguuguccgaucaacaggguucaagauaucgucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguuguuguauuuguauucaguucuauugcaauaauuugcuuagcuauucuuuauagggugcucaagugccuaaagauugccccaaggaaaguucugaauccacuaauguggauuacagccuucaucagauggguguauaagaagaugguugcuagaguggcggacaauauuaaucaagugaacagagaaauaggauggauggaaggaggucaguugguucuagggaaccccgccccuauuccucgucaugccccaaucccacguuauagcacauaccuaaugcuacuacugauugucucauaugcaucagcauguucagaacugauucaggcaagcuccagaaucaccacuugcucuacagagggugucaacaccaaguguagacugucuggcacagcauugaucagggcagggucaguuggggcggaggcuuguuugauguugaagggggucaaggaagaucaaaccaaguucuuaaagauaaaaacuguuucaagugagcuaucgugcagggagggccagagcuauuggacuggguccuuuagccccaagugccugagcucaagaagaugccaucuugucggagaaugucaugugaauaggugucuguccuggagggacaaugaaacuucagcagaguuuucauuuguuggggaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauaguuuuucuuuuauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccugucuaucacauccacaggaacugggacucucucugcccacaauaaggacgggucucugcauauaguucucccaucagagaaugggacaaaagaucagugucagauacuacauuucacuguaccugaaguagaagaggaguuuauguacucuugugauggagaugagcggccucuguuagugaaagggacccugauagcuauugacccauuugaugauaggcgggaggcagggggggaaucaacaguugugaauccaaaaucuggaucuuggaauuucuuugacugguuuucuggacucaugaguugguuuggagggccgcuuaaaacuauacuccucauuugccuguauguuguauuaucaauugggcucuucuuccuccuuauauaucuuggaagaacaggccucucuaaaauguggcuugcugcuacuaagaaggccucauag

SEQ ID NO: 4368 - RNA, 3594 nt, Artificial Sequence
  derived and/or modified CDS sequence (wt) from RVFV(2007001292)__EU574046.1__GP
auguauguuuuauugacaauucuaaucucgguucuggugugugaagcgguuauuagagugucucuaagcuccacaagagaggaaaccuguuuuggugacuccaccaacccagagaugauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcggguggggauaguccggugugagagacgaagagaugcuaagcaaauagggagagaaaccauggcagggauugcgaugacaguccuuccagccuuagcaguuuuugcuuuggcaccuguuguuuuugcugaagacccccaucucagaaacagaccagggaaggggcacaacuacauugacggaaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggauccuuuagccccaagugccugagcucaaggagaugccaucuugucggggaaugucaugugaauaggugucugucuuggagggauaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccugucuaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaaucucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4369 - RNA, 3594 nt, Artificial Sequence
  derived and/or modified CDS sequence (wt) from RVFV(Sudan 85-2010)__JQ820488.1__GP
auguauguuuuauugacaauucuaaucucgguccuggugugugaagcgguuauuagagugucucuaagcuccacaagagaggagaccuguuuuggugacuccacuaacccagagaugauugaaggagcuugggauucacucagagaggaggagaugccagaggaacucuccugcucuguaucaggcauaagggagguuaagaccucaagccaggaguuauacagagcauuaaaagccaucauugcugcugauggccugaacaacaucaccugccaugguaagaauccugaggacaagauuucucucauaaagggcccuccucacaaaaagcggguggggauaguucggugugagagacgaagagaugcuaagcaaauagggagagaaaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauugcccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaagaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaaugggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucacagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucguauuuguauucaguucuauugcaauaauuugcuuagccauucuuuauagggugcucaagugcuuaaagauugccccaaggaaaguucugaauccacuaauguggauuacagccuucaucagauggguguauaagaagaugguugcuagaguggcagacaauauuaaucaagugaacagagaaauaggauggauggaaggaggucaguugguucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaagaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaacaaguguuuugagcaguguggaggauggggguguggaugcuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacuggggcucaguuagccucucacuggacgcagagggcauuucaggcucaaauagcuuuucuuuuauugagagcccaggcaaaggguaugcaauuguugaugagccauucucagagaucccucggcaaggguucuugggggagauuagguguaauucagaguccucaguccugagugcucaugaaucaugccuuagggcaccaaaccuuaucucguacaagcccaugauagaucaauuggagugcacuacaaaucugauugaucccuuuguugucuuugagagggguucucugccacagacaaggaaugaaaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccugucuaucacauccacaggaacuggaacucucucugcccacaacaaggacgggucucugcauauaguucucccaucagagaaugggacaaaagaucagugucagauacuacauuucacuguaccugaaguagaagaggaguucauguacucuugugauggagaugagcggccucuguuagugaaagggacccugauagcuauugacccauuugaugauaggcgggaagcagggggggaaucaacaguugugaauccaaaaucuggaucuuggaacuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4370 - RNA, 3594 nt, Artificial Sequence
  derived and/or modified CDS sequence (wt) from RVFV(2007002060)__EU574039.1__GP
auguauguuuuauugacaauucuaaucucgguucuggugugugaagcgguuauuagagugucucuaagcuccacaagagaggaaaccuguuuuggugacuccaccaacccagagaugauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcggguggggauaguccggugugagagacgaaaagaugcuaagcaaauagggagagaaaccauggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugauuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccuguccaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4371 - RNA, 3594 nt, Artificial Sequence
  derived and/or modified CDS sequence (wt) from RVFV(2007002476)__EU574036.1__GP
auguauguuuuauugacaauucuaaucucgguucuggugugugaagcgguuauuagagugucucuaagcuccacaagagaggaaaccuguuuuggugacuccaccaacccagagaugauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcggguggggauaguccggugugagagacgaagagaugcuaagcaaauagggagagaaaccauggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucaaauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaacgcaggggccagagucugccuguccaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4372 - RNA, 3594 nt, Artificial Sequence
  derived and/or modified CDS sequence (wt) from RVFV(2269/74)__DQ380222.1__GP
auguauguuuuacuaacaauucuaaucucgguucuggugugugaagcgguuauuagagugucucuaagcuccacaagagaagagaccuguuuuggugacuccaccaaccccgagaugauugaaggagcuugggauucgcucagagaggaggagaugccagaggagcucuccuguucuauaucaggcauaagggagguuaagaccucaagccaggaauuguacagggcauuaaaagccaucauugcugcugauggcuugaacaacaucaccugccaugguaaggacccugaggacaagauuucucucauaaaggguccuccucacaaaaaacggguggggauaguucggugugagagacgaagagacgcuaagcaaauagggagagaaaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacauguaaaccugugacauaugcuggggcauguagcaguuuugaugucuugcucgaaaaggggaaauucccccucuuccagucguaugcucaucauagaacucuacuagaggcaguucacgacacuaucauugcaaaggcugacccaccuagcugugaccuucagagugcucaugggaaucccugcaugaaagagaagcucgugaugaagacacacuguccaaaugacuaccaaucagcucauuaccuuaacaaugacgggaaaauggcuucagucaagugccccccuaaguaugagcucacugaggauugcaacuuuuguaggcagaugacaggugcuagccugaagaaggggucuuauccucuccaggacuuauuuugucagucaagugaggaugaugggucaaaauuaaaaacaaaaaugaaaggggucugcgaagugggaguucaagcacuaaaaaagugugauggccaacucagcacugcacaugagguugugcccuucgcaguguuuaagaacucaaagaagguuuaucuugauaagcuugaccuuaagacugaggaaaaucugcuaccagacucauuugucugcuucgagcauaaaggacaacauaaaggaacaauggacucuggucagaccaagagggagcucaaaagcuuugauaucucucagugccccaagauuggaggacaugguagcaagaagugcacuggggacgcagcauuuugcucugcuuaugagugcacugcucaguacgccaaugccuauuguucacaugcuaaugggucaggaauugugcagauacaagugucaggggucuggaagaagccuuuauguguaggguaugagagagugguuguaaagagagaacucucugccaagcccauccagagaguugagccuugcacaacuuguauaaccaaaugcgagccucauggacugguuguccgaucaacaggguucaagauaucaucugcaguugcuugugcuagcggaguuugcgucacaggaucgcagaguccuucuaccgagauuacacucaaguauccaggaauaucucaguccucugggggggacauagggguucacauggcacacgacgaucagucaguuagcuccaaaauaguagcucacugccccccccaggacccgugcuuagugcauggcugcauagugugugcucauggccugauaaauuaccagugucacacugcucucagugccuuuguuguuguguucguguucagcucuguugcaauaauuuguuuggccauucuuuauaaggugcucaagugccuaaagauugccccaaagaaaguucugaauccgcuaauguggauuacugccuucaucagauggguauauaagaagaugguugccagaguggcagauaauauaaaucaagugaacagggaaauaggauggauggaaggaggucaguuggcucuagggaacccugccccuauuccucgucacgcuccaaucccacgcuauagcacauaccuaaugcuacuacugauugucucauaugcgucagcauguucagaacugauucaggcaagcucuaggauuaccacuugcuccacagaaggugucaacaccaaguguaggcugucuggcacagcauuaauuagggcagggucaguuggggcagaggcuuguuugauguuaaagggggucaaggaagaccaaaccaaguucuugaagauaaaaacugucucaagugagcuaucgugcagggagggccagagcuacuggacuggguccuuuagccccaaaugucugagcucaaggagaugccaucuugucggggaaugucaugugaauaggugcuugucuuggagggacaaugaaacuucagcagaguuuucauuuguuggggaaagcacgaccaugcgagagaauaaguguuuugagcaguguggaggauggggauguggguguuucaaugugaacccaucuugcuuauuugugcacacguaccugcagucaguuagaaaagaggcccuuagaguuuuuaacuguaucgauugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucauucauugagagcccaggcaaaggguaugcaauuguugaugagccauucucagaaauuccucggcaaggguuccugggggagaucaggugcaacucagaaucuucaguccugagugcucaugaaucaugccuuagggcaccaaaccuuaucucauacaagccuaugauagaucaguuggagugcacaacaaaucugauugaucccuuuguugucuuugagagggguucucugccacagacaagaaaugacaaaacuuuugcagcuucaaaaggaaauagggguguucaagcuuucucuaagggcucugugcaagcugaucuaacucugauguuugacaauuuugagguggacuuugugggagcagccgugucuugugaugccgccuucuuaaauuugacagguugcuauucuugcaaugcaggggccagggucugccugucuaucacauccacaggaacuggaacucucucugcccacaacaaggaugggucucugcauauaguucucccaucagaaaauggaacaaaagaucagugucagauacuacacuucacugugccugagguagaggaggaguuuauguacucuugugauggagaugagcggccuuuguuagugaaggggacccugauagccauugauccauuugaugauaggcgggaagcaggaggggaaucaacaguugugaauccaaaaucuggaucuuggaauuucuuugacugguucucuggacucaugaguugguuuggagggccucuuaagaccauacuccucauaugccuguauguugcauuaucaauugggcucuuuuuccuucuuauauaucuuggaagaacaggucucucuaaaauguggcuugcugcuacuaagaaggcuucauag

SEQ ID NO: 4373 - RNA, 3594 nt, Artificial Sequence
  derived and/or modified CDS sequence (wt) from RVFV(SA-51 (Van Wyck))__DQ380195.1__GP
auguauguuuuacuaacaauucuaaucucgguucuggugugugaagcgguuauuagagugucucuaagcuccacaagagaagagaccuguuuuggugacuccaccaacccagagaugauugaaggagcuugggauucacucagagaggaggagaugccagaggagcucuccuguucuauaucaggcauaagggagguuaagaccucaagccaggaauuauacagggcauuaaaagccaucauugcugcugauggcuugaacaacaucaccugccaugguaaggauccugaggacaagaucucucucauaaaggguccuccucacaaaaaacggguggggauaguucggugugagagacgaagagacgcuaagcaaauagggagagaaaccauggcagggauugcaaugacaguccuuccagccuuagcaguuuuugcuuuggcaccuguuguuuuugcugaagacccccaucucagaaacagaccagggaagggacacaacuacauugacgggaugacucaggaggaugccacauguaaaccugugacauaugcuggggcauguagcaguuuugaugucuugcucgaaaagggaaaauuuccccuuuuucagucguaugcucaucauagaacucuacuagaggcaguucacgacaccaucauugcaaaggcugauccaccuagcugugaccuucagagugcucaugggaaucccugcaugaaagagaaacucgugaugaagacacacuguccaaaugacuaccagucagcucauuaccucaacaacgacgggaaaauggcuucagucaagugcccuccuaaguaugagcucacugaggacugcaacuuuuguaggcagaugacaggugcuagccugaagaaggggucuuauccucuccaggacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaaaacugaggaaaaucugcuaccagacucauuugucugcuucgagcauaagggacaguauaaaggaacaauggacucuggucagacuaagagggagcucaagagcuuugauaucucucagugccccaagauuggaggacgugguagcaagaagugcacuggggacgcagcauuuugcucugcuuaugagugcacugcucaauacgccaaugccuauuguucacaugcuaaugggucaggaauugugcagauacaaguaucaggggucuggaagaagccuuuauguguaggauaugagagagugguugugaaaagagaacucucugccaagcccauccagagaguugagccuugcacaacuuguauaaccaaaugugagccucauggauugguuguccgaucaacaggguucaagauaucaucugcaguugcuugugcuagcggaguuugcgucacaggaucgcagagcccuucuacagagauuacacucaaguacccagggauaucccaguccucuggaggggacauagggguucacauggcacacgaugaucagucaguuagcuccaaaauaguagcucacugccccccccaagacccgugcuuagugcauggcugcauagugugugcucauggccugauaaauuaccagugucacacugcucucagugccuuuguuguuguguucguauucagcucuguugcaauaaucuguuuagccauucuuuauaaggugcucaagugccuaaagauugccccaaggaaaguucugaauccacuaauguggauuacugccuucaucagauggguguauaagaagaugguugccagaguggcagacaauauuaaucaagugaacagggagauaggauggauggaaggaggucaguuggcucuagggaauccugccccuauuccucgucaugcuccaauuccacguuauagcacauaccuaaugcuacuauugauugucucauaugcaucagcaugcucagaacugauucaggcaagcuccagaaucaccacuugcucuacagaaggugucaacaccaaguguaggcugucuggcacagcauuaaucagggcagggucaguuggggcagaggcuuguuugauguugaagggggucaaggaagaccaaaccaaguucuugaagauaaaaacugucucaagugagcuaucgugcagggagggccagagcuauuggacuggguccuuuagccccaagugucugagcucaaggagaugccaucuugucggggaaugucaugugaauaggugucugucuuggagggauaaugaaacuucagcagaguuuucauuuguuggggaaagcacgaccaugcgagaaaauaaguguuuugagcaguguggaggauggggauguggguguuucaaugugaacccaucuugcuuauuugugcacacguaucugcagucaguuagaaaagaggcccuuagaguuuuuaacuguaucgauugggugcauaaacucacucuggaggucacagauuuugauggcucuguuucaacaauagacuugggagcaucaucuagccguuucacaaacugggguucaguuagccucucacuggaugcagagggcauuucaggcucaaauagcuuuucuuucauugagagcccaggcaaaggguaugcaauuguugaugagccauucucagaaauuccucggcaaggguucuugggggagaucaggugcaauucagaaucuucaguucugagugcccacgaaucaugccuuagggcaccaaaccuuaucucauacaagcccaugauagaucaguuggagugcacaacaaaucugauugaucccuuuguugucuuugagagggguucccugccacagacaaggaaugacaaaaccuuugcagcuucaaaaggaaacagggguguucaagcuuucucuaagggcucuguacaagcugaucuaacucugauguuugacaauuuugagguggacuuugugggagcagccgugucuugugaugcugccuucuuaaauuugacagggugcuauucuugcaaugcaggggccagggucugccugucuaucacauccacaggaacuggaacccucucugcccacaauaaggaugggucucugcauauaguucuuccaucagagaauggaacaaaagaucagugucagauacuacacuucacuguuccugaaguagaggaagaguuuauguacucuugugauggagaugagcggccucuguuggugaaggggacccugauagcuauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuucuuauauaucuuggaagaacaggucuuucuaaaauguggcuugcugcuacuaagaaggccucauag

SEQ ID NO: 4374 - RNA, 3594 nt, Artificial Sequence
  derived and/or modified CDS sequence (wt) from RVFV(OS-8)__DQ380185.1__GP
auguauguuuuacuaacaauucuaaucucgguucuggugugugaagcgguuauuagagugucucuaagcuccacaagagaagagaccuguuuuggugacuccaccaacccagagaugauugagggagcuugggauucacucagagaggaggagaugccagaggagcucuccugcucuauaucaggcauaagggagguuaagaccucaagccaggaauuauacagagcauuaaaagccaucauugcugcugauggcuugaacaacaucaccugccaugguaaggauccugaggacaagauuucucuuauaaaggguccuccucacaaaaagcggguggggauaguucggugugagagacgaagagacgcuaagcaaauagggagagaaaccauggcagggauugcaaugacaguccuuccagccuuagcaguuuuugcuuuggcaccuguuguauuugcugaagacccccaucucagaaauagaccagggaaggggcacaacuacauugacgggaugacucaggaggaugccacuuguaaaccugugacauacgcuggggcauguagcaguuuugaugucuugcucgaaaagggaaaauucccccucuuccagucguaugcucaucauagaacucuacuagaggcaguucaugacaccaucauugcaaaggcugauccaccuaguugugaucuucagagugcucaugggaauccuugcaugaaagagaaacucgugaugaagacacacuguccaaaugacuaccagucagcccacuaccucaacaaugaugggaaaauggccucagucaagugcccuccuaaguaugagcucacugaggacugcaacuuuuguaggcagaugacaggugcuagccugaagaaggggucuuauccucuccaggacuuauuuugucagucaagugaggaugauggaucaaaauuaaaaacaaaaaugaaaggggucugcgaaguggggguucaggcacucaagaagugugauggccagcucagcacugcacaugagguugugcccuuugcaguguuuaagaacucaaagaagguuuaucuugacaagcuugaccucaaaacugaagaaaaucugcuaccagacucauuugucugcuucgagcauaagggacaguauaaaggaacaauggacucuggucaaacuaagagggagcucaaaagcuuugauaucucucagugccccaagauuggaggacaugguagcaagaagugcacuggggacgcagcauuuugcucugcuuaugagugcacugcucaauacgccaaugccuauuguucacaugcuaaugggucaggaguugugcagauacaaguauccggggucuggaagaaaccuuuauguguaggguaugagagagugguugugaagagagaacucucugccaaacccauccagagaguugagccuugcacaaccuguauaaccaaaugugagccucauggauugguuguccgaucaacaggguucaagauaucaucugcaguugcaugugcuagcggaguuugugucacaggaucgcagaguccuucuaccgagaucacacucaaguauccagggauaucccaguccucugggggggacauagggguucacauggcacacgaugaucagucaguuagcuccaaaauaguagcucacugccccccccaggacccgugccuagugcauggcugcauagugugugcucauggccuaauaaauuaccagugucacacugcucucagugccuuuguuguuguguucguauucagcucuguugcaauaauuuguuuggccauucuuuauaaggugcucaagugccuaaagauugccccaaggaaaguucuaaauccacuaauguggauuacugccuucaucagauggguguauaagaagaugguugccaggguggcagacaauauuaaucaagugaacagagaaauaggauggauggagggaggucaguuggcucuagggaacccugccccuauuccucgucaugccccaauuccacguuauagcacauaccugaugcuacuauugauugucucauaugcaucagcauguucagaacugauucaggcaagcucuagaauaaccacuugcuccacagaaggugucaacaccaaguguaggcugucuggcacagcauuaaucagggcagggucaguuggggcagaggcuugcuugauguuaaagggagucaaggaggaccaaacaaaguucuugaggauaaaaacugucucaagugagcuaucgugcagggaaggccagagcuauuggacuggauccuuuagucccaaaugucugagcucaaggagaugccaucuugucggggaaugucaugugaauaggugucugucuuggagggacaaugaaacuucagcagaguuuucauuuguuggggaaagcacgacuaugcgagagaauaaauguuuugagcagugugggggauggggaugugggugcuucaaugugaacccaucuugcuuguuugugcacacguaucugcagucaguuagaaaagaggcccuuagaguuuuuaacuguaucgauugggugcauaaacucacucuagagaucacagacuuugaugguucuguuucaacaauagacuugggagcaucaucuagccguuucacaaacuggggcucaguuagccucucacuggaugcagagggcauuucaggcucaaauagcuuuucuuucauugagagcccaggcaaaggguaugcaauuguugaugagccauucucagaaaucccucggcaaggguucuugggggagaucaggugcaauucagaaucuucaguccugagugcucaugaaucaugccuucgggcaccaaaccucaucucauacaagcccaugauagaccaguuggagugcacaacaaaucugauugaucccuuuguugucuuugagagggguucucugccucagacaaggaaugauaaaacuuuugcagcuucaaaaggaaauagggguguucaagcuuucucuaagggcucuguacaagcugauuuaacucugauguuugacaauuuugagguggacuuugugggagcagccgugucuugugaugccgcuuucuuaaaucugucagguuguuauucuuguaaugcaggggccagagucugccugucuaucacauccacaggaacuggaacucucucugcccacaauaaggaugggucucugcauauaguucuuccaucagagaauggaacaaaagaucagugucagauacuacacuucacuguaccugagguagaggaggaguuuauguacucuugugauggagaugagcggccucuguuggugaaggggacccugaucgccauugauccauuugaugacaggcgggaagcagggggagaaucaacaguugugaauccaaaaucuggaucuuggaauuucuuugacugguuuucuggacucaugaguugguuuggagggccucuuaagacuauacuccucauuugccuguauguugcauuaucaauugggcucuuuuuccuucucauauaucuuggaagaacaggucucucuaaaauguggcuugcugcuacuaagaaggccucauaa

SEQ ID NO: 4375 - RNA, 3594 nt, Artificial Sequence
  derived and/or modified CDS sequence (wt) from RVFV(BIME-01)__KX609032.1__GP
auguauguuuuacuaacaauucuaaucucgguucuggugugugaagcgauuauuagagugucucuaagcuccacaagagaggaaaccuguuuuggugacuccaccaacccagagaugauugaaggagcuugggauucacucagagaggaggagaugccagaagagcucuccuguuccauaucuggcauaagggaggucaagaccucaagccaggaauuauacagggcauuaaaagccaucauugcugcugauggcuugaacaacaucaccugccaugguaaggauccugaggacaaaauuucucucauaaaggguccuccucacaagaagcggguggggauaguucggugugagagacgaagggacgcuaagcaaauagggagagaaaccauggcagggauugcaaugacaguucuucccgccuuagcaguuuuugcuuuggcaccuguuguuuuugcugaggacccucaucucagaaacagaccagggaagggacauaacuacauugacgggaugacucaggaggaugccacaugcaaaccugugacauaugcuggggcauguagcaguuuugauguuuugcucgaaaagggaaaauucccccucuuccagucauaugcucaucauagaacucuacuagaggcaguucacgacaccaucauugcaaaggcugauccaccuagcugugaucuccagagugcucaugggaaucccugcaugaaagagaaacucgugaugaagacacacuguccaaaugacuaccagucagcucauuaccucaacaaugacgggaaaauggcuucagucaagugcccuccuaaguaugagcuuacugaggacugcaacuuuuguaggcagaugacaggugcuagcuugaagaaggggucuuauccucuccaggacuuauuuugucagucaagugaggaugauggaucaaaacuaaagacaaaaaugaaaggggucugcgaaguggggguucaggcacucaaaaagugugauggccaacucagcacugcacaugagguugugcccuuugcaguguuuaagaauucaaagaagguuuaucuugacaagcuugaccuuaagacugaagaaaaucugcuaccagacucauuugucugcuuugagcauaagggacaguauaaaggaacaauggacucuggucagacuaagagggagcucaaaagcuuugauaucucucagugccccaagauugggggacaugguagcaagaagugcacuggggacgcagcauuuugcucugcuuaugaguguacugcucaauaugccaaugccuauuguucacaugcuaaugggucugggauuguacagauacaaguauccggggucuggaagaagccuuuaugugugggguaugagagagugguugugaagagagaacucucugccaagcccauccagagaguugagccuugcacaacuugcauaaccaaaugugagccucauggauugguuguccgaucaacaggguucaagauaucaucugcaguugcuugugccagcggaguuugcgucacaggaucgcagagcccuucuacugagaucacucucaaguauccagggauaucccaguccucugggggggauauagggguucacauggcacaugaugaucagucaguuagcuccaaaauaguggcucacugccccccccaggacccgugccuagugcauggcugcauagugugugcucauggcuugauaaauuaccagugucacacugcucuuagugcuuuuguuguuguguucguauucagcucuguugcaauaauuugucuggccauucuuuauaaggugcucaggugccuaaagauugccccaaagaaaguucugaauccacuaauguggaucacugccuucaucagauggguguauaagaagaugguugccagaguggcagacaauaucaaucaagugaacagagaaauaggauggauggaaggaggccaguuggcucuagggaacccugcucccauuccucgucaugcuccgauuccacguuauagcacauaccuaaugcuacuauugauuaucucauaugcaucagcauguucagaacugauucaggcaagcuccagaaucaccacuugcuccacagaaggugucaacaccaaguguaggcugucuggcacagcauuaaucagggcagggucaguuggggcagaggcuuguuuaauguuaaagggggucaaggaagaccagaccaaguucuugaagauaaaaacugucucaagugagcuaucgugcagggagggccagagcuauuggacuggguccuuuagccccaaaugucugagcucaaggagaugccaucuugucggagaaugucaugugaauaggugucugucuuggagggacaaugaaacuucagcagaauuuucauuuguuggggaaagcacgaccaugcgagagaauaaguguuuugagcaguguggaggauggggauguggauguuucaaugugaacccaucuugcuuauuugugcacacguaucugcaaucaguuagaaaagaggcucuuagaguuuuuaacuguauugauugggugcauaaacucacucuagagaucacagacuuugauggcucuguuucaacaauagacuugggagcaucaucuagccguuucacaaacuggggcucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaaucuucuguccugagugcucaugagucaugccuuagggcaccaaaccuuaucucauacaaacccaugauagaucaguuggagugcacaacaaaucugauugaucccuuuguugucuuugagaggggaucucugccacagacaaggaaugacaaaaccuuugcagcuucaaaaggaaauagggguguucaagcuuucucuaaaggcucuguacaggcugaucuaacucugauguuugacaauuuugagguggacuuugugggagcagccgugucuugugaugccgccuucuuaaauuugacagguugcuauuccugcaaugcuggagccagagucugccugucuaucacauccacaggaacuggaacucuuucugcccacaauaaggaugggucucugcauauaguucuuccaucagagaauggaacaaaagaucagugucagauacuacacuucacuguaccugagguggaggaggaguucauguacucuugugauggagaugagcgaccuuuguuggugaaggggacccuaauagcuauugauccauuugaugauaggcgagaagcagggggagaaucaacaguugugaauccaaaaucuggaucuuggaacuucuuugacugguuuucuggacuuaugaguugguuuggaggaccucuuaagacuauacuccuaauuugccuguauguagcauuaucaauugggcucuuuuuccuucuuauauaucuuggaagaacaggucucucuaaaauguggcuugcugccacuaagaaagccucauag

SEQ ID NO: 4376 - RNA, 3594 nt, Artificial Sequence
  derived and/or modified CDS sequence (wt) from RVFV(Kenya 83 (21445))__DQ380198.1__GP
auguauguuuuauugacaauucuaaucucgguucuggugugugaagcgguuauuagagugucucuaagcuccacaagagaagagaccuguuuuggugacuccaccaacccagagaugauugaaggagcuugggauucacucagagaggaggagaugccagaggagcucuccugcucuauaucaggcauaagggagguuaagaccucaagccaagaguuauacagggcauuaaaagccaucauugcugcugauggcuugaacaacaucaccugccaugguaagaauccugagaacaagauuucucucauaaaggguccuccucacaaaaagcggguggggauaguccggugugagagacgaagagaugcuaagcaaauagggagagaaaccauggcagggauugcaaugacaguccuuccagccuuagcaguuuuugcuuuggcaccuguuguuuuugcugaagacccccaccucagaaacagaccagggaaggggcacaacuacauugacgggaugacucaggaggaugccacaugcaaaccugugacauaugcuggggcauguagcaguuuugaugucuugcuugaaaaggggaaauuuccccuuuuccagucauaugcucaucauagaacucuacuagaggcaguucacgacaccaucauugcaaaggcugauccaccuagcugugaccuucagagugcucaugggaaucccuguaugaaagagaaacucgugaugaagacacauuguccaaaugacuaccagucagcucauuaccucaacaaugacgggaaaauggcuucagucaagugcccaccuaaguaugagcucacugaggacugcaacuuuuguaggcagaugacaggugcuagccugaaaaaggggucuuacccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucuguuucgagcauaagggacaguauaaaggaacaauggacucuggucagaccaagagggagcucaaaagcuuugauaucucucagugccccaagauuggagggcaugguaguaagaagugcacuggggacgcagcauucugcucugcuuaugagugcacugcucaguacgccaaugccuauuguucacaugcuaaugggucagggauugugcagauucaaguaucaggggucuggaagaagccuuuauguguaggguaugagagagugguugugaagagagaacucucugccaagcccauccagagaguugagccuugcacaacuugcauaaccaaaugugagccucauggauugguuguccgaucaacaggguucaagauaucaucugcaguugcuugugcuagcgggguuugcgucacaggaucgcagaguccuucuacugagauuacacucaaguauccagggauaucucaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguuguuguauuuguauucaguucuauugcaauaauuugcuuagcuauucuuuauagggugcucaagugccuaaagauugccccaaggaaaguucugaauccacuaauguggauuacagcuuucaucagauggguguauaagaagaugguugcuagaguggcagacaacauuaaucaagugaacagggaaauaggauggauggaaggaggucaguuggcucuagggaacccugccccuauuccucgucaugccccaaucccacguuauagcacauaccuaaugcuacuauugauugucucauaugcaucagcauguucagaacugauccaggcaagcuccagaaucaccacuugcuccacagagggugucaacaccaaguguagacugucuggcacagcauugaucagggcagggucaguuggggcagaggcuuguuugauguugaagggggucaaggaggaucaaaccaaauucuuaaagauaaaaacagucucaagugagcuaucgugcagggagggccagagcuauuggacuggguccuuuagccccaagugucugagcucaaggagaugccaucuugucggggaaugucaugugaauaggugucugucuuggagggacaaugaaacuucagcagaguuuucauuuguuggggaaagcacaaccaugcgagagaauaaguguuuugagcaguguggaggauggggauguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucagguucaaauagcuuuucuuuuauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucguacaagcccaugauagaucaauuggagugcacuacaaaucugauugaccccuuuguugucuuugagagggguucucugccacagacaaggaaugacaaaaccuuugcagcuucaaaaggaaauagagguguucaggcuuucucuaagggcucuguacaagcugaucugacucugauguuugacaauuuugagguggacuuugugggagcagccgugucuugugaugccgccuucuugaauuugacagguugcuauucuuguaaugcaggggccagggucugccugucuaucacauccacaggaacuggaacucucucugcccacaauaaggaugggucucugcauauaguucucccaucagagaaugggacaaaagaucagugucagauacuacacuucacuguaccugaaguagaggaggaguuuauguacucuugugauggagaugagcggccucuguuagugaaagggacccugauagcuauugacccauuugaugauaggcgggaagcaggaggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugccgcuacuaagaaggccucauag

SEQ ID NO: 4377 - RNA, 3594 nt, Artificial Sequence
  derived and/or modified CDS sequence (wt) from RVFV(2007000253)__JF326192.1__GP
auguauguuuuauugacaauucuaaucucgguucuggugugugaagcaguuauuagagugucucuaagcuccacaagagaggaaaccuguuuuggugacuccaccaacccagagaugauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcggguggggauaguccggugugagagacgaagagaugcuaagcaaauagggagagaaaccauggcagggauugcgaugacaguccuuccagccuuagcaguuuuugcuuuggcaccaguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucagcuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccuguccaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4378 - RNA, 3594 nt, Artificial Sequence
  derived and/or modified CDS sequence (wt) from RVFV(200803166)__JF311381.1__GP
auguauguuuuauugacaauucuaaucucgguucuggugugugaagcgguuauuagagugucucuaagcuccacaagagaggagaccuguuuuggugacuccaccaacccagagaugauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcggguggggauaguccggugugagagacgaagagaugcuaagcaaauagggagagaaaccauggcagggauugcgaugacaguccuuccagcccuagcgguuuuugcuuuagcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuuaaaaaggggaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguaggcagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaaugggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggauccgugcuuagugcauggcugcauagugugugcucauggccugauaaauuaccagugucacacugcucucagugccuuuguuguuguauuuguauucaguucuauugcaauaauuugcuuagcuauucuuuauagggugcucaagugccuaaagauugccccaaggaaaguucugaauccacuaauguggauuacagccuucaucagauggguguauaagaagaugguugcuagaguggcggacaauauuaaucaagugaacagggaaauaggauggauggaaggaggucaguugguucuagggaacccugccccuauuccucgucaugccccaaucccacguuauagcacauaccuaaugcuacuauugauugucucauaugcaacagcauguucagaacugauucaggcaagcuccagaaucaccacuugcuccacagagggugucaacaccaaguguagacugucuggcacagcauugaucagggcagggucaguuggggcagaggcuuguuugauguugaaggggguuaaggaagaucaaaccaaguucuugaagauaaaaacugucucaagugagcuaucgugcagggagggccagagcuauuggacuggguccuuuagccccaagugucugagcucaaggagaugccaucuugucggggaaugucaugugaauaggugucugucuuggagggacaaugaaacuucagcagaguuuucauuuguuggggaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagucucucacuggacgcagagggcauuucaggcucaaauagcuuuucuuuuauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccuguccaucacauccacaggaacuggaacucucucugcccacaauaaggacgggucucugcauguaguucucccaucagagaaugggacaaaagaucagugucagauacugcauuucacuguaccugaaguagaagaggaguuuauguacucuugugauggagaugagcggccucuguuagugaaagggacccugauagcuauugacccauuugaugauaggcgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4379 - RNA, 3594 nt, Artificial Sequence
  derived and/or modified CDS sequence (wt) from RVFV(2007001107)__EU574047.1__GP
auguauguuuuauugacaauucuaaucucgguucuggugugugaagcgguuauuagagugucucuaagcuccacaagagaggaaaccuguuuuggugacuccaccaacccagagaugauugaaggagcuugggauucacucagagaggaggagaugccagaggagcucuccugcucuguaucaggcauaagggagguuaagaccucaaaccaggaguuauacagagcauuaaaagccaucauugcugcugauggcuugaacaacaucaccugccaugguaagaauccugaggacaagauuucucucauaaaggguccuccucacaaaaagcggguggggauaguccggugugagagacgaagagaugcuaagcaaauagggagagaaaccauggcagggauugcgaugacaguccuuccagccuuagcaguuuuugcuuuggcaccuguuguuuuugcugaagacccccaucucagaaacagaccagggaaggggcacaacuacauugacggaaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggauaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauaguuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggggcagccgugucuugugaugccgccuucuugaauuugacagguugcuauucuugcaaugcaggggccagagucugccugucuaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4380 - RNA, 3594 nt, Artificial Sequence
  derived and/or modified CDS sequence (wt) from RVFV(ANK-3837)__DQ380215.1__GP
auguauguuuuauuaacaauucuaaucucgguucuggugugugaagcgguuauuagagugucucuaagcuccacaagagaagagaccuguuuuggugacuccaccaacccagagaugauugaaggagcuugggauucacucagagaggaggagaugccagaggagcucuccuguucuauaucaggcauaagggagguuaagaccucaagccaggaguuauacagggcauuaaaagccaucauugcugcugauggcuugaacaacaucaccugccaugguaaggauccugaggacaagauuucucucauaaaggguccuccucauaaaaagcggguggggauaguucggugugagagacgaagagaugcuaagcaaauagggagagaaaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugagaaggggaaauucccccuuuuccagucguaugcucaucauagaacucuacuagaggcaguucacgacaccaucauugcaaaggcugauccaccuagcugugaccuucagagugcucaugggaaucccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaggacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaccuugauaagcuugaccucaagacugaggagaaucugcuaccagacucauuugucugcuucgagcauaagggacaguauaaaggaaaauuggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagaguaguugugaagagagaacucucugccaagcccauccagagaguugagccuugcacaacuuguauaaccaaaugugagccucauggguugguuguccgaucaacaggguucaagauaucaucugcaguugcuugugcuagcggaguuugcgucacaggaucgcagaguccuuccaccgagauuacacucaaguauccagggauaucccaguccucuggaggggacauagggguucacauggcacacgaugaucagucaguuagcuccaaaauaguagcucacugcccuccccaggacccgugcuuagugcacggcugcauagugugugcucauggccugauaaauuaccagugucacacugcucucagugccuuuguuguuguguuuguauucaguucuauugcaauaauuuguuuagcuauucuuuauagggugcucaagugccuaaagauugccccaaggaaaguucugaauccacuaauguggauuacagccuucaucagauggguguauaggaagaugguugccagaguggcagacaauauuaaucaagugaacagggagauaggauggauggaaggaggucaguugguucuagggaacccugccccuauuccucgucauguuccaauuccacguuauagcacauaccuaaugcuacuacugauugucucauaugcaucagcauguucagaacugauucaggcaagcuccagaaucacuacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaaaugucugagcucaaggagaugccaucuugucggggaaugucaugugaauaggugucugucuuggagggacaaugaaacuucagcagaguuuucauuuguuggagaaagcacgaccaugcgagagaauaaguguuuugagcaguguggaggauggggauguggguguuucaaugugaacccaucuugcuuauuugugcacacguaucugcagucaguuagaaaagaggcccuuagaguuuuuaacuguaucgacugggugcauaaacucacucuggagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugagucaugccuuagggcaccaaaccuuaucucauacaagcccaugauagaucaauuggagugcacaacaaaucugauugaccccuuuguuguauuugagagggguucucugccacagacaaggaaugacaaaaccuuugcugcuucaaaaggaaauagagguguucaagcuuucucuaagggcucugugcaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaacucucucugcccacaauaaggaugggucucugcauauaguucuuccaucagagaauggaacaaaagaucagugucagauacuacacuucacuguaccugaaguagaggaggaguuuauguacucuugugauggagaugagcggccucuauuggugagggggacucugauagcuauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugcuuguauguugcauuaucaauugggcucuuuuuccuccucauauaucuuggaagaacaggccucucuaaaauguggcuugcugcuacuaagaaggccucauag

SEQ ID NO: 4381 - RNA, 3594 nt, Artificial Sequence
  derived and/or modified CDS sequence (wt) from RVFV(OS-1)__DQ380186.1__GP
auguauguuuuacuaacaauucuaaucucgguucuggugugugaagcgguuauuagagugucucuaagcuccacaagagaagagaccuguuuuggugacuccaccaacccagagaugauugagggagcuugggauucacucagagaggaggagaugccagaggagcucuccugcucuauaucaggcauaagggagguuaagaccucaagccaggaauuauacagagcauuaaaagccaucauugcugcugauggcuugaacaacaucaccugccaugguaaggauccugaggacaagauuucucuuauaaaggguccuccucacaaaaagcggguggggauaguccggugugagagacaaagagacgcuaagcaaauagggagagaaaccauggcagggauugcaaugacaguccuuccagccuuagcaguuuuugcuuuggcaccuguuguauuugcugaagacccccaucucagaaauagaccagggaaggggcacaacuacauugacgggaugacucaggaggaugccacuuguaaaccugugacauaugcuggggcauguagcaguuuugaugucuugcucgaaaagggaaaauucccccucuuccagucguaugcucaucauagaacucuacuagaggcaguucaugacaccaucauugcaaaggcugauccaccuaguugugaucuucagagugcucaugggaauccuugcaugaaagagaaacucgugaugaagacacacuguccaaaugacuaccagucagcccacuaccucaacaaugaugggaaaauggccucagucaagugcccuccuaaguaugagcucacugaggacugcaacuuuuguaggcagaugacaggugcuagccugaagaaggggucuuauccucuccaggacuuauuuugucagucaagugaggaugauggaucaaaauuaaaaacaaaaaugaaaggggucugcgaaguggggguucaggcacucaagaagugugauggccagcucagcacugcacaugagguugugcccuuugcaguguuuaagaacucaaagaagguuuaucuugacaagcuugaccucaaaacugaagaaaaucugcuaccagacucauuugucugcuucgagcauaagggacaguauaaaggaacaauggacucuggucaaacuaagagggagcucaaaagcuuugauaucucucagugccccaagauuggaggacaugguagcaagaagugcacuggggacgcagcauuuugcucugcuuaugagugcacugcucaauacgccaaugccuauuguucacaugcuaaugggucaggaguugugcagauacaaguauccggggucuggaagaaaccuuuauguguaggguaugagagagugguugugaagagagaacucucugccaaacccauccagagaguugagccuugcacaaccuguauaaccaaaugugagccucauggauugguuguccgaucaacaggguucaagauaucaucugcaguugcaugugcuagcggaguuugugucacaggaucgcagaguccuucuaccgagaucacacucaaguauccagggauaucccaguccucugggggggacauagggguucacauggcacacgaugaucagucaguuagcuccaaaauaguagcucacugcccuccccaggacccgugccuagugcauggcugcauagugugugcucauggccuaauaaauuaccagugucacacugcucucagugccuuuguuguuguguucguauucagcucuguugcaauaauuuguuuggccauucuuuauaaggugcucaagugccuaaagauugccccaaggaaaguucuaaauccacuaauguggauuacugccuucaucagauggguguauaagaagaugguugccaggguggcagacaauauuaaucaagugaacagagaaauaggauggauggagggaggucaguuggcucuagggaacccugccccuauuccucgucaugccccaauuccacguuauagcacauaccugaugcuacuauugauugucucauaugcaucagcauguucagaacugauucaggcaagcucuagaauaaccacuugcucuacagaaggugucaacaccaaguguaggcugucuggcacagcauuaaucagggcagggucaguuggggcagaggcuugcuugauguuaaagggagucaaggaggaccaaacaaaguucuugaagauaaaaacugucucaagugagcuaucgugcagggaaggccagagcuauuggacuggauccuuuagucccaaaugucugagcucaaggagaugccaucuugucggggaaugucaugugaauaggugucugucuuggagggacaaugaaacuucagcagaguuuucauuuguuggggaaagcacgacuaugcgagagaauaaauguuuugagcagugugggggauggggaugugggugcuucaaugugaacccaucuugcuuguuugugcacacguaucugcagucaguuagaaaagaggcccuuaaaguuuuuaacuguaucgauugggugcauaaacucacucuagagaucacagacuuugaugguucuguuucaacaauagacuugggagcaucaucuagccguuucacaaacuggggcucaguuagccucucacuggaugcagagggcauuucaggcucaaauagcuuuucuuucauugagagcccaggcaaaggguaugcaauuguugaugagccauucucagaaaucccucggcaaggguucuugggggagaucaggugcaauucagaaucuucaguccugagugcucaugaaucaugccuucgggcaccaaaccucaucucauacaagcccaugauagaccaguuggagugcacaacaaaucugauugaucccuuuguugucuuugagagggguucucugccucagacaaggaaugauaaaacuuuugcagcuucaaaaggaaauagggguguucaagcuuucucuaagggcucuguacaagcugauuuaacucugauguuugacaauuuugagguggacuuugugggagcagccgugucuugugaugccgcuuucuuaaaucugacagguuguuauucuuguaaugcaggggccagagucugccugucuaucacauccacaggaacuggaacucucucugcccacaauaaggaugggucucugcauauaguucuuccaucagagaauggaacaaaagaucagugucagauacuacacuucacuguaccugagguagaggaggaguuuauguacucuugugauggagaugagcggccucuguuggugaaggggacccugaucgccauugauccauuugaugacaggcgggaagcagggggagaaucaacaguugugaauccaaaaucuggaucuuggaauuucuuugacugguuuucuggacucaugaguugguuuggagggccucuuaagacuauacuccucauuugccuguauguugcauuaucaauugggcucuuuuuccuucucauauaucuuggaagaacaggucucucuaaaauguggcuugcugcuacuaagaaggccucauaa

SEQ ID NO: 4382 - RNA, 3594 nt, Artificial Sequence
  derived and/or modified CDS sequence (wt) from RVFV(Sudan 2V-2007)__JQ820490.1__GP
auguauguuuuauugacaauucuaaucucgguucuggugugugaagcgguuauuagagugucucuaagcuccacaagagaggagaccuguuuuggugacuccaccaacccagagaugauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaauaucacuugccaugguaagaauccugaggacaagauuucucucauaaaggguccuccucacaaaaagcgaguggggauaguccggugugagagacgaagagaugcuaagcaaauagggagagaaaccauggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaaggggaaauuuccccuuuuccagucauaugcucaucauagaacucuacuagaggcaguucacgacaccaucauugcaaaggcugauccaccuagcugugaccuccagagugcucaugggaaucccuguaugaaagagaaacuugugaugaagacacauuguccaaaugacuaccagucagcucauuaccucaacaaugacgggaaaauggccucagucaagugcccaccuaaguaugagcucacugaggacugcaacuuuuguagacagaugacaggugcuagccugaagaaggggucuuauccucuccaagacuuauuuugucagucgagugaggaugauggaucaaaauugaaaacaaaaaugaaaggggucugcgaaguggggguucaagcacucaaaaagugugauggccaacucagcacugcacaugagguugugcccuuugcaguguuuaagaacucaaagaaggucuaucuugauaagcuugaccucaagacugaggagaaucugcuaccagacucauuugucugcuucgagcauaagggacaguauaaaggaacaauggacucuggucagaccaagagggagcucaagagcuuugauaucucucagugccccaagauuggagggcaugguaguaagaagugcacuggggaugcagcauuuugcucugcuuaugaaugcacugcucaguaugccaaugccuauuguucacaugcuaaugggucagggauugugcagauucaaguaucaggggucuggaagaaaccuuuguguguaggguaugagagagugguugugaagagagaacucucugccaaacccauccagagaguugagccuugcacaacuugcauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggauauagggguucacauggcacacgaugaucagucaguuagcuccaaaauaguagcucacugccccccccaggacccgugcucagugcauggcugcauagugugugcucauggccugauaaauuaccagugucacacugcucucagugccuuuguuguuguauuuguauucaguucuauugcaauaauuugcuuagcuauucuuuauagggugcucaagugccuaaagauugccccaaggaaaguucugaauccacuaauguggauuacagccuucaucagauggguguauaagaagaugguugcuagaguggcggacaauauuaaucaagugaacagagaaauaggauggauggaaggaggucaguugguucuagggaacccugccccuauuccucgucaugccccaaucccacguuauagcacauaccuaaugcuacuauugauugucucacaugcaucagcauguucagaacuuauucaggcaagcuccagaaucaccacuugcuccacagagggugucaacaccaaguguagacugucuggcacagcauugaucagggcagggucaguuggggcggaggcuuguuugauguugaagggggucaaggaagaucaaacuaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggggaaagcacaaccaugcgagagaauaaguguuuugagcaguguggaggauggggguguggauguuucaauguaaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagaaauuccucggcaaggguuuuugggggagaucaggugcaauucagaguccucaguccuaagugcucaugaaucaugccuuagggcgccaaaccuuaucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccugucuaucacauccacaggaacuggaacucucucugcccacaauaaagacgggucucugcauauaguucucccaucagagaaugggacaaaagaucagugucagauacuacauuuuacuguaccugaaguagaagaggaguuuauguacucuugugauggagaugagcggccucuguuaguaaaagggacccugauggcuauugacccauuugaugauaggcgggaggcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4383 - RNA, 3594 nt, Artificial Sequence
  derived and/or modified CDS sequence (wt) from RVFV(200803162)__JF311377.1__GP
auguauguuuuauugacaauucuaaucucgguucuggugugugaagcgguuauuagagugucucuaagcuccacaagagaggaaaccuguuuuggugacuccaccaacccagagaugauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcggguggggauaguccggugugagagacgaagagaugcuaagcaaauagggagagaaaccauggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaauaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauagccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuaaggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccuguccaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4384 - RNA, 3594 nt, Artificial Sequence
  derived and/or modified CDS sequence (wt) from RVFV(2007001811)__EU574040.1__GP
auguauguuuuauugacaauucuaaucucgguucuggugugugaagcgguuauuagagugucucuaagcuccacaagagaggagaccuguuuuggugacuccaccaacccagagaugauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcgaguggggauaguccggugugagagacgaagagaugcuaagcaaauagggagagaaaccauggcagggauugcgaugacaguccuuccagccuuagcaguuuuugcuuuggcaccuguugucuuugcugaagacccccaucucagaaacagaccagggaaaggacacaacuacauugacgggaugacucaggaggaugccacaugcaaaccugugacauaugcuggggcauguagcaguuuugaugucuugcuugaaaaggggaaauuuccccuuuuccagucauaugcucaucauagaacucugcuagaggcaguucacgacaccaucauugcaaaggcugauccaccuagcugugaccuccagagugcucaugggaaucccuguaugaaagagaaacuugugaugaagacacauuguccuaacgacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggaugcagcauuuugcucugcuuaugaauguacugcucaguaugccaaugccuauuguucacaugcuaaugggucagggauugugcagauucaaguaucaggggucuggaagaaaccuuuaugugugggguaugagagagugguugugaagagagaacucucagccaaacccauccagagaguugagccuugcacaacuugcauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguuguuguauuuguauucaguucuauugcaauaauuugcuuagcuauucuuuauagggugcucaagugccuaaagauugccccaaggaaaguucugaauccacuaauguggauuacagccuucaucagauggguguauaagaagaugguugcuagaguggcggacaauauuaaucaagugaacagagaaauaggauggauggaaggaggucaguugguucuagggaaccccgccccuauuccucgucaugccccaaucccacguuauagcacauaccuaaugcuacuacugauugucucauaugcaucagcauguucagaacugauucaggcaagcuccagaaucaccacuugcuccacagagggugucaacaccaaguguagacugucuggcacagcauugaucagggcagggucaguuggggcggaagcuuguuugauguugaagggggucaaggaagaucaaaccaaguucuuaaugauaaaaacugucucaagugagcuaucgugcagggagggccagagcuauuggacuggguccuuuagccccaagugccugagcucaagaagaugccaucuugucggggaaugucaugugaauaggugucuguccuggagggacaaugaaacuucagcagaguuuucauuuguuggggaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauaguuuuucuuuuauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucguacaagcccaugauagaucaauuggagugcacuacaaaucugauugaucccuuuguugucuuugagagggguucucugccacagacaaggaaugaaaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccugucuaucacauccacaggaacugggacucucucugcccacaauaaggacgggucucugcauauaguucucccaucagagaaugggacaaaagaucagugucagauacuacauuucacuguaccugaaguagaagaggaguuuauguacucuugugauggagaugagcggccucuguuagugaaagggacccugauagcuauugacccauuugaugauaggcgggaggcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugcugcuacuaagaaggccucauag

SEQ ID NO: 4385 - RNA, 3594 nt, Artificial Sequence
  derived and/or modified CDS sequence (wt) from RVFV(clone 13)__DQ380213.1__GP
auguauguuuuauuaacaauucuaaucucgguucuggugugugaagcgguuauuagagugucucuaagcuccacaagagaagagaccugcuuuggugacuccaccaacccagagaugauugaaggagcuugggauucacucagagaggaggagaugccagaggagcucuccuguucuauaucaggcauaagagagguuaagaccucaagccaggaguuauacagggcauuaaaagccaucauugcugcugauggcuugaacaacaucaccugccaugguaaggauccugaggauaagauuucucucauaaaggguccuccucacaaaaagcggguggggauaguucggugugagagacgaagagaugcuaagcaaauagggagagaaaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaaggggaaauuuccccucuuccagucguaugcucaucauagaacucuacuagaggcaguucacgacaccaucauugcaaaggcugauccaccuagcugugaccuucagagugcucaugggaaucccugcaugaaagagaaacucgugaugaagacacacuguccaaaugacuaccagucagcucauuaccucaacaaugacgggaaaauggcuucagucaagugcccuccuaagcaugagcucacagaggacugcaacuuuuguaggcagaugacaggugcuagccugaagaaggggucuuauccucuccaagacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcacaagggacaguauaagggaacaauggacucuggucagacuaagagggagcucaaaagcuuugauauuucucagugccccaagauuggaggacaugguaguaagaagugcacuggggacgcagcauuuugcucugcuuaugagugcacugcucaguaugccaaugcuuauuguucacaugcuaaugggucagggauugugcagauacaaguaucaggggucuggaagaagccuuuauguguaggguaugagagagugguugugaagagagaacucucugccaagcccauccagaggguugagccuugcacaacuuguauaaccaaaugugagccucauggauugguuguccgaucaacaggguucaagauaucaucugcaguugcuugugcuagcggaguuugcgucacaggaucgcagaauccuuccaccgagaucacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugccacacugcucucagugccuuuguuguuguguucguguucaguucuauugcaauaauuuguuuagcuauucuuuauagggugcucaagugccuaaagauugccccaaggaaaguucugaauccacuaauguggauuacagccuucaucagauggguguauaagaagaugguugccagaguggcagacaauauuaaucaagugaauagggaaauaggauggauggaaggaggucaguugguccuagggaacccugccccuauuccucgccaugccccaauuccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuugucugauguugaagggggucaaggacgaucaaaccaaguucuuaaagauaaaaacugucucaagugagcuaucgugcagggagggccagagcuauuggacuggguccuuuagccccaaaugucugagcucaaggagaugccaucuugucggggaaugucaugugaauaggugucugucuuggagggacaaugaaacuucagcagaguuuucauuuguuggggaaagcacgaccaugcgagagaauaaguguuuugagcaguguggaggauggggauguggguguuucaaugugaacccaucuugcuuauuugugcacacguaucugcagucaguuagaaaagaggcccuuagaguuuuuaacuguaucgacugggugcauaaacuaacacuagagaucacagacuuugauggcucuguuucaacaauagaccuaggagcaucaucuagccguuucacaaacugggguucagucagccucucacuggacgcagagggcauuucaggcucaaauagcuuuucuuucauugagagcccaggcaaaggguaugcaauuguugaugagccauucucagaaauuccucggcaaggguuccugggggagaucaggugcaauucagaguccucaguccugagugcucaugaaucaugccuuagggcaccaaaccuuaucucauacaagcccaugauagaccaauuggagugcacaacgaaucugauugauccauuuguugucuuugagagggguucucugccacagacaaggaaugaaaaaaccuuugcagcuucaaaaggaaauagagguguccaagccuucucuaagggcucuguacaagcugaucuaacucugauguuugacaauuuugagguggauuuugugggagcagccguaucuugugaugccgccuucuuaaauuugacagguugcuauucuugcaaugcaggggccagggucugccugucuaucacauccacaggaacuggaacucucucugcccacaauaaggaugggucucugcauauaguucuuccaucagagaauggaacaaaagaucaaugccagauacuacacuucacuguaccugagguagaggaggaguuuauguacucuugugacggagaugagcggccucuguuggugaaggggacccugauagcuauugauccauuugaugauaggcgggaagcagggggggaaucaacaguugugaauccaaaaucuggaucuuggaauuucuuugacugguuuucuggacucaugaguugguuuggagggccucuuaaaacuauacuccuuauuugccuguauguugcauuaucaauugggcucuuuuuccuccucauauaucuuggaagaacaggccucucuaaaauguggcuugcugcuacuaagaaggccucauag

SEQ ID NO: 4386 - RNA, 3594 nt, Artificial Sequence
  derived and/or modified CDS sequence (wt) from RVFV(MP12)__Z30318.1__GP
auguauguuuuauuaacaauucuaaccucgguucuggugugugaagcgauuauuagagugucucuaagcuccacaagagaagagaccugcuuuggugacuccacuaacccagagaugauugaaggagcuugggauucacucagagaggaggagaugccggaggagcucuccuguucuauaucaggcauaagagagguuaagaccucaagccaggaguuauacagggcauuaaaagccaucauugcugcugauggcuugaacaacaucaccugccaugguaaggauccugaggacaagauuucccucauaaaggguccuccucacaaaaagcggguggggauaguucggugugagagacgaagagaugcuaagcaaauagggagaaaaaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucaucaccucaacaaugacgggaaaauggcuucagucaagugcccuccuaaguaugagcucacugaagacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcacacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaaguuaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaggaacaggccucucuaaaauguggcuugcugccacuaagaaggccucauag

SEQ ID NO: 4387 - RNA, 3594 nt, Artificial Sequence
  derived and/or modified CDS sequence (wt) from RVFV__JQ068143.1__GP
auguauguuuuacuaacaauucuaaucucgguucuggugugugaagcgguuauuagagugucucuaagcuccacaagagaagaaaccuguuuuggugacuccaccaacccagagaugauugaaggagccugggauucacucagagaggaggagaugccagaagagcucuccuguuccauaucuggcauaagggagguuaagaccucuagccaggaauuauacagggcauuaaaagccaucauugcugcugauggcuugaacaacaucaccugccaugguaaggauccugaggacaagauuucccucauaaaggguccuccucacaagaagcggguggggauaguucggugugagagacgaagggacgcuaagcaaauagggagagaaaccauggcagggauugcaaugacaguccuucccgccuuagcaguuuuugcuuuggcaccuguuguuuuugcugaggacccucaucucagaaacagaccagggaagggacacaacuacauugacgggaugacucaggaggaugccacaugcaaaccugugacauaugcuggggcauguagcaguuuugauguuuugcucgaaaagggaaaauucccccucuuccagucauaugcucaucauagaacucuacuagaggcaguucacgacaccaucauugcaaaggcugacccaccuagcugugaucuucagagugcucaugggaaccccugcaugaaagagaaacucgugaugaagacacacuguccaaaugacuaccagucagcucauuaucucaacaaugacgggaaaauggcuucagucaagugcccuccuaaguaugagcucacugaggacugcaacuuuuguaggcagaugacaggugcuagcuugaagaaggggucuuauccucuccaggacuuauuuugucagucaagugaggaugaugggucaaaauuaaagacaaaaaugaaaggggucugcgaaguggggguucaagcacucaaaaagugugauggccaacucagcacugcacaugagguugugcccuuugcaguguuuaagaacucaaagaagguuuaucuugacaagcuugaccucaagacugaagaaaaucugcuaccagacucauuugucugcuuugagcauaaaggacaguauaaaggaacaauagacucuggucagacuaagagagagcucaaaagcuuugauaucucucagugccccaagauuggaggacaugguagcaagaagugcacuggggacgcagcauuuugcucugcuuaugaguguacugcucaguaugccaaugccuauuguucacaugcuaaugggucugggauuguacagauacaaguguccggggucuggaagaagccucuguguguaggauaugagagagugguugugaagagagaacucucugccaagcccauccagagaguugagccuugcacaacuugcauaaccaaaugugagccucauggauugguuguccgaucaacaggguuuaagauaucaucugcaguugcuugugcuagcgggguuugcgucacaggaucgcagagcccuucuacugagaucacucuuaaguauccagggauaucccaauccucugggggggacauaggaguucacauggcacaugaugaucagucaguuagcuccaaaauaguggcucacugccccccccaggacccgugccuagugcauggcugcauagugugugcucauggcuugauaaauuaccagugucacacugcucucagugcuuuuguuguuguauucguauucagcucuguugcaauaauuugucuggccauccuuuauaaggugcucaggugccuaaagauugccccaaagaaaguucugaauccacuaauguggaucacugccuucaucagauggguguauaagaagaugguugccagaguggcagacaauaucaaucaagugaacagagaaauaggauggauggaaggaggccaguuggcucuagggaacccugcuccuauuccucgucaugcuccaauuccacguuauagcacguaucuaaugcuacuauugauuaucucauaugcaucagcauguucagaacugauucaggcaagcuccagaaucacuacuugcuccacagaaggugucaacaccaaguguaggcugucuggcacagcauuaaucagggcagggucaguuggggcagaggcuuguuuaauguuaaagggggucaaggaagaccagaccaaguucuugaagauaaaaacugucucaagugagcuaucgugcagggagggccagagcuauuggacuggguccuuuagccccaaaugucugagcucaaggagaugccaucuugucggggaaugucaugugaauaggugucugucuuggagggacaaugaaaccucagcagaauuuucauuuguuggggaaagcacgaccaugcgagagaauaaguguuuugagcaguguggaggauggggauguggauguuucaaugugaacccaucuugcuuauuugugcacacguaucugcagucaguuagaaaagaggcccuuagaguuuuuaacuguauugauugggugcauaaacucacucuagagaucacagacuuugauggcucuguuucaacaauagacuugggggcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggagagaucaggugcaauucagaaucuucuguccugagugcucaugaaucaugccuuagggcuccaaaccuuaucucauacaaacccaugauagaucaguuggagugcacaacaaaucugauugaucccuuuguugucuuugagaggggaucucugccacagacaaggaaugacaaaaccuuugcagcuucaaaaggaaauagggguguucaagcuuucucuaagggcucuguacaagcugaucuaacucugauguuugacaauuuugagguggacuuugugggggcagccgugucuugugaugccgccuucuuaaauuugacagguugcuauuccugcaaugcuggagccagagucugccugucuaucacauccacaggaacuggaacucuuucugcccacaauaaggaugggucucugcacauaguucuuccaucagagaauggaacaaaagaucagugucagauacuacacuucacuguaccugagguggaggaggaguuuauguacucuugugauggagaugagcggccuuuguuggugaaggggacccuaauagcuauugauccauuugaugauaggcgagaagcagggggagaaucaacaguugugaauccaaaaucuggaucuuggaacuucuuugacugguuuucuggacuuaugaguugguuuggagggccucuuaagacuauacuccuaauuugccuguauguagcauuaucaauugggcucuuuuuccuucuuauauaucucggaagaacaggucucucuaaaauguggcuugcugccacuaagaaagccucauag

SEQ ID NO: 4388 - RNA, 3594 nt, Artificial Sequence
  derived and/or modified CDS sequence (wt) from RVFV(2007002445)__EU574037.1__GP
auguauguuuuauugacaauucuaaucucgguucuggugugugaagcgguuauuagagugucucuaagcuccacaagagaggaaaccuguuuuggugacuccaccaacccagagaugauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcggguggggauaguccggugugagagacgaagagaugcuaagcaaauagggagagaaaccauggcagggauugcgaugacaguccuuccagccuuagcaguuuuugcuuuggcaccuguuguuuuugcugaagacccccaucucagaaacagaccagggaaggggcacaacuauauugacgggaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugaaaaaaccuuugcagcuucaaaaggaaauagagguguucaggcuuucucuaagggcucuauacaagcugaucugacucugauguuugauaauuuugagguggacuuugugggagcagccgugucuugugaugccgccuucuugaauuugacagguugcuauucuugcaacgcaggggccagagucugccuguccaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4389 - RNA, 3594 nt, Artificial Sequence
  derived and/or modified CDS sequence (wt) from RVFV(2008/00101)__HE687306.1__GP
auguauguuuuauugacaauucuaaucucgguucuggugugugaagcgguuauuagagugucucuaagcuccacaagagaggaaaccuguuuuggugacuccaccaacccagagaugauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcggguggggauaguccggugugagagacgaagagaugcuaagcaaauagggagagaaacuauggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcauucucuaagggcucuguacaagcugaucugacucugauguuugauaauuuugagguggacuuugugggagcagccgugucuugugaugccgccuucuugaauuugacagguugcuauucuugcaaugcaggggccagagucugccuguccaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuacacuccucauuugccuguauguugcauuaucaauugggcucuucuuccuccuuauauaucuuggaagaacaggccucucuaaaauguggcuugccgcuacuaagaaggccucauag

SEQ ID NO: 4390 - RNA, 3594 nt, Artificial Sequence
  derived and/or modified CDS sequence (wt) from RVFV(Hv-B375)__DQ380218.1__GP
auguauguuuuauuaacaauucuaaucucgguucuggugugugaagcgguuaucagagugucucuaagcuccacaagagaagagaccuguuuuggugacuccaccaacccagagaugauugaaggagcuugggauucacucagagagggggagaugccagaggagcucuccuguucuauaucaggcauaagggagguuaagaccucaagccaggaguuauacagggcauuaaaagccaucauugcugcugauggcuugaacaacaucaccugccaugguaaggauccugaggacaagauuucucucauaaaggguccuccucauaaaaagcggguggggauaguucggugugagagacgaagagaugcuaagcaaauagggagagaaaccauggcagggauugcaaugacaguccuuccagccuuggcaguuuuugcuuuggcaccuguuguuuuugcugaggacccccaucucagaaacagaccagggaaggggcacaacuacauugacgggaugacccaggaggaugccacaugcaaaccugugacauaugcuggggcauguagcaguuuugaugucuugcuugagaaggggaaauuuccccuuuuccagucguaugcucaucauagaacucuacuagaggcaguucacgacaccaucauugcaaaggcugauccaccuagcugugaccuucagagugcucaugggaaucccugcaugaaagagaaacucgugaugaagacacacuguccaaaugacuaccagucagcucauuaccucaacaaugacgggaaaauggcuucagucaagugcccuccuaagaaugagcucacugaggacugcaacuuuuguaggcagaugacaggugcuagccuaaagaaggggucuuauccucuccaagacuuauuuugccagucaagugaggaugauggaucaaaauuaaaaacaaaaaugaaaggggucugcgaaguggggguccaagcacucaaaaagugugauggccaacucagcaccgcacaugagguugugcccuuugcaguguucaagaacucaaagaagguuuaccucgauaagcuugaccucaagacugaggagaaucugcugccagacucauuugucugcuucgagcauaagggacaguauaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaagugucaggggucuggaagaagccuuuauguguaggguaugagagagugguugugaagagagaacucucugccaagcccauccagagaguugagccuugcacaacuuguauaaccaaaugugagccucaugguuugguuguccgaucaacaggguucaagauaucaucugcaguugcuugugcuagcggaguuugcgucacaggaucacagagcccuucuaccgagauuacacucaaguauccagggauaucccaguccucugggggggacauagggguucacauggcacacgaugaucagucaguuagcuccaaaauaguagcucacugcccuccccaggacccaugcuuagugcacggcugcauagugugugcucauggccugauaaauuaccagugucacacugcccucagugccuuuguuguuguguuuguauucaguucuauugcaauaauuuguuuagccauucuuuauagggugcucaagugcuuaaagauugccccaaggaaaguucugaauccacuaauguggaucacagccuucaucagauggguguauaagaagaugguugccagaguggcagacaauauuaaucaagugaacagggagauaggauggauggaaggaggucaguugguucuagggaacccugcuccuauuccucgucaugccccaauuccacguuauagcacauaccuaaugcuacugcuaauugucucauaugcaucagcauguucagaacuaauucaggcaagcuccagaaucacuacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaaaugucugagcucaaggagaugccaucuugucggggaaugucaugugaauaggugucugucuuggagggacaaugaaacuucagcagaguuuucauuuguuggggaaaguacgaccaugcgagagaauaaguguuuugagcaguguggaggauggggauguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaacucagaguccucaguccugagugcucaugaaucaugccuuagggcaccaaaccuuaucucauacaagcccaugauagaucaauuggagugcacaacaaaucugauugaucccuuuguuguauuugagagggguucucugccacagacaaggaaugacaaaaccuuugcagcuucaaaaggaaauagagguguucaagcuuucucuaagggcucugugcaagcugaucuaacucugauguuugacaauuuugagguggacuuugugggagcagcuguaucuugugaugccgccuucuuaaauuugacagguugcuauucuugcaaugcaggggccagggucugccugucuaucacauccacaggaacuggaacucucucugcccacaauaaggaugggucucugcauauaguucuuccaucagagaauggaacaaaagaucaaugccagauacuacacuucacuguaccugaaguagaggaggaguuuauguacucuugugauggagaugagcggccucuauuagugaaagggacccugauagcuauugauccauuugaugauaggcgggaagcagggggagaaucaacaguugugaauccaaaaucuggaucuuggaauuucuuugacugguuuucuggacucaugaguugguuuggagggccucucaaaacuauacuccucauuugccuguauguugcauuaucaauugggcucuuuuuccuccucauauaucuuggaagaacagggcucucuaaaauguggcuugcugcuacuaagaaggccucauag

SEQ ID NO: 4391 - RNA, 3594 nt, Artificial Sequence
  derived and/or modified CDS sequence (wt) from RVFV(763/70)__DQ380188.1__GP
auguauguuuuacuaacaauucugaucacgguucuggugugugaagcgguuauuagagugucucuaaguuccacaagagaagagaccugcuuuggugacuccaccaacccagagaugauugaaggagcuugggauucacucagagaggaggagaugccagaagagcucuccuguuccauaucaggcauaagggaggucaaaaccucaagccaggaauuauauagggcauuaaaagccaucauugcugcugauggcuugaacaacaucaccugccaugguaaggauccugaggauaagauuucucucguaaaggguccuccucacaaaaagcggguggggauaguucggugugagagacgaagagacgcuaagcaaauaggaagagaaaccauggcagggauugcaaugacaguccuuccagccuuagcaguuuuugcuuuggcaccuguuguuuuugcugaagacccucaucucagaaacagaccagggaaggggcacaacuacauugacgggaugacucaggaggacgccacaugcaaaccugugacauaugcuggggcuuguagcaguuuugaugucuugcucgaaaagggaaaauucccccucuuccagucguaugcccaucacagaacccuacuagaagcaguucacgacaccaucauugcaaaggcugauccaccuagcugugaccuucagagugcucaugggaaucccugcaugaaggagaaacucgugaugaagacacacuguccaaaugacuaccagucagcucauuaccucaacaaugacgggaaaauggcuucagucaagugcccuccuaaauaugggcucacugaggacugcaauuuuugcaggcagaugacaggugcuagcuugaagaaggggucuuauccucuucaggacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguauuuaagaacucaaagaagguuuaucuugauaagcuugaccucaagacugaggaaaaucuguugccagacucauuugucugcuucgagcauaagggacaguauaaaggaacaauggacucuggucagaccaagagggagcucaaaagcuuugauaucucucagugccccaagauuggaggacaugguagcaagaagugcacuggggacgcagcuuuuugcucugcuuaugagugcacugcucaauacgccaaugcuuauuguucacaugcuaaugggucaggaauuguacagauacaaguauccggggucuggaagaagccuuugugugucggguaugagagggugguugugaagagagaacucucugcuaagcccauccagagaguugagccuugcacaacuuguauaaccaaaugugagccucacggauugguuguccgaucaacagguuucaagauaucaucugcaguugcuugugcuagcggaguuugcguuacaggaucgcagagcccuucuaccgagaucacacucaaguauccagggauaucccaguccucugggggggacauagggguucacauggcacaugaugaucagucaguuagcuccaaaauaguagcucacugcccuccccaggauccaugccuagugcauggcugcauagugugugcucauggccugauaaauuaccagugucacacugcucucagugccuuuguuguuguguucguauuuagcucugucgcaauaauuuguuuggccauucuuuauaaaguucucaagugccuaaagauugccccaaggaaaguucugaauccacuaauguggauuacugcuuucaucagauggguguauaagaagaugguugccagaguggcagacaauaucaaucaggugaacagggaaauaggauggauggaaggaggccagcuggcucuagggaacccugccccuauuccucgucaugcuccaauuccacguuauagcacauacuuaaugcuacuauugauugucucauaugcaucagcauguucagaacugauucaggcaagcuccagaaucaccacuugcuccacagaaggugucaacaccaaguguaggcugucuggcacagcauuaaucagggcagggucaguuggggcagaggcuuguuugauguuaaagggggucaaggaagaccaaaccaaguuuuugaagauaaaaacugucucaagugagcuaucgugcagggagggccagagcuauuggacuggguccuuuagcccuaaaugucugagcucaaggagaugccaucuugucggggaaugucaugugaauaggugucugucuuggagagacaaugaaaccucagcagaauuuucauuuguuggggaaagcacgaccaugcgggagaauaaguguuuugagcaguguggaggauggggauguggguguuucaaugugaacccaucuugcuuauuugugcacacguaucugcagucagucagaaaagaggcccuuagaguuuucaacuguaucgauugggugcauaaacucacucuagagauuacugacuuugacggcucuguuucaacaauagaccugggagcaucaucuagccguuucacaaacugggguucaguuagccucucacuggacgcagagggcauuucaggcucaaacagcuuuuccuucauugagagcccaggcaaaggguaugcaauuguugaugagccauucucagaaauuccucggcaaggguucuugggggagaucaggugcaauucagaaucuucaguccugagugcucaugaaucaugccuuagggcaccaaaucuuauuucauacaagcccaugauagaucaguuggagugcacaacaaaucugauugaucccuuuguugucuuugagaggggcucucugccacagacaaggaaugacaaaaccuuugcagcuucaaaaggaaauagggguguucaagcuuucucuaagggcucuguacaggcugaucuaacacugauguuugacaauuuugagguggacuuugugggagcagccgugucuugugaugccgccuucuuaaauuugacagguugcuauuccugcaaugcaggggccagagucugccugucuaucacauccacaggaacuggaacucucucugcccacaauaaagaugggucucugcauauaguucuuccaucagagaauggaacaaaagaucagugucagauacuacacuucacuguaccugagguagaggaggaguuuauguacucuugugauggagaugagcggccucuguuggugaagggaacccugauagcuauugauccauuugaugauaggcgagaagcagggggggaaucaacaguugugaauccaaaaucuggaucuuggaauuucuuugacugguuuucuggacucaugaguugguuuggagggccucuuaagacuauacuccucauuugccuguauguagcauuaucaauugggcucuuuuuccuucuuauauaucuuggaagaacaggccucucuaaaauguggcuugcugccaccaagaaagccucauag

SEQ ID NO: 4392 - RNA, 3594 nt, Artificial Sequence
  derived and/or modified CDS sequence (wt) from RVFV(RVFBJ01/2016)__KX785331.1__GP
auguauguuuuacuaacaauucuaaucucgguucuggugugugaagcgauuauuagagugucucuaagcuccacaagagaggaaaccuguuuuggugacuccaccaacccagagaugauugaaggagcuugggauucacucagagaggaggagaugccagaagagcucuccuguuccauaucuggcauaagggaggucaagaccucaagccaggaauuauacagggcauuaaaagccaucauugcugcugauggcuugaacaacaucaccugccaugguaaggauccugaggacaaaauuucucucauaaaggguccuccucacaagaagcggguggggauaguucggugugagagacgaagggacgcuaagcaaauagggagagaaaccauggcagggauugcaaugacaguucuucccgccuuagcaguuuuugcuuuggcaccuguuguuuuugcugaggacccucaucucagaaacagaccagggaagggacauaacuacauugacgggaugacucaggaggaugccacaugcaaaccugugacauaugcuggggcauguagcaguuuugauguuuugcucgaaaagggaaaauucccccucuuccagucauaugcucaucauagaacucuacuagaggcaguucacgacaccaucauugcaaaggcugauccaccuagcugugaucuccagagugcucaugggaaucccugcaugaaagagaaacucgugaugaagacacacuguccaaaugacuaccagucagcucauuaccucaacaaugacgggaaaauggcuucagucaagugcccuccuaagcaugagcuuacugaggacugcaacuuuuguaggcagaugacaggugcuagcuugaagaaggggucuuauccucuccaggacuuauuuugucagucaagugaggaugauggaucaaaacuaaagacaaaaaugaaaggggucugcgaaguggggguucaggcacucaaaaagugugauggccaacucagcacugcacaugagguugugcccuuugcaguguuuaagaauucaaagaagguuuaucuugacaagcuugaccuuaagacugaagaaaaucugcuaccagacucauuugucugcuuugagcauaagggacaguauaaaggaacaauggacucuggucagacuaagagggagcucaaaagcuuugauaucucucagugccccaagauugggggacaugguagcaagaagugcacuggggacgcagcauuuugcucugcuuaugaguguacugcucaauaugccaaugccuauuguucacaugcuaaugggucugggauuguacagauacaaguauccggggucuggaagaagccuuuaugugugggguaugagagagugguugugaagagagaacucucugccaagcccauccagagaguugagccuugcacaacuugcauaaccaaaugugagccucauggauugguuguccgaucaacaggguucaagauaucaucugcaguugcuugugccagcggaguuugcgucacaggaucgcagagcccuucuacugagaucacucucaaguauccagggauaucccaguccucugggggggauauagggguucacauggcacaugaugaucagucaguuagcuccaaaauaguggcucacugccccccccaggacccgugccuagugcauggcugcauagugugugcucauggcuugauaaauuaccagugucacacugcucuuagugcuuuuguuguuguguucguauucagcucuguugcaauaauuugucuggccauucuuuauaaggugcucaggugccuaaagauugccccaaagaaaguucugaauccacuaauguggaucacugccuucaucagauggguguauaagaagaugguugccagaguggcagacaauaucaaucaagugaacagagaaauaggauggauggaaggaggccaguuggcucuagggaacccugcacccauuccucgucaugcuccgauuccacguuauagcacauaccuaaugcuacuauugauuaucucauaugcaucagcauguucagaacugauucaggcaagcuccagaaucaccacuugcuccacagaaggugucaacaccaaguguaggcugucuggcacagcauuaaucagggcagggucaguuggggcagaggcuuguuuaauguuaaagggggucaaggaagaccagaccaaguucuugaagauaaaaacugucucaagugagcuaucgugcagggagggccagagcuauuggacuggguccuuuagccccaaaugucugagcucaaggagaugccaucuugucggagaaugucaugugaauaggugucugucuuggagggacaaugaaacuucagcagaauuuucauuuguuggggaaagcacgaccaugcgagagaauaaguguuuugagcaguguggaggauggggauguggauguuucaaugugaacccaucuugcuuauuugugcacacguaucugcaaucaguuagaaaagaggcucuuagaguuuuuaacuguauugauugggugcauaaacucacucuagagaucacagacuuugauggcucuguuucaacaauagacuugggagcaucaucuagccguuucacaaacuggggcucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaaucuucuguccugagugcucaugagucaugccuuagggcaccaaaccuuaucucauacaaacccaugauagaucaguuggagugcacaacaaaucugauugaucccuuuguugucuuugagaggggaucucugccacagacaaggaaugacaaaaccuuugcagcuucaaaaggaaauagggguguucaagcuuucucuaaaggcucuguacaggcugaucuaacucugauguuugacaauuuugagguggacuuugugggagcagccgugucuugugaugccgccuucuuaaauuugacagguugcuauuccugcaaugcuggagccagagucugccugucuaucacauccacaggaacuggaacucuuucugcccacaauaaggaugggucucugcauauaguucuuccaucagagaauggaacaaaagaucagugucagauacuacacuucacuguaccugagguggaggaggaguucauguacucuugugauggagaugagcgaccuuuguuggugaaggggacccuaauagcuauugauccauuugaugauaggcgagaagcagggggagaaucaacaguugugaauccaaaaucuggaucuuggaacuucuuugacugguuuucuggacuuaugaguugguuuggaggaccucuuaagacuauacuccuaauuugccuguauguagcauuaucaauugggcucuuuuuccuucuuauauaucuuggaagaacaggucucucuaaaauguggcuugcugccacuaagaaagccucauag

SEQ ID NO: 4393 - RNA, 3594 nt, Artificial Sequence
  derived and/or modified CDS sequence (wt) from RVFV(Lunyo)__KU167026.1__GP
auguauguuuuacuaacaauucuaaucucgguuuuggugugugaagcgguuauuagagugucucuaagcuccacaagagaagagaccuguuuuggugacuccaccaacccagagaugauugaaggagcuugggauucacucagagaggaggagaugccagaagaacucuccuguucuauaucaggcauaagagagguuaaaaccucaagccaggaauuauacagggcauuaaaagccaucauugcugcugauggcuugaacaacaucaccugccaugguaaggauccugaggacaagauuucucucauaaaggguccuccucacaaaaagcggguggggauaguucggugugagagacgaagagacgcuaagcaaauagggagagaaaccauggcagggauugcaaugacaguccuuccagccuuagcaguuuuugcuuuggcaccuguuguuuuugcugaagacccucaucucagaaauagaccagggaaggggcacaacuacauugacgggaugacucaggaggaugccacauguaaaccugugacauaugcuggggcauguagcaguuuugaugucuugcuugaaaagggaaaauuuccccucuuccagucguaugcucaucauagaacucuacuggaggcaguucaugacaccaucauugcaaaggcugauccaccuagcugugaccuucagagugcucaugggaaucccugcaugaaagagaaacucgugaugaagacacacuguccaaaugacuaccagucagcucauuaccucaacaaugacgggaaaauggcuucagucaagugcccuccuaaguaugagcucacugaagacugcaacuuuuguaggcagaugacaggugcuagcuugaagaaggggucuuauccccuccaggaccuauuuugucagucaagugaggaugauggaucaaaauuaaaaacaaaaaugaaaggggucugcgaaguugggguucaagcacucaaaaagugugauggccaacucagcacugcacaugagguugugcccuuugcaguguuuaagaacucaaagaagguuuaucuugauaagcuugaccucaagacugaggaaaaucugcuaccagacucauuugucugcuucgagcacaagggacaguauaaaggaacaauggucucuggucagacuaagagggagcucaaaagcuuugauaucucucagugucccaagauuggaggacaugguagcaagaagugcacuggggacgcagcauuuugcucugcuuaugagugcacugcucaauaugccaaugccuauugcucacaugcuaauggaucaggaauuguacagauacaaguauccggggucuggaagaagccuuuauguguaggguaugagagagugguugugaagagagaacucucugccaagcccauccagagaguugagccuugcacaacuuguauaaccaaaugugagccucauggauugguuguccggucaacaggguucaagauaucaucugcaguugcuugugcuagcggaguuugcgucacaggaucgcagaguccuucuaccgagauuacacucaaguauccagggauaucccaguccucugggggggacauagggguucacauggcacaugaugaucagucaguuaguuccaaaauaguagcucacugcccuccccaggacccgugccuagugcauggcugcauagugugugcucauggccugauaaauuaccagugucacacugcucucagugccuuuguuguuguguucguauucagcucuguugcaauaauuuguuuggccauucuuuauaaggugcucaagugccuaaagauugccccaaggaaaguucugaauccacuaauguggauuacugccuucaucagauggguguauaagaagaugguugccagaguggcagacaauaucaaucaagugaacagggaaauaggauggauggaaggaggucaguuggcucuagggaacccugccccuauuccucgucaugcuccaauuccacguuauagcacauaccuaaugcuacuauugauugucucauaugcaucagcauguucagaacugauucaggcaagcuccagaaucaccacuugcuccacagaaggugucaacaccagguguaggcugucuggcacagcauuaaucagggcagggucaguuggggcagaggcuuguuugauguuaaagggggucaaggaagaccaaaccaaguucuugaagauaaaaacugucucaagugagcuaucgugcagggagggccagagcuauuggacuggauccuuuagccccaaaugucugagcucaaggagaugccaucuugucggggaaugucaugugaauaggugucugucuuggagggacaaugaaacuucagcagaauuuucauuuguuggggaaagcacgacuaugcgagagaauaaauguuuugagcaguguggaggauggggauguggguguuucaaugugaacccaucuugcuuauuugugcacacguaucugcagucaguuagaaaagaggcccuuagaguuuucaacuguaucgauugggugcauaaacucacucuagagauuacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaaucuucaguccugagugcucaugaaucaugccuuagggcaccaaaccuuauuucauacaagcccaugauagaucaguuggagugcacaacaaauuugauugaucccuuuguugucuuugagagggguucucuaccacagacaaggaaugacaaaaccuuugcagcuucaaaaggaaauagggguguucaagcuuucucuaagggcucuguacaagcugaccuaacucugauguuugacaauuuugagguggacuuugugggggcagccgugucuugugaugccgccuucuuaaauuugacagguugcuauuccugcaaugcaggggccagagucugccugucuaucacauccacaggaacuggaacucucucugcccacaauaaggaugggucucugcauauaguucuuccaucagagaauggaacaaaagaucagugucagauacuacacuucacuguaccugagguggaggaggaguuuauguacucuugugauggagaugagcggccucuguuggugaaggggacccugauagcuauugauccauuugaugauaggcgagaagcagggggggaaucaacaguugugaauccaaaaucuggaucuuggaauuucuuugacugguuuucuggacucaugaguugguuuggagggccccuuaagacuauacuccuuauuugccuguauguagcauuaucaauugggcucuuuuuccuucuuauauaucuuggaagaacaggucucucuaaaauguggcuugcugccacuaagaaagccucauag

SEQ ID NO: 4394 - RNA, 3594 nt, Artificial Sequence
  derived and/or modified CDS sequence (wt) from RVFV(2007000234)__JF326191.1__GP
auguauguuuuauugacaauucuaaucucgguucuggugugugaagcgguuauuagagugucucuaagcuccacaagagaggaaaccuguuuuggugacuccaccaacccagagaugauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcggguggggauaguccggugugagagacgaagagaugcuaagcaaauaaggagagaaaccauggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccugucuaucacauccacaggaacuggaacucucucugcccacaauaaggacgggucucugcauauaguucucccaucagagaacgggacaaaagaucagugucagauacuacauuuuacuguaccagaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4395 - RNA, 3594 nt, Artificial Sequence
  derived and/or modified CDS sequence (wt) from RVFV(KEN07-KUR340)__EF460404.1__GP
auguauguuuuauugacaauucuaaucucgguucuggugugugaagcgguuauuagagugucucuaagcuccacaagagaggaaaccuguuuuggugacuccaccaacccagagaugauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucuuauaaaggguccuccucacaaaaagcggguggggauaguccggugugagagacgaagagaugcuaagcaaauagggagagaaaccauggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugacccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugacaucucucagugccccaagauuggagggcaugguaguaagaagugcacuggggacgcagcauucugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauaggaugcucaagugcuuaaagauugccccaaggauaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucgucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccugucuaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4396 - RNA, 3594 nt, Artificial Sequence
  derived and/or modified CDS sequence (wt) from RVFV(2373/74)__DQ380194.1__GP
auguauguuuuacuaacaauucuaaucucgguucuggugugugaagcaguuauuagagugucucuaagcuccacaagagaagaaaccuguuuuggugacuccaccaacccagagaugauugaaggagcuugggauucacucagagaggaggagaugccagaagagcucuccuguuccauaucaggcauaagagagguuaagaccucaagccaggaauuauacagggcacuaaaagccaucauugcugcugauggcuugaacaacaucaccugcuaugguaaggauccugaggacaagauuucucucauaaaggguccuccucacaaaaagcggguggggauaguucggugugagagacgaagagaugcuaagcaaauagggagagaaaccauggcagggauugcaaugacaguccuuccagccuuagcaguuuuugcuuuggcaccuguuguuuuugcugaagacccucaucucagaaacagaccagggaaggggcacaacuacauugacgggaugacucaggaggaugccacauguaaaccugugacauaugcuggggcauguagcaguuuugaugucuugcucgaaaagggaaaauucccccucuuccagucauaugcucaucauagaacucuacuagaggcaguucacgacaccaucauugcaaaggcugacccaccuagcugugaccuccagagugcucaugggaaucccugcaugaaagagaaacucgugaugaagacacacugcccaaaugacuaccagucagcucauuaccucaacaaugacgggaaaauggcuucagucaagugcccuccuaaguaugagcucacugaggacugcaacuuuuguaggcagaugacaggugcuagcuugaagaaggggucuuauccucuccaggacuuguucugucaaucaagugaggaugauggaucaaaauuaaaaacaaaaaugaaaggggucugcgaaguggggguucaagcacucaaaaagugugauggccaacucagcacugcacaugagguugugccauuugcaguguuuaaaaacucaaagaagguuuaucuugacaagcuugaccucaagacugaggaaaaucugcuaccagacucauuugucugcuucgagcauaagggacaguauaaagggacaauggacucuggucagacuaagagggagcucaaaaguuuugauaucucucagugccccaagauuggaggacaugguagcaagaagugcacuggggacgcagcauuuugcucugcuuaugagugcacugcucaauacgccaaugccuauuguucacaugcuaaugggucaggaauuguacagauacaaguauccggggucuggaagaagccuuuauguguaggauaugagagagugguugugaagagagaacucucugcuaagcccauccagagaguugagccuugcacaacuuguauaaccaaaugcgagccucauggguugguuguccgaucaacaggguucaagauaucuucugcaguugcuugugcuagcggaguuugcgucacaggaucacagagcccuucuaccgagauuacacucaaguauccaggaauaucccaguccucugggggggacauagggguucacauggcacaugaugaucagucaguuagcuccaaaaugguagcucacugccccccccaggacccgugccuagugcauggcugcauagugugugcucauggcuugauaaauuaccagugucacacugcucucagugccuuuguuguuguguucguauucagcucuguugcaauaauuuguuuggccauucuuuauaaggugcucaagugccuaaagauugccccaaggaaaguucugaauccacuaauguggauuacugccuucaucagguggguguauaagaagaugguugccagaguggcagacaauaucaaucaagugaacagggaaauaggauggauggaaggaggccaguuggcucuagggaacccugccccuauuccucgucaugccccaauuccacguuauagcacauaccuaaugcuacuauugauugucucauaugcaucagcauguucagaacugauucaggcaagcuccagaaucaccaccugcuccacagaaggugucaacaccaaguguaggcugucuggcacagcauuaaucagggcagggucaguuggggcagaggcuuguuugauguuaaagggggucaaagaagaccaaaccaaguucuugaagauaaaaacugucucaagugagcuaucgugcagggaaggccagagcuauuggacuggguccuuuagccccaaaugccugagcucaaggaggugccaucuugucggggaaugucaugugaauaggugucugucuuggagggacaaugaaacuucugcagaauuuucauuuguuggggaaagcacgaccaugcgagagaauaaguguuuugagcaguguggaggauggggauguggguguuucaaugugaauccaucuugcuuauuugugcacacguaucugcagucgguuagaaaagaggcccuuagaguuuucaacuguauugauugggugcauaaacucacucuagagaucacagacuuugauggcucuguuucaacauuagacuugggagcaucaucuagccguuucacaaacugggguucgguuagccucucacuggaugcagagggcauuucaggcucaaauagcuuuucuuucauugagagcccaggcaaaggguaugcaauuguugaugagccauucucagaaauuccucggcaaggguucuugggagagaucaggugcaauucagaaucuucaguccugagugcucaugaaucaugccuuagggcaccaaaccuuaucucauacaagccuaugauagaucaguuggagugcacaacaaaucugauugaucccuuuguugucuuugagagggguucucugccacagacaaggaaugaaaaaaccuuugcagcuucaaaaggaaauagggguguucaagcuuucuccaagggcucuguacaagcugaucuuacucugauguuugacaauuuugagguggacuuugugggagcagccgugucuugugaugccgccuucuuaaauuuaacagguugcuauuccugcaaugcaggagccagagucugcuugucuaucacauccacaggaacuggaacucucucugcccacaauaaggaugggucucugcacauaguucuuccaucagagaauggaacaaaagaucagugucagauacuacacuucacuguaccugagguggaggaggaguuuauguacucuugugauggagaugagcggccucuauuggugaaggggacccugauagcuauugauccauuugaugauaggcgagaagcaggaggggaaucaacaguugugaauccaaaaucugguucuuggaauuucuuugacugguuuucuggacuuaugaguugguuuggagggccucuuaagaccauacuccuaauuugccuguauguggcauuaucaauugggcucuuuuuccuccuuauauaucuuggaagaacaggucucucuaaaauguggcuugcugccacuaagaaagccucauag

SEQ ID NO: 4397 - RNA, 3594 nt, Artificial Sequence
  derived and/or modified CDS sequence (wt) from RVFV(200803169)__JF311384.1__GP
auguauguuuuauugacaauucuaaucucgguucuggugugugaagcgguuauuagagugucucuaagcuccacaagagaggaaaccuguuuuggugacuccaccaacccagagaugauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcggguggggauaguccggugugagagacgaagagaugcuaagcaaauagggagagaaaccauggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugacccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugacaucucucagugccccaagauuggagggcaugguaguaagaagugcacuggggacgcagcauucugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaagguagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagauuccucggcaaggguucuugggggaggucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccugucuaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4398 - RNA, 3594 nt, Artificial Sequence
  derived and/or modified CDS sequence (wt) from RVFV(200803167)__JF311382.1__GP
auguauguuuuauugacaauucuaaucucgguucuggugugugaagcgguuauuagagugucucuaagcuccacaagagaggagaccuguuuuggugacuccaccaacccagagaugauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcggguggggauaguccggugugagagacgaagagaugcuaagcaaauagggagagaaaccauggcagggauugcgaugacaguccuuccagccuuagcaguuuuugcuuuggcaccuguuguuuuugcugaagaccuccaucucagaaacagaccagggaaggggcacaacuacauugacgggaugacucaggaggaugccacaugcaaaccugugacauaugcuggggcauguagcaguuuugaugucuugcuugaaaaggggaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguaggcagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaaugggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauugcacucaaguauccagggauaucccaguccucugggggggauauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguuguuguauuuguauucaguucuauugcaauaauuugcuuagcuauucuuuauagggugcucaagugccuaaagauugccccaaggaaaguucugaauccacuaauguggauuacagccuucaucagauggguguauaagaagaugguugcuagaguggcggacaauauuaaucaagugaacagggaaauaggauggauggaagggggucaguugguucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugucugagcucaaggagaugccaucuugucggggaaugucaugugaauaggugucugucuuggagggacaaugaaacuucagcagaguuuucauuuguuggggaaagcacaaccaugcgagagaauaaguguuucgagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccugucuaucacauccacaggaacuggaacucucucugcccacaauaaggacgggucucugcauauaguucucccaucagagaaugggacaaaagaucagugucagauacuacauuucacuguaccugaaguagaagaggaguuuauguacucuugugauggagaugagcggccucuguuagugaaagggacccugauagcuauugacccauuugaugauaggcgggaagcagggggggaaucaacaguugugaauccaaaaucuggaucuuggaauuucuuugacugguuuucuggacucaugaguugguuuggagggccgcuuaaaacuaugcuccucauuugccuguauguugcauuaucaauugggcucuucuuccuccuuauauaucuuggaagaacaggccucucuaaaauguggcuugccgcuacuaagaaggccucauag

SEQ ID NO: 4399 - RNA, 3594 nt, Artificial Sequence
  derived and/or modified CDS sequence (wt) from RVFV(Entebbe)__DQ380191.1__GP
auguaugcuuuacuaacaauucuaaucucgguucuggugugugaagcgguuauuagagugucucuaagcuccacaagagaagaaaccuguuuuggugacuccaccaacccagagaugauugaaggagcuugggauucacucagagaggaggagaugccagaggagcucuccuguuccauaucaggcauaagggagguuaagaccucaagccaggaauuacacagggcauuaaaagccaucauugcugcugauggcuugaacaacaucaccugccaugguaaggauccugaggacaagauuucucucauaaaagguccuccucacaaaaagcggguggggguaguucggugugagagacgaagagacgcuaagcaaauagggagagaaaccauggcagggauugcaaugacaguccuuccagccuuagcaguuuuugcuuuggcaccuguuguuuuugcugaagacccucaucucagaaacagaccagggaagggacacaacuacauugacgggaugacucaggaggaugccacauguaaaccugugacauaugcuggggcauguagcaguuuugaugucuugcucgaaaagggaaaauuuccccucuuccagucguaugcucaucauagaacucuauuagaggcaguucacgacaccaucauugcaaaggcugauccaccuagcugugaccuucagagugcucaugggaaucccugcaugaaagagaaacucguaaugaagacacacuguccaaaugacuaccagucagcucauuaccucaacaaugacgggaaaauggcuucagucaagugcccuccuaaguaugagcucacugaggacugcaacuuuuguaggcagaugacaggugcuagcuugaagaaggggucuuauccucuccaagacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugacaagcuugaccucaagacugaggaaaaucugcuaccagacucauuugucugcuucgagcauaagggacaguacaaaggaacaauggacucuggucagauuaagagggagcucaaaagcuuugauaucucucagugccccaagauuggaggacaugguagcaagaagugcacuggggacgcagcauuuugcucugcuuaugaguguacugcucaauacgccaaugccuauuguucacaugcuaaugggucaggaauuguacagauacaaguauccggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucugcaguugcuugugcuagcggaguuugcgucacaggaucgcagagcccuucuacugagauuacacucaaguauccagggauaucccaguccucugggggagacauagggguucacauggcacaugaugaucagucaguuagcuccaaaauaguagcucacugccccccccaggacccgugccuagugcauggcugcauagugugugcucauggcuugauaaauuaccagugucacacugcucucagugccuuuguuguuguguucguauucagcucuguugcaauaauuuguuuggccauucuuuauaaggugcucaagugccuaaagauugccccaaggaaaguucugaauccacuaauguggauuacugccuucaucagauggguguauaagaagaugguugcuagaguggcagacaauaucaaucaagugaacagggaaauaggauggauggaaggaggccaguugguucuagggaacccugccccuauuccucgucaugcuccaauuccacguuauagcacauaccuaaugcugcuauugauugucucauaugcaucagcauguucagaacuaauucaggcaagcuccagaaucaccaccugcuccacagaaggugucaacaccaaguguaggcugucuggcacagcauuaaucagggcagggucaguuggggcagaggcuuguuugauguuaaagggggucaaggaagaccagaccaaguucuugaagauaaaaacugucucaagugagcuaucguguagggagggccagagcuauuggacuggguccuuuagccccaaaugucugagcucaaggagaugccaucuugucggagaaugucaugugaauaggugucugucuuggagggacaaugagacuucagcagaauuuucauuuguuggggaaagcacgaccaugcgagagaauaaguguuuugagcaguguggaggauggggauguggguguuucaaugugaacccaucuugcuuauuugugcacacguaucugcagucaguuagaaaagaggcccuuagaguuuuuaacuguauugauugggugcauaaacucacucuagagaucacagacuuugauggcucuguuucaacaguagacuugggagcaucaucuagccguuucacaaacugggguucaguuagccucucacuggacgcagagggcauuucaggcucaaauagcuucucuuucauugagagcccaggcaaaggguaugcaauuguugaugagccauucucagaaauuccucggcaaggguucuugggagagaucaggugcaauucagaaucuucaguccugagugcucaugaaucaugccuuagggcaccaaaccuuaucucauacaaacccaugauagaucaguuggagugcacaacaaaucugauugaucccuuuguugucuuugagagggguucucugccucagacaaggaaugacaaaaccuuugcagcuucaaaaggaaauagggguguucaagcuuucucuaagggcucuguacaagcugaucuaacucugauguuugacaauuuugagguggacuuugugggagcagccgugucuugugaugccgccuucuuaaacuugacagguugcuauuccugcaaugcaggggccagagucugucugucuaucacaucuacaggaacuggaacucuuucugcccacaauaaggaugggucucugcauauaguucuuccaucagagaauggaacaaaagaucagugucagauacuacacuucacuguaccugagguggaggaggaguuuauguacucuugugauggagaugagcggccucuguuggugaaggggacccugauagcuauugauccauuugaugauaggcgagaagcagggggggaaucaacaguugugaauccaaaaucuggaucuuggaacuucuuugacugguuuucuggacuuaugaguugguuuggagggccucuuaagacuauacuccuaauuugccuguauguagcauuaucaauugggcucuuuuuccuucuuauauaucuuggaagaacaggucucuccaaaauguggcuugcugccacuaagaaagcuucauag

SEQ ID NO: 4400 - RNA, 3594 nt, Artificial Sequence
  derived and/or modified CDS sequence (wt) from RVFV(25010-24)__KM210509.1__GP
auguauguuuuacuaacaauucuaaucucgguucuggugugugaagcgguuauuagagugucucuaagcuccacaagagaagaaaccuguuuuggugacuccaccaacccagaaaugauugagagagcuugggauucacucagagaggaggagaugccagaagagcucucuuguuccauaucaggcauaagggagguuaagaccucaagccaggaauuauacagggcauuaaaagcuaucauugcugcugauggcuugaacaacaucaccugccaugguaaggauccugaggacaagauuucucucauaaaggguccuccucacaagaagcgaguggggauaguucggugugagagacgaagagacgcuaagcaaguagggagagaaaccauggcagggauugcaaugacaguccuuccagccuuagcaguuuuugcuuuggcaccuguugucuuugccgaagacccucaucuuagaaacaggccaggaaagggacacaacuacauugacgggaugacucaggaggaugccacauguaaaccugugacauaugcuggggcauguagcaguuuugaugucuugcucgaaaagggaaaauuuccccucuuccagucauacgcucaucauagaacucuacuagaggccguccacgacaccauuauugcaaaggcugauccaccuagcugugaccuucagagugcucaugggaaucccugcaugaaggagaaacucgugaugaagacacacuguccaaaugacuaccagucagcucauuaccuuaacaaugacgggaaaauggccucagucaagugcccuccuaaguaugagcucacugaggacugcaacuuuuguaggcagaugacaggugcuagccugaagaaagggucuuauccucuccaggacuuauuuugucagucaagugaggaugaugggucaaaauuaaaaacaaaaaugaaaggggucugcgaagugggaguucaagcacucaaaaagugugauggccaacucagcacugcacaugagguugugcccuuugcaguauuuaagaacucaaagaagguuuaucuugacaagcuugaccucaagacugaggaaaaucugcuaccagacucauuugucugcuucgagcauaaggggcaguauaaaggaacaauggacucuggucagacaaagagggagcucaaaagcuuugauaucucucagugucccaagauuggagggcaugguagcaagaaauguacuggggacgcagcauucugcucugcuuaugagugcacugcucaauacgccaaugccuauuguucacaugcuaaugggucaggaauuguacagauacaaguauccggggucuggaagaagccuuuguguguaggguaugagagagugguugugaagagagagcucucugccaagcccauccagagaguugagccuugcacaacuuguauaaccaaaugugagccucauggauuaauuguccgaucaacaggguucaagauaucaucugcaguugcuugugcuagcggaguuugcgucacaggaucgcagagcccgucuacugagaucacacucaaguacccagggauaucccaguccucugggggggacauagggguucacauggcacaugaugaucagucaguuagcuccaaaauaguagcucacugccccccccaggacccgugccuagugcauggcugcauagugugugcucauggcuugauaaauuaccagugucacacugcucucagugccuuugucguuguguucguguucagcucuguugcaauaauuuguuuggcuauucuuuauaaggugcucaagugccuaaaaauugccccaaagaaaguucuaaauccacugauguggauuacugcuuucaucagauggguguauaagaagaugguugccagaguggcagacaauaucaaucaagugaacagggaaauaggauggauggaaggaggccaguuagcucuagggaauccugcuccuaucccucgucaugcuccaauuccacguuauagcacauaccuaaugcuacuauugauugucucauaugcaucagcauguucagaacugauucaggccagcuccagaaucacuacuugcuccacagaagguguuaacacuaaguguaggcugucuggcacagcauugaucagggcaggaucaguuggagcagaagcuugucugauguuaaagggggucaaggaugaccaaaccaaguuccugaagauaaaaacugucucaagugagcuaucgugcagggagggccagagcuauuggacuggguccuucagccccaaaugucugagcucaaggaggugccaucuugucggggaaugucaugugaauaggugucugucuuggagggacaaugagacuucagcagaauuuucauuuguuggggaaagcacgaccaugcgagagaacaaguguuuugagcaguguggaggauggggauguggguguuucaacguaaacccaucuugcuuguuugugcacacguaucuacagucagucagaaaagaggcccuuagaguuuuuaacugcauugauugggugcauaaacuuacucuagagaucacagacuuugauggcucuguuucaacaauagacuugggagcuucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggauucuuaggagagaucaggugcaauucagaaucuucaguucugagugcucaugaaucaugccuuagggcgccaaaccuuaucucauacaaaccaaugauagaucaguuggagugcacaacaaaucuaauugauccuuuuguagucuuugagagggguucccugccacaaacaaggaaugacaaaaccuuugcagcuucaaaagggaauagggguguucaagcuuucucuaagggcucuguacaagcugaucuaacucugauguuugacaauuuugagguggacuucgugggagcagccgugucuugugaugccgccuucuugaauuugacagguugcuauucaugcaaugcaggagccagagucugccugucuaucacauccacaggaacuggaacucuuucugcccacaauaaggaugggucucugcauauaguucuuccaucagagaauggaacaaaagaucagugucagauacuacacuucacuguaccugagguggaggaggaguuuauguacucuugugauggagaugagcggccucuguuggugaaagggacccugauagcuauugauccauuugaugauaggcgagaagcagggggggaaucaacaguugugaauccaaaaucuggaucuuggaauuucuuugacugguuuucuggacucaugaguugguuuggagggccucucaagacuauacuccuaauuugccuguauguagcauuaucaauugggcucuuuuuccuucuuauauaucuugggagaacaggucucucuaaaauguggcuugcugcuacuaagaaggccucauag

SEQ ID NO: 4401 - RNA, 3594 nt, Artificial Sequence
  derived and/or modified CDS sequence (wt) from RVFV(Kenya 9800523)__DQ380196.1__GP
auguauguuuuauugacaauucuaaucucgguucuggugugugaagcgguuauuagagugucucuaagcuccacaagagaggagaccuguuuuggugacuccaccaacccagagaugauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcggguggggauaguccggugugagagacgaagagauacuaagcaaauagggagagaaaccauggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaaggggaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguaggcagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcauaagggacaguauaaaggaacaauggacucuggccagaccaagagggagcucaaaagcuuugauaucucucagugccccaagauuggagggcacgguaguaagaagugcacuggggacgcagcauuuugcucugcuuaugaaugcacugcucaguaugccaaugccuuuuguucacaugcuaaugggucagggauugugcagauucaaguaucaggggucuggaagaagccuuuauguguaggguaugagagagugguugugaagagagaacucucugccaaacccauccagagaguugagccuugcacaacuuguauaaccaaaugugaaccucauggauugguuguccgaucaacaggguucaagauaucaucugcaguugcuugugcuagcggaguuugcgucacagggucgcagaguccuucuacugagauuacacucaaguauccagggauaucccaguccucugggggggacauagggguucacauggcacaugaugaucagucaguuagcuccaaaauaguagcucacugcccuccccaggacccgugcuuagugcauggcugcauagugugugcucauggccugauaaauuaccagugucacacugcucucagugccuuuguuguuguauuuguauucaguucuauugcaauaauuugcuuagcuauucuuuauagggugcucaagugccuaaagauugccccaaggaaaguucugaauccauuaauguggauuacagccuucaucagauggguguauaagaagaugguugcuagaguggcggacaauauuaaucaagugaacagggaaauaggauggauggaaggaggucaguugguucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugucugagcucaaggagaugccaucuugucggggaaugucaugugaauaggugucugucuuggagggacaaugaaacuucagcagaguuuucauuuguuggggaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagaaauuccucggcaaggguucuugggggagaucaggugcaauucagaguccucaguccugaaugcucaugaaucaugccuuagggcaccaaaccuuaucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguuguuauuccugcaaugcaggggccagagucugccugucuaucacauccacaggaacuggaacucucucugcccacaauaaggaggggucucugcauauaguucucccaucagagaaugggacaaaagaucagugucagauacuacauuucacugugccugaaguagaagaggaguuuauguacucuugugauggagaugagcggccucuguuagugaaagggacccugauagcuauugacccauuugaugauaggcgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4402 - RNA, 3594 nt, Artificial Sequence
  derived and/or modified CDS sequence (wt) from RVFV(ANK-6087)__DQ380216.1__GP
auguauguuuuauuaacaauucuaaucucgguucuggugugugaagcgguuauuagagugucucuaagcuccacaagagaagagaccuguuuuggugacuccaccaacccagagaugauugaaggagcuugggauucacucagagaggaggagaugccagaggagcucuccuguucuauaucaggcauaagggagguuaagaccucaagccaggaguuauacagggcauuaaaagccaucauugcugcugauggcuugaacaacaucaccugccaugguaaggauccugaggacaagauuucucucauaaaggguccuccucauaaaaagcggguggggauaguucggugugagagacgaagagaugcuaagcaaauagggagagaaaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugagaaggggaaauucccccuuuuccagucguaugcucaucauagaacucuacuagaggcaguucacgacaccaucauugcaaaggcugauccaccuagcugugaccuucagagugcucaugggaaucccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaggacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaccuugauaagcuugaccucaagacugaggagaaucugcuaccagacucauuugucugcuucgagcauaagggacaguauaaaggaaaauuggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagaguaguugugaagagagaacucucugccaagcccauccagagaguugagccuugcacaacuuguauaaccaaaugugagccucauggguugguuguccgaucaacaggguucaagauaucaucugcaguugcuugugcuagcggaguuugcgucacaggaucgcagaguccuuccaccgagauuacacucaaguauccagggauaucccaguccucuggaggggacauagggguucacauggcacacgaugaucagucaguuagcuccaaaauaguagcucacugcccuccccaggacccgugcuuagugcacggcugcauagugugugcucauggccugauaaauuaccagugucacacugcucucagugccuuuguuguuguguuuguauucaguucuauugcaauaauuuguuuagcuauucuuuauagggugcucaagugccuaaagauugccccaaggaaaguucugaauccacuaauguggauuacagccuucaucagauggguguauaggaagaugguugccagaguggcagacaauauuaaucaagugaacagggagauaggauggauggaaggaggucaguugguucuagggaacccugccccuauuccucgucauguuccaauuccacguuauagcacauaccuaaugcuacuacugauugucucauaugcaucagcauguucagaacugauucaggcaagcuccagaaucacuacuugcuccacagagggugucaacaccaaguguagacugucuggcacagcauugaucagggcagggucaguuggggcagaggcuuguuugauguugaagggggucaaggaagaucaaaccaaguucuuaaaaauaaaaacugucucaagugagcuaucgugcagggagggccagagcuauuggacuggguccuuuagccccaaaugucugagcucaaggagaugccaucuugucggggaaugucaugugaauaggugucugucuuggagggacaaugaaacuucagcagaguuuucauuuguuggagaaagcacgaccaugcgagagaauaaguguuuugagcaguguggaggauggggauguggguguuucaaugugaacccaucuugcuuauuugugcacacguaucugcagucaguuagaaaagaggcccuuagaguuuuuaacuguaucgacugggugcauaaacucacucuggagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugagucaugccuuagggcaccaaaccuuaucucauacaagcccaugauagaucaauuggagugcucaacaaaucugauugaccccuuuguuguauuuaagagggguucucugccacagacaaggaaugacaaaaccuuugcugcuucaaaaggaaauagagguguucaagcuuucucuaagggcucugugcaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaacucucucugcccacaauaaggaugggucucugcauauaguucuuccaucagagaauggaacaaaagaucagugucagauacuacacuucacuguaccugaaguagaggaggaguuuauguacucuugugauggagaugagcggccucuauuggugagggggacucugauagcuauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugcuuguauguugcauuaucaauugggcucuuuuuccuccucauauaucuuggaagaacaggccucucuaaaauguggcuugcugcuacuaagaaggccucauag

SEQ ID NO: 4403 - RNA, 3594 nt, Artificial Sequence
  derived and/or modified CDS sequence (wt) from RVFV(SAUDI 200010901)__KU978778.1__GP
auguauguuuuauugacaauucuaaucucgguucuggugugugaagcaguuauuagaguaucucuaagcuccacaagagaggagaccuguuuuggugacuccaccaacccagagaugauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcggguggggauaguccggugugggagacgaagagauacuaagcaaauagggagagaaaccauggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaaggggaaauuuccucuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguaggcagaugacaggugcuagccugaagaaggggucuuauccucuccaagacuuauuuugucagucaagugaggaugauggaucaaaauugaaaacaaaaaugaaaggggucugcgaagugggaguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcauaagggacaguauaaaggaacaauggacucuggccagaccaagagggagcucaaaagcuuugauaucucucagugccccaagauuggagggcaugguaguaagaagugcacuggggacgcagcauuuugcucugcuuaugaaugcacugcucaguaugccaaugccuuuuguucacaugcuaaugggucagggauugugcagauucaaguaucaggggucuggaagaagccuuuauguguaggguaugagagagugguugugaagagagaacucucugccaaacccauccagagaguugagccuugcacaacuuguauaaccaaaugugaaccucauggauugguuguccgaucaacaggguucaagauaucaucugcaguugcuugugcuagcggaguuugcgucacagggucgcagaguccuucuacugagauuacacucaaguauccagggauaucccaguccucugggggggacauagggguucacauggcacaugaugaucagucaguuagcuccaaaauaguagcucacugcccuccccaggacccgugcuuagugcauggcugcauagugugugcucauggccugauaaauuaccagugucacacugcucucagugccuuuguuguuguauuuguauucaguucuauugcaauaauuugcuuagcuauucuuuauagggugcucaagugccuaaagauugccccaaggaaaguucugaauccauuaauguggauuacagccuucaucagauggguguauaagaagaugguugcuagaguggcggacaauauuaaucaagugaacagggaaauaggauggauggaaggaggucaguugguucuagggaacccugccccuauuccucgucaugccccaaucccacguuauagcacauaccuaaugcugcuauugauuaucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggagucaaggaagaucaaaccaaguucuuaaagauaaaaacugucucuagugagcuaucgugcagggagggccagagcuauuggacuggguccuuuagccccaagugucugagcucaaggagaugccaucuugucggggaaugucaugugaauaggugucugucuuggagggacaaugaaacuucagcagaguuuucauuuguuggggaaagcacaaccaugcgagagaauaaguguuuugagcaguguggaggauggggguguggauguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucguacaagcccaugauagaucaauuggagugcacuacaaaucugauugaucccuuuguugucuuugagagggguucucugccacagacaaggaaugaaaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguuguuauuccugcaaugcaggggccagagucugccugucuaucacauccacaggaacuggaacucucucugcccacaauaaggacgggucucugcauauaguucucccaucagagaaugggacaaaagaucagugucagauacuacauuucacugugccugaaguagaagaggaguuuauguacucuugugauggagaugagcggccucuguuagugaaagggacccugauagcuauugacccauuugaugauaggcgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4404 - RNA, 3594 nt, Artificial Sequence
  derived and/or modified CDS sequence (wt) from RVFV(35/74)__JF784387.1__GP
auguauguuuuacuaacaauucugaucacgguucuggugugugaggcgguuauuagagugucucuaaguuccacaagagaagagaccugcuuuggugacuacaccaacccagagaugauugaaggagcuugggauucacucagagaggaggagaugccagaagagcucuccuguuccauaucaggcauaagggaggucaaaaccucaagccaggaauuguauagggcauuaaaagccaucauugcugcugauggcuugaacaacaucaccugccaugguaaggauccugaggauaagauuucucucguaaaggguccuccucacaaaaagcggguggggauaguucggugugagagacgaagagacgcuaagcaaauaggaagagaaaccauggcagggauugcaaugacaguccuuccagccuuagcaguuuuugcuuuggcaccuguuguuuuugcugaagacccucaucucagaaacagaccagggaaggggcacaacuacauugacgggaugacucaggaggacgccacaugcaaaccugugacauaugcuggggcuuguagcaguuuugaugucuugcucgaaaagggaaaauucccccucuuccagucguaugcccaucacagaacccuacuagaagcaguucacgacaccaucauugcaaaggcugauccaccuagcugugaccuucagagugcucaugggaaucccugcaugaaggagaaacucgugaugaagacacacuguccaaaugacuaccagucagcucauuaccucaacaaugacgggaaaauggcuucagucaagugcccuccuaaauaugagcucacugaggacugcaauuuuugcaggcagaugacaggugcuagcuugaagaaggggucuuauccucuucaggacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguauuuaagaacucaaagaagguuuaucuugauaagcuugaccucaagacugaggaaaaucuguugccagacucauuugucugcuucgagcauaagggacaguauaaaggaacaauggacucuggucagaccaagagggagcucaaaagcuuugauaucucucagugccccaagauuggaggacaugguagcaagaagugcacuggggacgcagcuuuuugcucugcuuaugagugcacugcucaauacgccaaugcuuauuguucacaugcuaaugggucaggaguuguacagauacaaguauccggggucuggaagaagccuuugugugucggguaugagagggugguugugaagagagaacucucugcuaagcccauccagagaguugagccuugcacaacuuguauaaccaaaugugagccucacggauugguuguccgaucaacagguuucaagauaucaucugcaguugcuugugcuagcggaguuugcguuacaggaucgcagagcccuucuaccgagauuacacucaaguauccagggauaucccaguccucugggggggacauagggguucacauggcacaugaugaucagucaguuagcuccaaaauaguagcucacugcccuccccaggauccaugccuagugcauggcugcauagugugugcucauggccugauaaauuaccagugucacacugcucucagugccuuuguuguuguguucguauuuagcucugucgcaauaauuuguuuggccauucuuuauaaaguucucaagugccuaaagauugccccaaggaaaguucuggauccacuaauguggauuacuguuuucaucagauggguguauaagaagaugguugccagaguagcagacaauaucaaucaggugaacagggaaauaggauggauggaaggaggccagcuggcucuagggaacccugccccuauuccucgucaugcuccaauuccacguuauagcacauaccuaaugcuacuauugauugucucauaugcaucagcauguucagaacugauucaggcaagcuccagaaucaccacuugcuccacagaaggugucaacaccaaguguaggcugucuggcacagcauuaaucagggcagggucaguuggggcagaggcuuguuugauguuaaagggggucaaggaagaccaaaccaaguuuuugaagauaaaaacugucucaagugagcuaucgugcagggagggccagagcuauuggacuggguccuuuagcccuaaaugucugagcucaaggagaugccaucuugucggggaaugucaugugaauaggugucugucuuggagagacaaugaaaccucagcagaauuuucauuuguuggggaaagcacgaccaugcgggagaacaaguguuuugagcaguguggaggauggggauguggguguuucaaugugaacccaucuugcuuauuugugcacacguaucugcagucagucagaaaagaggcccuuagaguuuucaacuguaucgauugggugcauaaacucacucuagagauuacugacuuugauggcucuguuucaacaauagaccugggagcaucaucuagccguuucacaaacugggguucaguuagccucucacuggacgcagagggcauuucaggcucaaacagcuuuuccuucauugagagcccaggcaaaggguaugcaauuguugaugagccauucucagaaauuccucggcaaggguucuugggggagaucaggugcaauucagaaucuucaguccugagugcucaugaaucaugccuuagggcaccaaaucuuauuucauacaagcccaugauagaucaguuggagugcacaacaaaucugauugaucccuuuguugucuuugagaggggcucucugccacagacaaggaaugacaaaaccuuugcagcuucaaaaggaaauagggguguucaagcuuucucuaagggcucuguacaggcugaucuaacacugauguuugacaauuuugagguggacuuugugggagcagccgugucuugugaugccgccuucuuaaauuugacagguugcuauuccugcaaugcaggggccagagucugccugucuaucacauccacaggaacuggaacucucucugcccacaauaaagauggaucucugcauauaguucuuccaucagagaauggaacaaaagaucagugucagauacuacacuucacuguaccugagguagaggaggaguuuauguacucuugugauggagaugagcggccucuguuggugaagggaacccugauagcuauugauccauuugaugauaggcgagaagcagggggggaaucaacaguugugaauccaaaaucuggaucuuggaauuucuuugacugguuuucuggacucaugaguugguuuggagggccucuuaagacuauacuccucauuugccuguauguagcauuaucaauugggcucuuuuuccuucuuauauaucuuggaagaacaggccucucuaaaauguggcuugcugccaccaagaaagccucauag

SEQ ID NO: 4405 - RNA, 3594 nt, Artificial Sequence
  derived and/or modified CDS sequence (wt) from RVFV(KEN/Kil-006/07)__HM586966.1__GP
auguauguuuuauugacaauucuaaucucgguucuggugugugaagcgguuauuagagugucucuaagcuccacaagagaggaaaccuguuuuggugacuccaccaacccagagaugauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcggguggggguaguccggugugagagacgaagagaugcuaagcaaauagggagagaaaccauggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcugaugguaauaaauguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccugucuaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgccacuaagaaggccucauag

SEQ ID NO: 4406 - RNA, 3594 nt, Artificial Sequence
  derived and/or modified CDS sequence (wt) from RVFV(MgH824)__DQ380210.1__GP
auguauguuuuauuaacaauucuaaucucgguucuggugugugaagcgguuauuagagugucucuaagcuccacaagagaagagaccugcuuuggugacuccacuaacccagagaugauugaaggagcuugggauucacucagagaggaggagaugccggaggagcucuccuguucuauaucaggcauaagggagguuaagaccucaagccaggaguuauacagggcauuaaaagccaucauugcugccgauggcuugaacaacaucaccugccaugguaaggauccugaggacaagauuucccucauaaaggguccuccucacaaaaagcggguggggauaguucggugugagaggcgaagagaugcuaagcaaauagggagagaaaccauggcagggauugcaaugacaguccuuccagccuuagcaguuuuugcuuuggcaccuguuguuuuugcugaagacccccaucucagaaacagaccagggaagggguacaacuacauugacgggaugacucaggaggaugccacaugcaaaccugugacauaugcuggggcauguagcaguuuugaugucuugcuugaaaaggggaaauuuccccuuuuccagucguaugcucaucauagaacucuacuagaggcaguucacgacaccaucauugcaaaggcugacccaccuagcugugaccuucagagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcguaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacuacucaguacgccaaugccuauuguucacaugcuaaugggucagggguugugcagauacaagugucaggggucuggaagaagccuuuauguguaggauaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcauggcugcauagugugugcucauggccugauaaauuaccagugccacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaauauuaaucaagugaacagggaaauaggauggauggaaggaggucaguugguucuagggaacccugccccuauuccucgucaugccccaaucccacguuauagcacauaccugauguuacuauugauugucucauaugcaucagcauguucagaacugauucaggcaagcuccagaaucaccacuugcucuacagaggguguugacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacaaccaugcgagagaauaaguguuuugagcaguguggaggauggggguguggguguuucaaugugaacccaucuugcuuauuugugcacacguaucugcagucaguuagaaaagaggcccuuagaguuuuuaacuguaucgacuggguacauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucccagagauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaccccuuuguugucuuugagagggguucucugccacagacaaggaaugacaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacauuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaaggacaggccucucuaaaauguggcuugcugccacuaagaaggccucauag

SEQ ID NO: 4407 - RNA, 3594 nt, Artificial Sequence
  derived and/or modified CDS sequence (wt) from RVFV(Kenya 57 (Rintoul))__DQ380192.1__GP
auguaugcuuuacuaacaauucuaaucucgguucuggugugugaagcgguuauuagagugucucuaagcuccacaagagaagaaaccuguuuuggugacuccaccaacccagagaugauugaaggagcuugggauucacucagagaggaggagaugccagaggagcucuccuguuccauaucaggcauaagggagguuaagaccucaagccaggaauuacacagggcauuaaaagccaucauugcugcugauggcuugaacaacaucaccugccaugguaaggauccugaggacaagauuucucucauaaaggguccuccucacaaaaagcggguggggguaguucggugugagagacgaagagacgcuaagcaaauagggagagagaccauggcagggauugcaaugacaguccuuccagccuuagcaguuuuugcuuuggcaccuguuguuuuugcugaagacccucaucucagaaacagaccagggaagggacacaacuacauugacgggaugacucaggaggaugccacauguaaaccugugacauaugcuggggcauguagcaguuuugaugucuugcucgaaaagggaaaauuuccccucuuccagucguaugcucaucauagaacucuauuagaggcaguucacgacaccaucauugcaaaggcugauccaccuagcugugaccuucagagugcucaugggaaucccugcaugaaagagaaacucguaaugaagacacacuguccaaaugacuaccagucagcucauuaccucaacaaugacgggaaaauggcuucagucaagugcccuccuaaguaugagcucacugaggacugcaacuuuuguaggcagaugacaggugcuagcuugaagaaggggucuuauccucuccaagacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugacaagcuugaccucaagacugaggaaaaucugcuaccagacucauuugucugcuucgagcauaagggacaguacaaaggaacaauggacucuggucagauuaagagggagcucaaaagcuuugauaucucucagugccccaagauuggaggacaugguagcaagaagugcacuggggacgcagcauuuugcucugcuuaugaguguacugcucaauacgccaaugccuauuguucacaugcuaaugggucaggaauuguacagauacaaguauccggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucugcaguugcuugugcuagcggaguuugcgucacaggaucgcagagcccuucuacugagauuacacucaaguauccagggauaucccaguccucugggggagacauagggguucacauggcacaugaugaucagucaguuagcuccaaaauaguagcucacugccccccccaggacccgugccuagugcauggcugcauagugugugcucauggcuugauaaauuaccagugucacacugcucucagugccuuuguuguuguguucguauucagcucuguugcaauaauuuguuuggccauucuuuauaaggugcucaagugccuaaagauugccccaaggaaaguucugaauccacuaauguggauuacugccuucaucagauggguguauaagaagaugguugccagaguggcagacaauaucaaucaagugaacagggaaauaggauggauggaaggaggccaguugguucuagggaacccugccccuauuccucgucaugcuccaauuccacguuauagcacauaccuaaugcugcuauugauugucucauaugcaucagcauguucagaacuaauucaggcaagcuccagaaucaccacuugcuccacagaaggugucaacaccaaguguaggcugucuggcacagcauuaaucagggcagggucaguuggggcagaggcuuguuugauguuaaagggggucaaggaagaccagaccaaguucuugaagauaaaaacugucucaagugagcuaucguguagggagggccagagcuauuggacuggguccuuuagccccaaaugucugagcucaaggagaugccaucuugucggagaaugucaugugaauaggugucugucuuggagggacaaugaaacuucagcagaauuuucauuuguuggggaaagcacgaccaugcgagagaauaaguguuuugagcaguguggaggauggggauguggguguuucaaugugaacccaucuugcuuauuugugcacacguaucugcagucaguuagaaaagaggcccuuagaguuuuuaacuguauugauugggugcauaaacucacucuagagaucacagacuuugauggcucuguuucaacaguagacuugggagcaucaucuagccguuucacaaacugggguucaguuagccucucacuggacgcagagggcauuucaggcucaaauagcuucucuuucauugagagcccaggcaaaggguaugcaauuguugaugagccauucucagaaauuucucggcaaggguucuugggagagaucaggugcaauucagaaucuucaguccugagugcucaugaaucaugccuuagggcaccaaaccuuaucucauacaaacccaugauagaucaguuggagugcacaacaaaucugauugaucccuuuguugucuuugagagggguucucugccucagacaaggaaugacaaaaccuuugcagcuucaaaaggaaauagggguguucaagcuuucucuaagggcucuguacaagcugaucuaacucugauguuugacaauuuugagguggacuuugugggagcagccgugucuugugaugccgccuucuuaaacuugacagguugcuauuccugcaaugcaggggccagagucugccugucuaucacauccacaggaacuggaacucuuucugcccacaauaaggaugggucucugcauauaguucuuccaucagagaauggaacaaaagaucagugucagauacuacacuucacuguaccugagguggaggaggaguuuauguacucuugugauggagaugagcggccucuguuggugaaggggacccugauagcuauugauccauuugaugauaggcgagaagcagggggggaaucaacaguugugaauccaaaaucuggaucuuggaauuucuuugacugguuuucuggacuuaugaguugguuuggagggccucuuaagacuauacuccuaauuugccuguauguagcauuaucaauugggcucuuuuuccuucuuauauaucuuggaagaacaggucucuccaaaauguggcuugcugccacuaagaaagcuucauag

SEQ ID NO: 4408 - RNA, 3594 nt, Artificial Sequence
  derived and/or modified CDS sequence (wt) from RVFV(SA-75)__DQ380189.1__GP
auguauguuuuacuaacaauucugaucacgguucuggugugugaggcgguuauuagagugucucuaaguuccacaagagaagagaccugcuuuggugacuacaccaacccagagaugauugaaggagcuugggauucacucagagaggaggagaugccagaagagcucuccuguuccauaucaggcauaagggaggucaaaaccucaagccaggaauuguauagggcauuaaaagccaucauugcugcugauggcuugaacaacaucaccugccaugguaaggauccugaggauaagauuucucucguaaaggguccuccucacaaaaagcggguggggauaguucggugugagagacgaagagacgcuaagcaaauaggaagagaaaccauggcaaggauugcaaugacaguccuuccagccuuagcaguuuuugcuuuggcaccuguuguuuuugcugaagacccucaucucagaaacagaccagggaaggggcacaacuacauugacgggaugacucaggaggacgccacaugcaaaccugugacauaugcuggggcuuguagcaguuuugaugucuugcucgaaaagggaaaauucccccucuuccagucguaugcccaucacagaacccuacuagaagcaguucacgacaccaucauugcaaaggcugauccaccuagcugugaccuucagagugcucaugggaaucccugcaugaaggagaaacucgugaugaagacacacuguccaaaugacuaccagucagcucauuaccucaacaaugacgggaaaauggcuucagucaagugcccuccuaaauaugagcucacugaggacugcaauuuuugcaggcagaugacaggugcuagcuugaagaaggggucuuauccucuucaggacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguauuuaagaacucaaagaagguuuaucuugauaagcuugaccucaagacugaggaaaaucuguugccagacucauuugucugcuucgagcauaagggacaguauaaaggaacaauggacucuggucagaccaagagggagcucaaaagcuuugauaucucucagugccccaagauuggaggacaugguagcaagaagugcacuggggacgcagcuuuuugcucugcuuaugagugcacugcucaauacgccaaugcuuauuguucacaugcuaaugggucaggaguuguacagauacaaguauccggggucuggaagaagccuuugugugucggguaugagagggugguugugaagagagaacucucugcuaagcccauccagagaguugagccuugcacaacuuguauaaccaaaugugagccucacggauugguuguccgaucaacagguuucaagauaucaucugcaguugcuugugcuagcggaguuugcguuacaggaucgcagagcccuucuaccgagauuacacucaaguauccagggauaucccaguccucugggggggacauagggguucacauggcacaugaugaucagucaguuagcuccaaaauaguagcucacugcccuccccaggauccaugccuagugcauggcugcauagugugugcucauggccugauaaauuaccagugucacacugcucucagugccuuuguuguuguguucguauuuagcucugucgcaauaauuuguuuggccauucuuuauaaaguucucaagugccuaaagauugccccaaggaaaguucugaauccacuaauguggauuacuguuuucaucagauggguguauaagaagaugguugccagaguagcagacaauaucaaucaggugaacagggaaauaggauggauggaaggaggccagcuggcucuagggaacccugccccuauuccucgucaugcuccaauuccacguuauagcacauaccuaaugcuacuauugauugucucauaugcaucagcauguucagaacugauucaggcaagcuccagaaucaccacuugcuccacagaaggugucaacaccaaguguaggcugucuggcacagcauuaaucagggcagggucaguuggggcagaggcuuguuugauguuaaagggggucaaggaagaccaaaccaaguuuuugaagauaaaaacugucucaagugagcuaucgugcagggagggccagagcuauuggacuggguccuuuagcccuaaaugucugagcucaaggagaugccaucuugucggggaaugucaugugaauaggugucugucuuggagagacaaugaaaccucagcagaauuuucauuuguuggggaaagcacgaccaugcgggagaacaaguguuuugagcaguguggaggauggggauguggguguuucaaugugaacccaucuugcuuauuugugcacacguaucugcagucagucagaaaagaggcccuuagaguuuucaacuguaucgauugggugcauaaacucacucuagagauuacugacuuugauggcucuguuucaacaauagaccugggagcaucaucuagccguuucacaaacugggguucaguuagccucucacuggacgcagagggcauuucaggcucaaacagcuuuuccuucauugagagcccaggcaaaggguaugcaauuguugaugagccauucucagaaauuccucggcaaggguucuugggggagaucaggugcaauucagaaucuucaguccugagugcucaugaaucaugccuuagggcaccaaaucuuauuucauacaagcccaugauagaucaguuggagugcacaacaaaucugauugaccccuuuguugucuuugagaggggcucucugccacagacaaggaaugacaaaaccuuugcagcuucaaaaggaaauagggguguucaagcuuucucuaagggcucuguacaggcugaucuaacacugauguuugacaauuuugagguggacuuugugggagcagccgugucuugugaugccgccuucuuaaauuugacagguugcuauuccugcaaugcaggggccagagucugccugucuaucacauccacaggaacuggaacucucucugcccacaauaaagauggaucucugcauauaguucuuccaucagagaauggaacaaaagaucagugucagauacuacacuucacuguaccugagguagaggaggaguuuauguacucuugugauggagaugagcggccucuguuggugaagggaacccugauagcuauugauccauuugaugauaggcgagaagcagggggggaaucaacaguugugaauccaaaaucuggaucuuggaauuucuuugacugguuuucuggacucaugaguugguuuggagggccucuuaagacuauacuccucauuugccuguauguagcauuaucaauugggcucuuuuuccuucuuauauaucuuggaagaacaggccucucuaaaauguggcuugcugccaccaagaaagccucauag

SEQ ID NO: 4409 - RNA, 3594 nt, Artificial Sequence
  derived and/or modified CDS sequence (wt) from RVFV(SA01-1322)__KX096942.1__GP
auguauguuuuauugacaauucuaaucucgguucuggugugugaagcaguuauuagaguaucucuaagcuccacaagagaggagaccuguuuuggugacuccaccaacccagagaugauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcggguggggauaguccggugugggagacgaagagauacuaagcaaauagggagagaaaccauggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaaggggaaauuuccucuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguaggcagaugacaggugcuagccugaagaaggggucuuauccucuccaagacuuauuuugucagucaagugaggaugauggaucaaaauugaaaacaaaaaugaaaggggucugcgaaguaggaguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcauaagggacaguauaaaggaacaauggacucuggccagaccaagagggagcucaaaagcuuugauaucucucagugccccaagauuggagggcaugguaguaagaagugcacuggggacgcagcauuuugcucugcuuaugaaugcacugcucaguaugccaaugccuuuuguucacaugcuaaugggucagggauugugcagauucaaguaucaggggucuggaagaagccuuuauguguaggguaugagagagugguugugaagagagaacucucugccaaacccauccagagaguugagccuugcacaacuuguauaaccaaaugugaaccucauggauugguuguccgaucaacaggguucaagauaucaucugcaguugcuugugcuagcggaguuugcgucacagggucgcagaguccuucuacugagauuacacucaaguauccagggauaucccaguccucugggggggacauagggguucacauggcacaugaugaucagucaguuagcuccaaaauaguagcucacugcccuccccaggacccgugcuuagugcauggcugcauagugugugcucauggccugauaaauuaccagugucacacugcucucagugccuuuguuguuguauuuguauucaguucuauugcaauaauuugcuuagcuauucuuuauagggugcucaagugccuaaagauugccccaaggaaaguucugaauccauuaauguggauuacagccuucaucagauggguguauaagaagaugguugcuagaguggcggacaauauuaaucaagugaacagggaaauaggauggauggaaggaggucaguugguucuaggggacccugccccuauuccucgucaugccccaaucccacguuauagcacauaccuaaugcugcuauugauuaucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggagucaaggaagaucaaaccaaguucuuaaagauaaaaacugucucuagugagcuaucgugcagggagggccagagcuauuggacuggguccuuuagccccaagugucugagcucaaggagaugccaucuugucggggaaugucaugugaauaggugucugucuuggagggacaaugaaacuucagcagaguuuucauuuguuggggaaagcacaaccaugcgagagaauaaguguuuugagcaguguggaggauggggguguggauguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccagguaaaggguaugcaauuguugaugagccauucucagaaauuccucggcaaggguucuugggggagaucaggugcaauucagaguccucaguccugagugcucaugaaucaugccuuagggcaccaaaccuuaucucguacaagcccaugauagaucaauuggagugcacuacaaaucugauugaucccuuuguugucuuugagagggguucucugccacagacaaggaaugaaaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguuguuauuccugcaaugcaggggccagagucugccugucuaucacauccacaggaacuggaacucucucugcccacaauaaggacgggucucugcauauaguucucccaucagagaaugggacaaaagaucagugucagauacuacauuucacugugccugaaguagaagaggaguuuauguacucuugugauggagaugagcggccucuguuagugaaagggacccugauagcuauugacccauuugaugauaggcgggaagcagggggggaaucaacaguugugaauccaaaaucuggaucuuggaauuucuuugacugguuuucuggacuuaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4410 - RNA, 3594 nt, Artificial Sequence
  derived and/or modified CDS sequence (wt) from RVFV(KEN/Mal-032/07)__HM586967.1__GP
auguauguuuuauugacaauucuaaucucgguucuggugugugaagcgguuauuagagugucucuaagcuccacaagagaggaaaccuguuuuggugacuccaccaacccagagaugauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcggguggggauaguccggugugagagacgaagagaugcuaagcaaauagggagagaaaccauggcagggauugcgaugacaguccuuccagccuuagcaguuuuugcuuuggcaccuguuguuuuugcugaagacccccaucucagaaacagaccagggaaggggcacaacuacauugacgggagacuucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcugaugguaauaaauguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccugucuaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4411 - RNA, 3594 nt, Artificial Sequence
  derived and/or modified CDS sequence (wt) from RVFV(KEN/Gar-008/06)__HM586965.1__GP
auguauguuuuauugacaauucuaaucucgguucuggugugugaagcgguuauuagagugucucuaagcuccacaagagaggaaaccuguuuuggugacuccaccaacccagagaugauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcggguggggauaguccggugugagagacgaagagaugcuaagcaaauagggagagaaaccauggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaagggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuugaagguggacuuugugggagcagccgugucuugugaugccgccuucuugaauuugacagguugcuauucuugcaaugcaggggccagagucugccuguccaucacauccacaggaacuggaacucucucugcccacaauaaggacgggucucugcauauaguucucccaucagagaacgggacaaaagaucagugucagauacuacauuuuacuguaccugaaguaaaagaggaguucauguacucuugugauggagaugagcgggcucuguuaaugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4412 - RNA, 3594 nt, Artificial Sequence
  derived and/or modified CDS sequence (wt) from RVFV(Kenya 56 (IB8))__DQ380190.1__GP
auguauguuuuacuaacaauucugaucacgguucuggugugugaagcgguuaucagagugucucuaaguuccacaagagaagagaccugcuuuggugacuccaccagcccagagaugauugaaggagcuugggauucacucagagaggaggagaugccagaagagcucuccuguuccauaucaggcauaagggagguuaaaaccucaagccaggaauuauauagggcauuaaaagccaucauugcugcugauggcuugaacaacaucaccugccaugguaaggauccugaggauaagauuucucucauaaaggguccuccucacaaaaagcagguggggauaguucggugugagagacgaagagacgcuaagcaaauaggaagagaaaccauggcagggauugcaaugacaguccuuccagccuuagcaguuuuugcuuuggcaccuguuguuuuugcugaagacccucaucucagaaacagaccagggaaggggcacaacuacauugacgggaugacucagggggaugccacaugcaaaccugugacauaugcuggggcuuguagcaguuuugaugucuugcucgaaaagggaaaauucccccucuuccagucguaugcccaucacagaacccuacuagaagcaguucacgacaccaucauugcaaaggcugauccaccuagcugugaccuucagagugcucaugggaauccuugcaugaaggagaaacucgugaugaagacacacuguccaaaagacuaccagucagcucauuaccucaacaaugacgggaaaauggcuucagucaagugcccuccuaaauaugagcucacugaggacugcaauuuuugcaggcagaugacaggugccagcuugaagaaggggucuuauccucuucaggacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguauuuaagaacucaaagaagguuuaucuugauaagcuugaccucaagacugaggaaaaucuguugccagacucauuugucugcuucgagcauaagggacaguauaaaggaacaauggacucuggucagaccaagagggagcuaaaaagcuuugauaucucucagugccccaagauuggaggacaugguagcaagaagugcacuggggacgcagcuuuuugcucugcuuaugagugcacugcucaauacgccaaugcuuauuguucacaugcuaaugggucaggaauuguacagauacaaguauccggggucuggaagaggccuuuguguguaggguaugagagggugguugugaagagagaacucucugcuaagcccauccagagaguugagccuugcacaacuuguauaaccaaaugugagccucauggauugguuguccgaucaacagguuucaagauaucaucugcaguugcuugugcuagcggaguuugcguuacaggaucgcagagcccuucuaccgagauuacacucaaguauccagggaugucccaguccucugggggggacauagggguucauauggcacaugaugaucagucaguuagcuccaaaauaguagcucacugcccuccccaggauccaugccuagugcauggcugcauagugugugcucauggccugauaaauuaccagugucacacugcucucagugccuuuguuguuguguucguauuuagcucugucgcaauaauuuguuuggccauucuuuauaaaguucucaagugccuaaagauugccccaaggaaaguucugaauccacuaauguggauuacugcuuucaucagauggguguauaagaagaugguugccagaguggcagacaauaucaaucaggugaacagggaaauaggauggauggaaggaggccagccggcucuagggaacccugccccuauuccucgucaugcuccaauuccacguuauagcacauaccuaaugcuacuauugauugucucauaugcaucagcauguucagaacugauucaggcaagcuccagaaucaccacuugcuccacagaaggugucaacaccaaguguaggcugucuggcacagcauuaaucagggcagggucaguuggggcagaggcuuguuugauguuaaagggggucaaggaagaccaaaccaaguuuuugaagauaaaaacugucucaagugagcuaucgugcagagagggccagagcuauuggacuggguccuuuagcccuaaaugucugagcucaaggaggugccaucuugucggggaaugucaugugaauaggugucugucuuggagagacaaugaaacuucagcagaauuuucauuuguuggggaaagcacgaccaugcgggagaauaaguguuuugagcaguguggaggauggggauguggguguuucaaugugaacccaucuugcuuauuugugcacacguaucugcagucagucagaaaagaggcccuuagaguuuucaacuguaucgauugggugcauaaacucacucuagagauuacugacuuugauggcucuguuucaacaauagaccugggagcaucaucuagccguuucacaaacugggguucaguuagccucucacuggacgcagagggcauuucaggcucaaacagcuuuucuuucauugagagcccaggcaaaggguaugcaauuguugaugagccauucucagaaauuccucggcaaggguucuugggggagaucaggugcaauucagaaucuucaguccugagugcucaugaaucaugccuuagggcaccaaaccuuauuucauacaagcccaugauagaucaguuggagugcacaacaaaucugauugaucccuuuguugccuuugagaggggcucucugccacagacaaggaaugacaaaaccuuugcagcuucaaaaggaaauagggguguucaagcuuucucuaagggcucuguacaggcugaucuaacacugauguuugacaauuuugagguggacuuugugggagcagccgugucuugugaugccgccuucuuaaauuugacagguugcuauuccugcaaugcaggggccagagucugccugucuaucacauccacaggaacuggaacucucucugcccacaauaaagaugggucucugcauauaguucuuccaucagagaauggaacaaaagaucagugucagauacuacacuucacuguaccugagguagaggaggaguuuauguacucuugugauggagaugagcggccucuguuggugaagggaacccugauagcuauugauccauuugaugauaggcgagaagcagggggggaaucaacaguugugaauccaaaaucuggaucuuggaauuucuuugacugguuuucuggacucaugaguugguuuggagggccucuuaagacuauacuccucauuugccuguauguagcauuaucaauugggcucuuuuuccuccuuauauaucuuggaagaacaggccucucuaaaauguggcuugcugccaccaagaaagccucauag

SEQ ID NO: 4413 - RNA, 3594 nt, Artificial Sequence
  derived and/or modified CDS sequence (wt) from RVFV(KEN/Bar-035/07)__HM586969.1__GP
auguauguuuuauugacaauucuaaucucgguucuggugugugaagcgguuauuagagugucucuaagcuccacaagagaggaaaccuguuuuggugacuccaccaacccagagaugauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcggguggggauaguccggugugagagacgaagagaugcuaagcaaauagggagagaaaccauggcagggauugcgaugacaguccuuccagccuuagcaguuuuugcuuuggcaccuguuguuuuugcugaagacccccaucucagaaacagaccagggaaggggcacaacuacauugacgggagacuucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcugacgguaauaaauguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcacggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggauaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaacgcaggggccagagucugccuguccaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4414 - RNA, 3594 nt, Artificial Sequence
  derived and/or modified CDS sequence (wt) from RVFV(TAN/Dod-002/07)__HM586971.1__GP
auguauguuuuauugacaauucuaaucucgguucuggugugugaagcgguuauuagagugucucuaagcuccacaagagaggaaaccuguuuuggugacuccaccaacccagagaugauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcggguggggauaguccggugugagagacgaagagaugcuaagcaaauagggagagaaaccauggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguccaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaggaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucaggccuggauaaucucucaguggcacacggcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaacgcaggggccagagucugccuguccaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4415 - RNA, 3594 nt, Artificial Sequence
  derived and/or modified CDS sequence (wt) from RVFV(Beijing-01)__KX611606.1__GP
auguauguuuuauuaacaauucuaaucucgguucugguguuugaggugguuauuagagugucucuaagcuccacaagagaggaaaccuguuuuggugacuccaccaacccagagaugauugaaggagcuugggauucacucagagaggaggagaugccagaagagcucuccuguuccauaucuggcauaagggaggucaagaccucaagccaggaauuauacagggcauuaaaagccaucauugcugcugauggcuugaacaacaucaccugccaugguaaggauccugaggacaaaauuucucucauaaaggguccuccucacaagaagcggguggggauaguucggugugagagacgaagggacgcuaagcaaauagggagagaaaccauggcagggauugcaaugacaguucuucccgccuuagcaguuuuugcuuuggcaccuguuguuuuugcugaggacccucaucucagaaacagaccagggaagggacauaacuacauugacggggugacucaggaggaugccacaugcaaaccugugacauaugcuggggcauguagcaguuuugauguuuugcucgaaaagggaaaauucccccucuuccagucauaugcucaucauagaacucuacuagaggcaguucacgacaccaucauugcaaaggcugauccaccuagcugugaucuccagagugcucaugggaaucccugcaugaaagagaaacucgugaugaagacacacuguccaaaugacuaccagucagcucauuaccucaacaaugacgggaaaauggcuucagucaagugcccuccuaaguaugagcuuacugaggacugcaacuuuuguaggcagaugacaggugcuagcuugaagaaggggucuuauccucuccaggacuuauuuugucagucaagugaggaugauggaucaaaacuaaagacaaaaaugaaaggggucugcgaaguggggguucaagcacucaaaaagugugauggccgacucagcacugcacaugagguugugcccuuugcaguguuuaagaauucaaagaagguuuaucuugacaagcuugaccuuaagacugaagaaaaucugcuaccagacucauuugucugcuuugagcauaagggacaguauaaaggaacaauggacucuggucagacuaagagggagcucaaaagcuuugauaucucucagugccccaagauugggggacaugguagcaagaagugcacuggggacgcagcauuuugcucugcuuaugaguguacugcucaauaugccaaugccuauuguucacaugcuaaugggucugggauuguacagauacaaguauccggggucuggaagaagccuuuaugugugggguaugagagagugguugugaagagagaacucucugccaagcccauccagagaguugagccuugcacaacuugcauaaccaaaugugagccucauggauugguuguccgaucaacaggguucaagauaucaucugcaguugcuugugccagcggaguuugcgucacaggaucgcagagcccuucuacugagaucacucucaaguauccagggauaucccaguccucugggggggauauagggguucacauggcacaugaugaucagucaguuagcuccaaaauagucuuugacugcccuccccaggacccgugccuagugcauggcugcauagugugugcucauggcuugauaaauuaccagugucacacugcucuuagugcuuuuguuguuguguucguauucagcucuguugcaauaauuugucuggccauucuuuauaaggugcucaggugccuaaagauugccccaaagaaaguucugaauccacuaauguggaucacugccuucaucagauggguguauaagaagaugguugccagaguggcagacaauaucaaucaagugaacagagaaauaggauggauggaaggaggccaguuggcucuagggaacccugcucccauuccucgucaugcuccgauuccacguuauagcacauaccuaaugcuacuauugauuaucucauaugcaucagcauguucagaacugauucaggcaagcuccagaaucaccacuugcuccacagaaggugucaacaccaaguguaggcugucuggcacagcauuaaucagggcagggucaguuggggcagaggcuuguuugauguuugagggggucaaggaagaccagaccaaguucuuaaagauaaaaacugucucaagugagcuaucgugcagggagggccagagcuauuggacuggguccuuuagccccaaaugucugagcucaaggagaugccaucuugucggagaaugucaugugaauaggugucugucuuggagggacaaugaaacuucagcagaauuuucauuuguuggggaaagcacgaccaugcgagagaauaaguguuuugagcaguguggaggauggggauguggauguuucaaugugaacccaucuugcuuauuugugcacacguaucugcaaucaguuagaaaagaggcucuuagaguuuuuaacuguauugauugggugcauaaacucacucuagagaucacagacuuugauggcucuguuucaacaauagacuugggagcaucaucuagccguuucacaaacuggggcucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaaucuucuguccugagugcucaugagucaugccuuagggcaccaaaccuuaucucauacaaacccaugauagaucaguuggagugcacaacaaaucugauugaucccuuuguugucuuugagaggggaucucugccacagacaaggaaugacaaaaccuuugcagcuucaaaaggaaauagggguguucaagcuuucucuaaaggcucuguacaggcugaucuaacucugauguuugacaauuuugagguggacuuugugggagcagccgugucuugugaugccgccuucuuaaauuugacagguugcuauuccugcaaugcuggagccagagucugccugucuaucacauccacaggaacuggaacucuuucugcccacaauaaggaugggucucugcauauaguucuuccaucagagaauggaacaaaagaucagugucagauacuacacuucacuguaccugagguggaggaggaguucauguacucuugugauggagaugagcgaccuuuguuggugaaggggacccuaauagcuauugauccauuugaugauaggcgagaagcagggggagaaucaacaguugugaauccaaaaucuggaucuuggaacuucuuugacugguuuucuggacuuaugaguugguuuggaggaccucuuaagacuauacuccuaauuugccuguauguagcauuaucaauugggcucuuuuuccuucuuauauaucuuggaagaacaggucucucuaaaauguggcuugcugccacuaagaaagccucauag

SEQ ID NO: 4416 - RNA, 3594 nt, Artificial Sequence
  derived and/or modified CDS sequence (wt) from RVFV(Smithburn)__DQ380193.1__GP
auguauguuuuacuaacaauucuaaucucgguucuggugugugaagcggucauuagagugucucuaagcuccacaagagaagaaaccuguuuuggugacuccaccaacccagagaugauugaaggagcuugggauucacucagagaggaggagaugccagaggagcucuccuguuccauaucaggcauaagggagguuaagaccucaagccaggaauuauacagggcauuaaaagccaccauugcugcugauggcuugaacaacaucaccugccaugguaaggauccugaggacaagauuucucucauaaaggguccuccucacaaaaagcggguggggguaguucggugugagagacaaagagacgcuaagcaaauagggagaggaaccauggcagggauugcaaugacagucuuuccagccuuaguaguuuuugcuuuggcaccuguuguuuuugcugaagacccucaucucagaaacagaccagggaagggacacaacuacauugacgggaugacucaggaggaugccacauguaaaccugugacauaugcuggggcauguagcaguuuugaugucuugcucgaaaagggaaaauuuccccucuuccagucguaugcucaucauagaacucuauuagaggcaguucacgacaucaucauugcaaaggcugauccaccuagcuguaaccuucagagugcucaugggaaucccugcaugaaagagaaacucguaaugaagacauacuguccaaaugacuaccagucagcucauuaccucaacaaugacgggaaaauggcuucagucaagugcccuccuaagcaugagcucacugaggacugcaacuuuuguaggcagaugacaggugcuagcuugaaggaggggucuuauccucuccaagacuuauuuugucagucaagugaggaugauggaucaaaauuaaaaacaaaaaugaaaggggucugcgaaguggggguucaaguacucaaaaagugugauggccaacucagcacugcacaugaaguugugcccuuugcaguguuuaagaacucaaagaagguuuaucuugacaagcuugaccucaagacugaggaaaaucugcuaccagacucauuugucugcuucgagcauaagggacaguacaaaggaacaauggacucuggucagauuaagagggagcucaaaagcuuugauaucucucagugccccaagauuggaggacaugguagcaagaagugcacuggggacgcagcauuuugcucugcuuaugaguguacugcucaauacgccaaugccuauuguucacaugcuaaugggucaggaauuguacagauacaaguauccggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucugcaguugcuugugcuagcggaguuugcgucacaggaucgcagagcccuucuacugagauuacacucaaguauccagggauaucccaguccucugggggagacauagggguucacauggcacaugaugaucagucaguuagcuccaaaauaguggcccacugccccccccaggacccgugccuagugcauggcugcauagugugugcucauggcuugauaaauuaccagugucacacugcuuucagugccuuuguuguuguguucguauucagcucuguugugauaauuuguuuggccauucuuuauaaggugcucaagugccuaaagauugccccaaggaaaguucugaauccacuaauguggaucacugccuucaucagauggguguauaagaagaugguugccagaguggcagacaauauuaaucaaguaaacagggaaauaggauggauggaaggaggccaguugguucuagggaacccugccccuauuccucgucaugcuccaauuccacguuauagcacauaccuaaugcugcuauugauugucucauaugcaucagcauguucagaacuaauucaggcaagcuccagaaucaccacuugcuccacagaaggugucaacaccaagugcaggcugucuggcacagcauuaaucagggcagggucaguuggggcagaggcuuguuugauguuaaagggggucaaggaagaccagaccaaguucuugaagauaaaaacugucucaagugagcuaucauguagggagggccagagcuauuggacuggguccuuuagccccaaaugucugagcucaaggagaugccaucuugucggagaaugucaugugaauaggugucugucuuggagggacaaugaaacuucagcagaauuuucauuuguuggggaaagcacgaccaugcgagagaauaaguguuuugaacaguguggaggauggggauguggguguuucaaugugaacccaucuugcuuauuugugcacacguaucugcagucaguuagaaaagaagcccuuagaguuuuuaacuguauugauugggugcauaaacugacucuagagauuacagacuuugauggcucuguuucaacaguagacuugggagcaucaucuagccguuucacaaacugggguucagucagccucucacuggacgcagagggcauuucaggcucaaauagcuucucuuucauugagagcccaggcaaaggguaugcaauuguugaugagccauucucagaaauuccucggcaaggguucuugggagagaucaggugcaauucagaaucuucaguccugagugcucaugaaucaugccuuagggcaccaaaccuuaucucauacaaacccaugauagaucaguuggagugcacaacaaaucugauugaucccuuuguugucuuugagagggguucucugccucagacaaggaaugacaaaaccuuugcagcuucaaaaggaaauagggguguucaagcuuucucuaagggcucuguacaagcugaucuaacucugauguuugacaauuuugagguggacuuugugggagcagccgugucuugugaugccgccuucuuaaacuugacagguugcuauuccugcaaugcaggggccagagucugccugucuaucacauccacaggaacuggaacucuuucugcccacaauaaggaugggucucugcauauaguucuuccaucagagaauggaacaaaagaucagugucagauacuacacuucacuguaccugagguagaggaggaguuuauguacucuugugauggagaugagcggccucuguuggugaaggggacccugauagcuauugauccauuugaugauaggcgagaagcagggggggaaucaacaguugugaauccaaaaucuggaucuuggaauuucuuugacugguuuucuggacuuaugaguugguuuggagggccucuuaagacuauacuccuaauuugccuguauguagcauuaucaauugggcuuuuuuucuuucuuauauaucuuggaagaacaggucucucuaaaauguggcuugcugccacuaagaaagcuucauag

SEQ ID NO: 4417 - RNA, 3594 nt, Artificial Sequence
  derived and/or modified CDS sequence (wt) from RVFV(KEN/Bar-032/07)__HM586968.1__GP
auguauguuuuauugacaauucuaaucucgguucuggugugugaagcgguuauuagagugucucuaagcuccacaagagaggaaaccuguuuuggugacuccaccaacccagagaugauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcggguggggauaguccggugugagagacgaagagaugcuaagcaaauagggagagaaaccauggcagggauugcgaugacaguccuuccagccuuagcaguuuuugcuuuggcaccuguuguuuuugcugaagacccccaucucagaaacagaccagggaaggggcacaacuacauugacgggagacuucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugacccaccuagcugugaccuucagagugcugaugguaauaaauguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaaaugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugugggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucucacacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugagguuugauaauuuugagguggacuuugugggagcagccgugucuugugaugccgccuucuugaauuugacagguugcuauucuugcaaugcaggggccagagucugccugucuaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4418 - RNA, 3594 nt, Artificial Sequence
  derived and/or modified CDS sequence (wt) from RVFV(KEN/Gar-004/06)__HM586964.1__GP
auguauguuuuauugacaauucuaaucucgguuugggugugugaagcgguuauuagagugucucuaagcuccacaagagaggaaaccuguuuuggugacuccaccaacccagagaugauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcggguggggauaguccggugugagagacgaagagaugcuaagcaaauagggagagaaaccauggcagggauugcgaugacaguccuuccagccuuagcaguuuuugcuuuggcaccuguuguuuuugcugaagacccccaucucagaaacagaccagggaaggggcacaacuacauugacggaaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucacagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaggaagaagagaacuggggacgcagcauuuugcucugcuuaugaaugcacugcucaguaugccaaugccuauuguucacgugccaacgggucagggauugugcagauucaaguaucaagggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauaaccagucacacucugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggauaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagauuacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugagguuugauaauuuugagguggacuuugugggagcagccgugucuugugaugccgccuucuugaauuugacagguugcuauucuugcaaugcaggggccagagucugccugucuaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4419 - RNA, 3621 nt, Artificial Sequence
  derived and/or modified CDS sequence (wt) from RVFV(RVFV)__M11157.1__GP
auguauguuuuauuaacaauucuaaucucgguucuggugugugaagcgguuauuagagugucucuaagcuccacaagagaagagaccugcuuuggugacuccacuaacccagagaugauugaaggagcuugggauucacucagagaggaggagaugccggaggagcucuccuguucuauaucaggcauaagagagguuaagaccucaagccaggaguuauacagggcauuaaaagccaucauugcugcugauggcuugaacaacaucaccugccaugguaaggauccugaggacaagauuucccucauaaaggguccuccucacaaaaagcggguggggauaguucggugugagagacgaagagaugcuaagcaaauagggagagaaaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucagagugcucaugggaaccccugcaugaaagagaaacucgugaugaagacacacuguccaaaugacuaccagucagcucauuaccucaacaaugacgggaaaauggcuucagucaagugcccuccuaaguaugggcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacacaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccguguuuagugcauggcugcauagugugugcucauggccugauaaauuaccagugucacacugcucucagugccuuuguuguuguguuuguauucaguucuauugcaauaauuuguuuagcuguucuuuauagggugcuuaagugccugaagauugccccaaggaaaguucugaauccacuaauguggaucacagccuucaucagauggauauauaagaagaugguugccagaguggcacacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccauuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcaucucaggcucaaauagcuuuucuuucauugagagcccaagcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugauaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaacuauacuccucauuugccuguauguugcauuaucaauugggcucuuuuuccuccuuauauaucuuggaagaacaggccucucuaaaauguggcuugcugccacuaagaaggccucauagaucaguacguguaaaaguaauauguuga

SEQ ID NO: 4420 - RNA, 3480 nt, Artificial Sequence
  derived and/or modified CDS sequence (wt) from RVFV(ZH-548)__DQ380206.1__NSm-Gn-Gc
augauugaaggagcuugggauucacucagagaggaggagaugccggaggagcucuccuguucuauaucaggcauaagagagguuaagaccucaagccaggaguuauacagggcauuaaaagccaucauugcugcugauggcuugaacaacaucaccugccaugguaaggauccugaggacaagauuucccucauaaaggguccuccucacaaaaagcggguggggauaguucggugugagagacgaagagaugcuaagcaaauagggagagaaaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccucauag
